United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 6

SEQ ID NO: 13310 - DNA, 60486 bp, Homo sapiens
actgcagatgaagattaaaatctaaacacaaatacttaatgtaggaaaaaatgcaggataatatttttacaatttcagtatgcatatgcagaaggatttcttaatcagaaaataaagatacagtataaacaaaaagaaagttaaacaaagataaattataagcaacagggttcctacaagtgacaatgatgctgaacatcaccagtaatcatgaacttgaaaaagaaaagacaaaatagatcatgctcccctccccatcagattggtaaaattttaaatgagtgctgggaaaatatatacacataagcattgctagtgagaaggtaagttggcattttagaaagttgatgagatagtatctataaatttgaaatgtatatacatagcaaattcacaatgggracagattcattatacaaaaatacttcggcatgccccaaagtataaatatgttaggacagccattgaattctattgtttgtagtaaattgttttagtccaaacactaattcctctgtagcaaacataggatctaataaaatggattatgtgtggaaatcagtcctctttagaaacctaaaggaccaagtgtatcctgattaaaaagataaaacgctttctttctttctttttgtttttgtttttttgtttgtttgtttcgagacagaggctcgctctgttgccaggctggagtgcagtggcgtgatctcggctcactgcaacctctgcctcccgggtttaagcgattctcgtgcatcagtctcccgtgcagctgggactacaggcgcacgccaccacacccagctaatttttgtagtttaagtagagacggggtttcaccatgttggccaggatggtctcaatctcttgacctcatgatccacctgcctcagtctcccaaagtgctttttgataattttgagaaatgatggargcatattagaatgaaaacaacctgaggatgtgcttttatctttgtatattcaaatattttttctcattaaaaagcagaaagtccgggtatgatggttcatgcctgtaaccctaacactttgcggggccgagataggaagatcccgtgaggycaggactttgaggctagcctgagcaacatggtaggaccctgtctccataaaaagcttaagaaaaaaattagcggggcgtggtggagtgcacctgtagtcttagctatttgggaggctgagatgggaggatcasttgagcctaggagttcaaggctgcactgagctatgatctaaccactgtactccagcctgggcaacagagcaagaccctgtctctgaaaaaaaaaaatacacacacacacacacacacacacacacacayaygttagtgggatagcacaaatgagaaaaactctgctctttgatcactgagtacatctctgtagatatatatttccttcactgcagattttgcccaagatacttcgtcaaagacaaagccagtacaccctctaatagggtgaatatggttatgccacctactgagcttgtttttgatactagttaatatgtaaccagatgaaattgtcattatcgtcactgtcaggactatgggaagcttaagtgttctcttttcaaggacaatgtgcgctaactgtacaattggtacaattaaataagttatattcagttcctgggaagcactatagcaatacaaggagaaaatttgattctatttatttttgttaaggcccacstacctcctaatcctaatttctctcatttcccaaatattccttgtttgttcttactgttatgtgttttcctgtattttgctcttctactttcttttccatggactatctttttcccttcctttttttcgctctacccctttacctcagctttctagcagtatttgctaaatacttcaaaactgtatagaactggttcaaattgtgtgctcccttttctgtcaagaacttgctactcaggtaacccaattggtgatttttcctggaaacactgatggatgctgttcctatagcgaaacccagaacagagatgaaatagatgtcatcctcagccattagcattcaaactataaaaattaatttacactggtatagtaaggatcagaatgtcaaagctgtgttacacctagcatcttgtatgaaactaccccattaaggtgagaccacagatattattgccccactattggcatgaaagctgaggctcagagcagttaactgagttacccaggaccacacagctaagttagaagtagggctcaggtgtcctggcaactaactggtccagttattttttctctcaagctcgttttccctctcctaaagaataggaggctctgtcgtggtgaaaggcgattttagtaatactttcctttttatctgtgattataatgaatgcggcatctctcccattaaggatcattcctccacccacattcttaatacatctgctgcatgcatccttcagagacctccctctgggatcatcccttctcactccaaaaagctcaacttctcccctgtcatttgtacctcccactcagcatttttagaagcaatatttcattcaaacttattcaagtttatttccacctaaagaaatattcctttcaccctggcatctccgtcaggtactgctctgttgtttttctccccttcagacaaactgccaaactggctctagttcctcacattccccatcaccctcagcaagcttctgccccacaccggcactgaaacagctgaatcccaatgtccttgtccttaaacccagcagaaaaaaaaaatcaatcaattatttgatttcacagcggcacttgacatgggtagccaggaatttatcaatgacaacctttacagatcatctttgtaatttatsatgaggcatcaaatgaatgctattaacattaatccctcctattttaagtcattaatccaagtaaatgctcacttatttctagcrtcttagaaaccatttaaattatgttacattatgaatcaatacattataaaattataccatcatttgtaataattttttaaaatgttgtgtgctattaacattgatgccttggtataaagtcatgatcattctggtctagtagcaatcttctattgactattctcttactaaagcggtcccttccgtgggactcagagacctcacactctcctgcctgtgtttcttcctctctaattggcccttcttgctccacttgggtgctcctgcccattgcctagacaagagcattccctgtaactctgtcttgggctctttttctcttttcatcaacatcttctacgtgggtattatcatccatttccatggcatcagcttgcccaataaactgataaatccatagtctctataagtacagcagatctcatcaagctagtggcattcagactgctttaactttaaccaaaaataagggattttgtacatgttcaataagcagttcccactgtgacactgtaatcacattttcacaattgtgacctaggacacttagagtaaaggatacagatgattgagacagaaatagtgacaaagaaaaataaggttaggatatagattttaatgctgtaacagacctcaaaatacaatggcttaactaagagaatgcatttctctgtcacataaaggtcccaactggcgtagacttttgatgactcaagggctcaggctgtgcctggtttgtggttctgccttccttaacacatggcttccatctgatgagctacagcagtacctatcactagtcagcatgtccacattccagcctgggcaaggaagaaaggggaagcgcagaactgtacccttccttttttaagtcatgaactgaaagttgcatgtatcacttccacttgccctccagtcaccagaacttagtcatatgccatacccagcttcaagggagtgggttaaaaacatagaagtcaactaggcagtctgcacccagcaaaggatcgggagttctattattaaagcagaattggagaagtggtaacaggaaacaaccaccagcctctgctgcatgtatatgaaacagatgtttcccaaatcactattctcacttattctgtctgatacactgtattttttattatattctctttcattttttaaaatcctggtcatgactcacagggcatgatgttacaacccacttagatgctaacaccataatctgaaaaatattacctatattatgtctaatattggccacttgaagtatggctagcctaaattgatctatgttgtaagtataaaattcacaccagcttgtgaaaacaaattatgaaaaaaaagtctttaagatatcattaacaattttatattggctaaatgttgaaatgatcatattttggatatattggattaaatamaatacactattaaaattaatttaatgtttctctttatgtggttactagaaaatttaaaatttaaaattacacagggcgatcacattctatttctagtagaccacactgctgtaagctcaagattcaaatgtcaaactcctgtgaatattaatacgtgaatatcccacaagcacttactccatcttcccaaccctcagcccttctgtcctccttctgctcccaccaatctgtgtttcttctgtttcactcacccagctaaaggcaacacaattcacyccgtgacgagccaggaaaatggaaagacacattttcctttattcctcacattgatatattcactgagcactataattacctcttaaatatgatataaatctgcaagctcttttcaataccaccacaaattccatagttcaaaatgccatcagctttcacctatattattacaccagctcccatctggtcttcctgcatcctggatcacctctttctagctgccctttcaaatttcaataagagcaagctttccaggaaacaaacctgaagtcaatccactgagtactcctctgaataccttaatattgttgacaaattcctttctgatttgaagtatcagaaaggaatatttcctccataccaaatagttttcatttcatgcatgtgccgtgattcttctccctcctttgcatctgtcattcgttatgcttagaaagctcttttcatctctttgttcttcgagacaaccactactcatacttcagagcttaatttacattttgctttccctcaaaatttttttaaaaggttccaggtctgggttatgtgctctcttatgtgctcccagagcatcctgaacttctgcaataatatgtttggctactgtattttatacagtagttttatattgtattttaactgtattttatacagtaggtgttatattgtattttatacagtagttgtttttctgtctgtttttgccccaacaagaatgtaaaatctttaagtgcctgttttcatacttatttgaccaccctatctctagaatcttgcatgatgtctagccctagtaggatcaaaaaatacttacaaagcaactgaatagctacatgaatagatggatgaataaatgcatgggtggatggatggattaatgaaatcatttatatgacttaaagtttgcagaggagtatcatatttggaaggcagtaaggaagtctgtgtagtcgatggtaaaggcaattgggaagtttgttaggcacaataggtcaaaatttgtttttgaagtcctgttacttcacgtttctttgtttcactttcttaaaacaggaaactcttttctatgatcattcttccagggcctggctcttcatctgcaacccagtaatatccctaatgtcaaaaagctactggtttaattcgtgccattttcaaagaggactactgaattctgatgtggcttcaaacatttaggttaggcatatctaatggagaacttgcagccacactgacttgtagtgaaatatctattttgagcctgcccagtgttgcttaaattgtagttttccttgcyagctattcatacaagagatgtgagaagcaccataaaaggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagrtcttgtgtgggtggaacttcctgtttgcacacagagcagcataaagcccagttgctttgggaagtgtttgggaccagatggattgtagggagtagggtacaatacagtctgktctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtcyttcatttattgcagatttttctttatatcmttccyttttctttcctatgatactgkcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacarctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatktatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaagaccttattagctgcttaccacaactgagactgtgaagtaatggctcactttctttgaggctcagattccatatctgtggagtggaagcgagtgcttaccatacaattttcacagggctgctgaatgtgtgtatgtatgtatgtgtgtatatatattttaatgaaaattctataatttgattagtttttgtaatgtccgcatgactgagagcttgcttactttttacagcaacttgaaggtaaaaatagattttacaacatgaacaaatgtaactacatatttttatttgaattcagatgttcacaaattgttccttaaagtgaagcatgcctacaagttttaatctgtttaagacctacctcaagtaaaatgttcactgccatggcatgtgagggaaaagggaaataattcttatgcatggccttcaacrgccaaatttcatgctcatcagtrcatcttctcttggtgtagaactgatgatgataattatgatgatggaaaaaagtgctgttgatagcaatgcstctcttccttcactttcctctaactgaaccgtctcattcccaggcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttgstaagaactgcaggaaggaatccaaatgtagcaaactaagtatagaaattaaggagcaatgcatgactmtccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggactgacaggaacacatcactccacactacttctaagagtaaaaattgtagaaattaccctgagcaaaggtgtaatatctcttcagagttgtccacatgtgagatgcttacagcctagtgtcagtaaaatacggggtttttttccatagcctgtaaaacatgcttcgaccatgcccttttagcatgtaatatcagcctggtaaagctcagcgtataattgaatcaagactgtttctgtgagctgtatgaaggtgtgaatctcacttacaacctctcttactgatttattttcctccaccttgtgtcctgtctccccatttgtaaaatggcagaagtgattcctgtccatgccaactttccctgctgagaacaagggagtgaagttaagtaagaagggcaagatctccagggaagagtgcaacagcaaataggggaggagacctgcgggtgctgaatggggtttcaggatcggtcctgtatttcaggtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacaggtatgaagaagcctacagacaggacamcttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctayacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctccaaagacaaaagattatggcctagttcttgtttctctttctctcatacccacatccacttcactggaaaatcatgttggcttaaaatatattcagactatttcttatcatctgaactactgctgcaagctagtcctagtcaatgtcatctctaaataagatcattacaataaccttcaaagtggtctcccagcttctactttcactcctctgtctaaaatgaggcaccacacccatcactctgtcagcctaacttggctttgtttttctatttgcacttaccaccattctatacgtattgatttttaaaaatctgcctatttctattataacataagctccattaaaacatggtttattgttcttttgtgcgtggttatattctcaatacctagaatgatacacagcgcatgagaaggtacttaataaagattagtttttaaaaatgaataaacattcatagtagcttcttatcaatgtttattcatttttaaaagtaatatttattaaactaaatttattaatgaaatatgtccattcctcctcattcttagaactacrtaagaattctatgacccatcttaatgattacatctgaacatatttacttatagttacataagtgtttatttctcaacctgtaaaattgcatagcaaaggattgawcttcactaggatgctataagcacttaagacatgttaatccatttttagtaaatggcactttacatgtatatttgttgctgaaggcctagtaagttcttaacattatttattaattgcttaaaatagattaatgaaaagttctataaaatttaatctggaatatttctgtatttcactatagagggaattattctatatgaaactaatttagattttttaaactttttattgtttttaatttttgtggaaacatagcaggtatatatatttatgggttacatgagatattttgatacaggcatgcagtgcaygataatgattatggatgataatcattatcattatccatatcattatccaatcatggataatgattattatcatgcattgcatgcctgtatcaataaatggagtacccatcccctcaaacatttattctttgtgttacgaacaaatccaattatacttttagttatttttaaatgtacaattaaattattttttactatactcaccctgttatgctagcaaatactagctgctttgcttataaatgagatttaagaatatttgaaaataattataaacttcttttttcttttgtctttcagattccactagtatacattcaggtaagcaacatgaaacattccatattaaaaggaaagcaatacatatagggaaaatgttcttatttcagaggtttttacaatatctcagaaacttgtcattaaaggagaagccttcaaactcccatagagctagatggctataactcatctcctctactcaccctttactactaccccatttgmcctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttmacatagcttcgttattttctgtagcaatatttaataccaacccccaaaattaaaacattcttgttttaatggagttttccataattaattaagcacacagtgatctctcatagtccctcaactgaaatcttcatttgagaggaggatagataagaatagattggagagcagagctaccttttcagagccctaaaatattattagggaactgttacagggaacctgaaaataggaattcccccaaagttgaaaaccaatcaccaaccttctttatcaccaatcaacagttcttcccaagtttgaagtacaagtaacagtgccaaagataatcaccatcttggaagaagagatgaatgtatcagtgtgtggcctgtgagttcattttttaaaaatcttttgtgggggattatttaaaagagactcaccatttgggatattttaactactctctccgggagcagtggcaacacaaaaattttaagtgctttgacagcatcctcatctgtagaatgttattctcctgttgcttttctatttttattttctttcacgttcttatcagtattattctatcatgaggtaagaaactgtttctagagaggttatgctaataggattgattctgaaagtgacaaaactgcacacacacacacacacaaaatgggaagggtggatagtgttgaagggtattggttctgccttaaccaaaaataaccaaacgtatattagggagataattaacacatggctataggggaaattcaatcatcaacagatcatttacctgaccttgcatgcttactggaaaaatcacttagattcagaatttgtagagataggcatacaactgaaatctcatctaactcactagtccacctaaggcgggtctacatacctgtctgcactgacatttttacgaagagactgaacgtgatttctcaagacagtctgttccaaccttgaaaagtcttgtttcctggatcttatgttcccatccatggtggcacacagtagcagtagcaggaagagcaggtatagtcctgyccaaagatcacacatgtaatacacctactattcagctaggcccctgctccagttctgtctcacagtgatggccaagttcctggttcctcataactggtgtgatcttgcaaatagacatacagaggacattctcaaataggaaaggagacaaatgcacttggaaacccagcaattgtctatgacatatttacgacacaatcccacttttgtaaaaaagtaaacaggcccggcgtggtggctcacgcctgtaatcccagcactttgggaggctgaggtgggcagatcacgaggtcaggagatcaagaccatcctggctaacatggtgaaaccccgtctctactaaaaaatacaaaaaattagccaggcatggtggccagcgcctgtagtcccagctacttgggaagctgaggcaggagaatggcatgaacccaggaggtggaggttgcagtgagccaagatcgcaccactgcactccagcctgggcgacagagcgagactccatctcaaaaataaaataaaataaaataaaataaaataaacaagtgaaactcgatatagagatggctgcacatggggagaggatgatggaagaagagacactatcgtactaatagtttgtattcctaggtagacttgagggcgtttgggttttttttgttctgttttgttttgtttgtttcgtcttgctggtattgtttctcttttaagaacgggtttaagttttataataagaaagacttttttaagataaaactaaaaaaaaacgaggaaaaaaaagaaatgataaaagaagaatgtaaatttcagcatgttgcaatggagatttctataagagccattagtgactcttgtcttcaatattgtgtgagcccagcagagagcagagggaagtacagacagggaatatactgtagctaaaggggagatataaatagctagaaaatggggaggttcrgtgtctgctctgattcctttgggaatgbtctcatgacagatacacatatgggaagcctgtccctggacatgtgactgtgagcatttgcagaaagtatagtgacgcttccgactgccacggtgaagattcacaggctttctgtgagaaattcagtggacaggtaggttgaacactattttttctagagaatagcgataaaggcattgttgaaaagcagtgagttgcagcatttttctgacgcaggaagagaacaatctagaagagaattccatgttggctattgtaatttttcaaaaaaaatcatgaacttagcacaatgggaattatttatttctcgtaattgcccattgtgagtgtttcagaacgatagacrctgagccatctaaagcctccatgggcattcacttctacaaaggaaggaaaaaaccatacacctcttaattgccttagctggccaggccatcagttctgctctctctgtgaacaagaacctatcacatggccccaccaagatgccagagagttgacaaacacagtccccatatagaaggccgcttcccagccacagctgaatattatggaggaggaaccagactttgatgaggagttctaatggtcaagagcagatgtactgtgtatttcaaaatagcaagtggacaggacttgaactatttccaacacatagaaatgatacatacttgagttggtaggcaccctaaatcccgcratgtgatcattacacattctctgcatgtaacaaaatatctcgtgtaccccataaatatgtataaatattatgcatcctttgtacaaaaaaaattactcctcaaattttaagacatttctatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcattatatttttgtattttattttctcccttcttagctaaacagccatggctgcttctatcagcaagtaaaaaccaaggtcttccagctgaagaggaaggagtatgaaatgaaacttcacactgaggcccagatccaagaagaaggaacaggtttgtgtacwacatgggtataagagaaaacacaacaggcattgattttcttagccaaataatgaattgtaagttggggggaggtgatagaattttagagacatcattcttcccaaaaataacagatttttttctcttttttcagtggtggaattgactggaaggcagtccagtgaaatcacaagaaccataaccaaactctcatttgtgaaagtggactcacactttcracagggaattcccttctttgggcaggtggagtattytccagttcactcatcaacccatgtactgttacctaattagcacaatagttatggtttgtgctaaaaccatgcctggttaatgttatcatttaatataaccaaaagtataaaatatcaccaaggcttgattagtataaccaaaggtataaaactacataaaaatagatttattcttctgtaaatttgtgtatgaaatgtatgtaattatcctaaggccttattaaaattagtagagttttccccccttcttttgaaacagcattgtacaagtcactcaatctccttctcatggtttaccaggcagtctcaggtttttatgacattttctcacaagaatctcaaaattcatgctgaccagtttcattacgatgctaacactaactttgtrtggaaacaggtgggtaggtggttttaatttttattttgaagtattaaagattctacaataatgtttatttcatggatagtatatttacactatttttctataacaagtatatttctaaaacagtgaacatggggtaaaacactgctatttaaggttctcagatttttgaattatgaattttcatgttatctaccaaaaaaatcttctcttacaatttttctgttgtcagcagatgtgcaaatggatctttatgactctagaagtctgagatcacagttacatgtgcctcaatgtgtatttactgtgtatcattttcttaatgtaaatgttacaggatttcagctatgaagggtgtaaaagaggcatagactcaacaaagtggagtacattctagaaggcttggttatgtcatgacaccaaaatgtattcaacttcctaaaatgaaagtgtagctcatttgtaaatttctcagaaagatagtgtactttgtaagtacattttattgctgttaaatatcctatttgtcataagactctctagctagaagaaaatcagaattatgtgcctattcttgtctttgtacatgcagccaacatttcactggcaaacttagattttgtaaatcaattatgagtactgatgggggtcagcctattgttcttcctgctaccaactgtagcttatactgaaaaagaattgccacctttacaatctgaactggactactcaactgccaatacaatattagcagtaaattagatttggcaacttatttaatactgtgtgcctcttttcaattttatatttttcacatgggaagtgtgtcataaaatctgcctaccttccaaaaggctgaagatctaggttgagaagcagagaccatgtctaaggcaactggagaaacacacaggacaatgtattggcaattgtttacttgtgcacttatgagacttcagacactaatctataggaagttaatggtccactccaaaataggtgtttggggcacaaataaatttagttaatagattaatagattaaaatatttcattatcatattactctagtgctctgtgactctctaagagttatatataataatacacagcacttccaaaatatctagaagacatttttcaggtcactcttgttattatccctatcactctctatcccttcacactgctctgtttttcttcttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagttattaccaatataactaatccacagcttttaatcttcaggtgcgcctagtagatgggaaaggcgtccctataccaaataaagtcatattcatcagaggaaatgaagcaaactattactccaatgctaccacggatgagcatggccttgtacagttctctatcaacaccaccaaygttatgggtacctctcttactgttagggtaagtttggaaagaaattaccaatgacatgaagtagccttggaaacaaggttgcaacctaagggtgagaaaatttccaaactgtgtctagttctatggagagaaaaaaactagcaattagaaaccrattgaaggttaacttttttaaagtttatgaaaagaaggcagtatattgtgattaaaagtgcgggttagactttagcagtgttgctgggaacgtaaaatggcggagccactatgaaaaacagtatagtagttcctgaaaaaattaaaaaatagaattaccaaatgatccagtaatcctacttctggacatatattcaaaagaatcgaaaacggggtctcaaagagctatttgcacacccgtgttcatagccgcactattcacaatagctgagagatcgaggctacccaaatgtccatcaagggatgaacaggtaaacaaaatgtggtatataaatacaacagaatattatgcagyctgagaagggaagaaaatcctgtcacatgctacagcatgaatgatccttgaggacgttatggtaagtgaaataagctagtcacaaaaagaccaatactrtatgattcacgtacatggggtttctaaagtagtcaaagtcatagaaacagaaaacaggatggtggttgccaagggctagggaaagagagaaatggggaattcctcttattggtattcaggtttagttttacaagatgaaaagttctggagatctgttgcacaacagatatacttaatactaccaaactgtacactaaagaataatgaagatggtaattttatgttgtgtgtgtgtgtgtgtttataataacttttttgaaaagtgtgaattccagaatctgaatcagataaagtggttaaaaatactggctcaaccctattttaaggaattaactaaaacctctgtgcttcatttccttatctgtaaaatgattgcaatactaacacctgactcttggggtggttgtgaagattaagtgaaatmatacatgttgaatcacttagtaagccccctttaactgttagatacttttactataaaagccaattctaacataattagcatttagttttaaatatatatactccaaaaattattaccttactttattttgtcttgctattctaattttctccagatgacctgttcataccaatataagttattcggtatagcatgcagtcctctattcatcaagagagatgtagacatgtctatagatacatggatatacaatacatatttaatatatattacataatcatggtaatggaaaacgcctgcctctttagagttttaccttgttatagagaaataaataatacattttatttatttagctttaatagatggcrtaaaagcacctccctctaatttgaatgtttactcatttcaaaaagtgtcttgaatgctttccacgtgccagcactgtgctagtcttgacaatgaaattattatttctacctgttccctgtttggggtgatcatatatrtgttgtcaccaaaatatacattaagatatgaacaaaatgttttgctcaaggattcactagtgctattgggagctggggatgamggtagaggaagcctgaaaggagctaaggaataacttctacaggaagaaaagttggaaatataacccaaatagggcctctgaggtattagaatccagattgcagggagcattaaaaatagtcagcctaggccaggcacggtagctcacgcctgtaatcccagcactttgggaggctgaggtgggtggattgcgtgaggccaggagwtcgagacgagcctaggcaacgtggtgaaaccctgtctctacaaaatatacaaaaaattagctgggtggggtggcatgcacctgtagtcctagcaactcaggaggctgactgggaggatcacttgagccccagaggcagagattgcactgagccaagattgtgccactgtactccagcatgggcgccagagcaaaaccctstctcaaaaaaataataataatagcaatcagcctaagatagcccagaagagstagacttcagctaattcatcagctcagctcttaaaccaatgctttctaccaatgtcttctcagacccctaaggttacaatattttatttattcataatacccattcaaaatccaccctaaaagaggcagctgctttctgaaagcacagttcttccatttctagagattatttactctcctcaatgaagtttcatagctccagtgtctctaattgcacaggtaaagcagtcaaagaaatttcaagcaagctaatcagagcaaaggatgcctccttttatgctcttaagaaatataaatctcaatcccaggaggctctgcagtgtaaagtcacaaagcatgcctacatttgaagcagagaaasaaaatcaggggtccttctcccacttttcattgtggawcaaaagatttctagctactagttaaggtaggacagtaaacttacgtagttttgtgagaacattaatctttatgacgtataatctaaaaataatataatttttctaattcattaggtcaattacaaggatcrtagtccctgttayggctaccagtgggtrtcagaagaacacgaagaggcacatcacactgcttatcttgtgttctccccaagcaagagctttgtccaccttragcccatgtctcatgaactaccctgtggccatactcagacagtccaggcacattatattctgaatggaggcaccctgctggggctgaagaagctctccttctattatctggtgagaagggaggttactgcgttgacttcactgtagacaaaagctctctgtggagcaagtaatcatgaagctctttagatgtcattacttcaacttcttatccatgttccttttgaaagtttgatttctcttgaggtgaattattgccrgcagggactcaataaaacaagtatattgaagtgagactgaagcgtgttctctctggcacatttaatttctttttatttccttttttgcagataatggcaaagggaggcattgtccgaactgggactcatggactgcttgtgaagcaggaagacagtgagtatttccatcatctctgcattgctgccccattctgacccattcagccttacaccacggaagtatcagaatactttccctttttttccataggtttttgggggaacaggtggtgtttggtcacatgaatgaataaattctttggtagtgatttccgagattttggtgcacccatcacccgagcagtatacattgtacccaatttgcagtcttttatccctcacccccttccacccttccccctgaatccacaaagtccattgtatcattcttatgcctttgcatcctcataacttagctcccacttcctaatagcttagctgccacttcctaatagcttagctcctacttctgagtgagaagatatgatgtttggttttccattcctgagctgggaatatcaggaatactttcaagtaaygagagaccatttccatctaatattaattaaaagaaagttgagggagggaaaacaataatggtttttttctcaccctttatcaaatatgtgttgtcttttttttcagcctattttctttgcgttatttaaaatattggtgtgggccagctatgatggcttacgcctgtaatcccagtactttgggagaacgggatgggaggatctcttgaggtcaggagtttgagaccagcctggtcaacatagtgagaccccatctctataaaagtaaataaataaataaataaataaataagaacaaagggggaaaaataaaatacataaaatattgttgtgtataatctatgcttattccagatttttaaaccataaatattcttgaacctcttctcaaaatgagaattgtgttagagaatggggtggagaaaatgtacgatttcaaggtatgttgtatataccaggtcttgtgctgagtcatttatgtcatttatattattataaatatcttttttccctttcaagatagttatgatttatgaagcattaaattgggtacttctaccgactgaagcggactcttgccatgagcaaatatgtcataatataaacctttgaaggttgctcctagtctagtagactctaaaagataacttgctagaaaagtatcagtaatctactctctcattagttcttgtagcaacacagaagcaccatagcagactgaaggaaacttaatgcaacctctaaagaatctacataggcatcaaaaaataacttctgaaggagcatggtgttcctcttatggagaaagaaccaaatattggctcatagaaggttaaagagcatgtagcatgaatacaatgtgttgaactcttactcttacatctcataacttcaggttctatttccctcttctagtatgaggcctagatcaaatggtagtgaattggatgtcttcatacccttaactagcatcagaacattaggtgggtgagctgaagcttaaagctggtgaaaaatcaacagagtatatgatttatgagaggagagagggctttgatagggtttttttctaaagctagagtccttagaggtaatcatccatttgttacatctactgtttattatgtctgttacatctactaatggaaatagtcattaacctatgatggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagwcattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagccaaaagaaaaatgcaagagcacctagacccatgcatgtcccaccacaattaatragcaccttgccgtgtatcaaagataaaaatggcatttcatgactagtaatttataagaataattagaaataattctactggctcaagtgattcttgagaatgaaagagaagtgtagggaacaaaaagcttcaggattgacacaatgccaaccctccacgaagtcaagcagagtggttatacattgtacatgaggaacactctgcaaatgcgagygaatgcatgggtaaacctggaaatttgcttttctgaccttttgttccaatttcacaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattwtatatatatatatatataactactcacttctgcagttaaaaaaataaacaaaatacaatatattgaatcaaataaaagaatttttaaaaggacaaaatgtgatgaaaattaacaaccaaaaaaggactcgttattcagacacgttaagcttcttgctcaagrgcacatagcaatacaaattcaaatcttctgattgtgtcaggacatccgtatatgcaaggctggagagaatacagagcagattgtgaaaagtgctatatgagaagtgcagttatgcaaaataaaagaaaggattaactgagcaaccggggaagccgttcgaaaattatatatttaaaatgtaaaaagaccatacagtacccaaagtccttaaaatcccagagctccatgcaaccagtaataggagttgtcaaactagtttcaacatttcaaaaagcctaacaraagtgatacatatacctgcactgaggctatacaggctaaatgaaatatcagatttccgtttttataagaattatggctgggcctggtggctcacgcctgtaatcccaacactgggaggccaaggcaggcagatmacttgagrtcaggagtttgagaccagtctggccaatataatgaaaccccgtatctactaaaaatacaaaaattagtcagacgtggtggcgggcgcctgtcatcccagctactcaggaggctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaaacttagggaaattgaactactatataattgacattgataactgaactctttgaaaatatggagctaatagaagaaataccaaaaggatatgctgaattggaacaacaaaaactagttaatagcatgtactaatagtagtttgctcacatcttcaaatttttaatatgagaccaattgtaataacctcttactgaagctttttctactaccataatttaacaaagagaaatttatatttttattttcctgaaatagaaacttataaaaaaatrtttcttacttgtttgtccttctaatgggattttaactgaaaatattagaatacttctaaaggaagcatcaagtacatttcaacagtaggatctcaagaggatatgtgggaaaataatatacrtgttttatacttttataatataattttataattctcaaagaatttttcaaattataacaaccctgatgggtagataaggcagacagtcctatttattaataataaagcagaagctttcagggatttagtagtagacctgagttaaaacaccaactcttctcaagctttgattagtgtcttaccaatgaaacactttgctgctactagtgtaggtcattcattcaacacatttatttaatgcccactgtgttctaggtattatactaagtgctagtagagatcaagcagtgagctactggaaagataaaaatgtatgtctcatggaacttacattgtctgtcccatagatgagacagacaataattatgcaatatgccacaataaaagcagggagaggaaatgagaaatgttaagatactttgagaaagtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagtgttgagtctagtggtggcctctgaactgtgtaacgaagtagtacttagtacttagatgagtacttagatggagtgtttggtttttcctaaaattgttaaacatcttcaaaatgaaaacactgtgtcaagaaaatgatccataccctctataaatcatcaaagcaatgagagcgctcaaagaaagacggatgttcattattcctgttcttttctccttgaacttaaaaaatgtcacaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtccrgcctgggcgacagagcgagactccgtctcaaaaaaaaaaaaaaaaaaaaaaaaaaaagtcacaaataagtttgcctttttgtctttcgtatttgtacaggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagaggtaaactccttatgttgcagatggtctgatcttaagcttcttaaaatattacacatggaaaagagtctgtatttgaatgccttcatgtcctagttgagggtaatgggatataaagaggtaagtggcttctctactaatagcagcagatctgcgaaaagctgctgaactaagctggaactttttggagtattattcaagttttcttttttcacaggaattaattgctctgtgatgtttattaaaatcacatatacaaaataattactgttgaaagagtttaatgaaaagaataaaattacatccttaagtatataaatatcccttctacagatgtgaatgttaaaagtttaatttaagttaactggattgcttgtcaaattcaataaaaagaagtagctacctatgtatattttataatatatatttactgattagatgataattttctttgcaggacatgggcttaaaggcattcaccaactcaaagattcgtaaacccaaaatgtgtccacagcttcaacagtatgaaatgcatggacctgaaggtctacrtgtaggtttttatggtaaacaaaaaattaataaatatatattgcctaatatattcaccaaattttaaattttttaaaagatacaatgtgacaaaaattaacaaacaaaaaggacatgtgagtcatacatattaaggttattgctcaaggtcatatagtaatataaactcaaattctagtaaatggaggtacatgtgttaggctgaaaggaaagagaaagtttccaagcgtaggattagtgtaaacagaaatagaaatgttcacacaacaacactacattctccatcagtcaggtaaaaaagctgttcaacttccccaaaacatcagccaatatttatgttggaaccacacacattcatcaatgacatgagctacttctttgatgaactgaatagtaatcaagcatttatttatagtcccatattgtcaaatcatgattgaggataagttgagtacagagaaaagagggtcaaaaatcaaggaaagcatttaaggagaatcagttggctctatggaattcactatgaagcctaccgcatattttattatttataaattatattgtataatcctttatcagtaagatatatagtaaatttatgcatgtataggtatatatatatatatatatatatatatatatatgcacaatttttttttccagagagctggttgtgaaatattgaccagcacacccttaatagaaggtgaatagagtgaaggaaactaactgtaatcttctgacacgatagagaataaaaagtctttattattattaaacttttccctcctgtaaactgtttctcaaagccactgtcataacatgtgtgtcagtttttccttgctcctgcagaggagcacaccaatggaaacttggattcctgcccctcttcacggccttgtgtcataacactctccacttagcacagcggcagcagccacataggactccacagagtccttgtgccccacagacaatccaagcctctgtctgccaaagtctctatagcctctgcttatgaccctcctcccccagctcactcctagcttattcttgtttttttttgttgtttgtttgtttgtttgtttgtttgagacgaagtctcactctgtcgctcaggtcgcccaggctggagtgcagtggcgccgtctcggcctcggcctctcaaagtgctgggattacaggcatgagccaccgcgcccggcctctcctggcttgttaagtcawccaacatatttcctcctcaaagaagctttccttgatgacccaagcgccctctcctccttcctctctatttcatcagacgatttgwtttttgttttttttttttggtggcaactattacattctctcataagctttatctgtatgtttattgtaatgtcttcttcctcactcaccatagagtcagatgtaatgggaagaggccatgcacgcctggtgcatgttgaagagcctcacacggagaccgtacgaaagtacttccctgagacatggatctgggatttggtggtggtaaagtaagtaacttcctgcatatgcaatatgcaacaatagaggtccctgactattttcaactctttgctagtttttctgtttttattgttttatatgtttatgatgtacaacatgatgttttgatatatatatatacacatacacatagtgaaatgattactacagtcaagcaaattaacacatccattagctcacattgttacctatttttgtgtgcatagcaagcacacctaaaatctatcctcttagccaagtttcagtatccaatacagtattatcaactrcagtcctcatgctgtactttagatttctaaatttattcatcctacgtaacttcaactttgtaccctttgacctgcttcttcccatccctgcaaccccaaccacctttctactctctgttcctatgtattcaacttcttttagcatccacatacaagtaagatcacgcagtacttgtcctgtgtctggcttatttcacttagcataatctcccccaggttcatccatgttgtcacaagtggcaggatcttcttccacttaaggctgaataatattccattacgcatagccacaatttatttatccattcacccagacacttaggttgtttttatatcttggcaactgtgaataatgctgtaatgaacaccaaaacacatatatctctacaaggtgcttatttcatttcctttgggagtatacccagaagagggatttctgggacatatggtagtttccattttaaaatttttgaggtatctccatactgttttccataatggctgtggcaatgtacatttgcaccaaggggagtgaacaaattccttccagagagacactggaaacagagttttatccstgaaacaagccagtggggcaggtggagagaaagagccggaatggccatatactccctttcaggctcctggagtcttgtttacttctccctttcactcccagatgcaggctgtttagaagcccaacccttaggagacagccagaaatgggagattttgcctgttctctctgtattgagccaaggggtggtgggggcrggtagccactggcattgctcaaaggcctatttaaaaccacctctgtgttcactgtggtctagggagactcctgattgcagagctccatctactcctggagctaggtgatttaggagccagacccttaggtacgagctgtaaacattggggtgcttgatgcatagacaaattattcccaggggtatgttcagacctggttttatccgtggggcgagccaggggaaggaggcatgggaagtgcccttactgcttttcagccttcctgtaagtctgtcgtttccctgctccttctgcttcccagtgcaggctagttagaagcccaacactcagtcagcaactgataaagtgggtagacgaagccsttccagggagaaactgggagctgttagctaatttttcagtactgaagtacttctttcaaacgcattgctaatttcaggagatgtttaacataaatacatcagctaagaagtcttactaatctaattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatrttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatmattcctagggattctctccctagaaaggatgtatttaactgcttacttwctgttcttcacttacactcctctccagctcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtccwaaactaccttcccaaatgcatccgggtaaggatctctttcctaaattaaatacaaggtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggggtgacaaaagtcagtactctattctcatgacagattctacaaggtttcaacctctacgatctcatatatttaacttttcgtagctcattcattatattaaacctaattttaaaagtcgtttgtgagcatcttacctttgctgaaaccataactgtttataagtcttgtatcctctgccgggagatccgggggaatggtcaaagttccagaccaaagaggtagagcagcatgccatcattacctttcccttcctctggtcccatcatgtgaaagagcaggttgcttccaaaataactcagatttacctgtgtaaatctgatacattaagatccacttaaatatatttcaggtacttgatcttcatttatatcatctttaatgtgaggcaacctgaaatctaaccaattcctcaagatgctttacttcaaacccattctccctctsttctccttccctctctactccctttcttatgtgtggtttcaggtcagtgtgcagctggaagcctctccygccttcctagctgtcccagtggagaaggaacaagygcctcactgcatctgtgcaaacgggcggcaaactgtgtcctgggcagtaaccccaaagtcattaggtgagcaaaaaactgctagagataattstctactcaaagattgtatatggcagtgggaaccttataktgagtgctacttccttcaggaaaagaccactagatgctgcgatttttttcctttgccttttattctaagatgcctacaaggatatcctcaacatctccaccttgaattctcagtatcattcacctctcatttgcatgtttccgttcctgcttctgtgttttaataaaacaaaagtttacagagcattgaacatttctaaatcttgagtttggaggcatggaggaaggggaagatgctattcatttctactggcctttttttwcaggaaatgtgaatttcactgtgagcgcagaggcactagagtctcaagagctgtgtgggactgaggtgccttcagttcctgaacacggaaggaaagacacagtcatcaagcctctgttggttgaagtaagtaaacctaaataatatatagtccacaataatatataatatatgtgggtaatataataatatatggatattttataatattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacaggatttcaccacgttggccaggctggtctcgaaytcctggcctcaagtgatctgcccacctcagcttcccaaagtgctgggattataggtgtgagccaccatgcacagcctccctttgatttactttcttaatttttccttcatttgttcatgcatcgaactacctcctacgtatattgcttatatgtacagaattttcttagataatacagttcaaatccttctcttcactatccaaatatctgtggtccctccattaaaacacatgttctgaaggtcagtccattctcactagcttttctttcttttacctaaagcctgaaggactagagaaggaaacaacattcaactccctactttgtccatcaggtaagagtcaaccatcataatttaaaaaacattaaagtctaacatttaaagttcaaagaacatttatatattattcctacactttctctgtgatctaagacctgaagcaccatcaatgcatttgacaaatgtggaaaatagttcttaggaaggccaagtaatttgatcagaatatccctaggcctgcattctgagtcttgatcttttgcagcacctgtgcaaacaccaaatgactttctgaccagtgtatggtatgggcataggtagaaagtgggtagaatcaaaattaatattaccaaaagggatgtttccttaaataattaataatgcaaactatggacggctgaatttagggcattctaacactgagttttacatagccaacagtatttgataacgggattgctatttcccaaaggaaaagttgtcatggcctttaccattattgtcatattaatatctgtttgatgcctatcccgtacctaatgccctatcaaacatttgagaaggaactgaagaaacttacaggaaaaatttaatacactaagaaatttatcagcacaatgcattctcaccccaaaccaacattgaatcaacatcatacataggttcattgcctttctctgactacctacaaatttagtatgtttttcgtactaaatactttatctattcatctgttgccaagatgtaacacataaaatgtaccctaaaaacataacttccttgtcatttagccttatttctacatttaagtgaactgattacctaycattcaatccttttatcatgacttctccgtttctgagttactcattttgatgtatctcttaagtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagatgtatatgtttgtggwtgtgtgatttacatataataaactgtataagtttcattctataaatcactgtttgtttttcamtcagcatcctgtcttggagatttacctatgttaaattgtagatctaggtctttccttggaattgcttttaagcctataatataaatacatcacaattctgcttagtgttttagtcttcctatattggttttttcaactattcactagctttaaaaaattagttagttaattataataagagcctcttaatgaacatatgcaagtacagctagggtagatccaaaatgttaaattcctgagtcagagagcatatgcatagatatgcatagttttgtttggttggttgttgttgttgttctttaattacattgtaaactgaccatttataattgtatatatatacagcakacaaagtgatgttatgatttatgaataaaatgtgaaataattaaatcaagctaacctgaaatacttatgttttgtggtgggaacatttgaaattctctaascaagtttgaaacataaaatacactattattaactatattcaccatgctgtgcaatagatcccaaaaagaaaaaaatgtattccttctgtctgagactttgtgtcccttgaacaccaccttccttttactccagcttcatcctccataaccaccattctactctctgctcctgtgaatttgaatgttttagcttccacatacaaatgagaacatgcaatatttgttttcctatacctggcttatttcacataacataatctcctccagatttaatcatgctgccataaatagcagaatgttcttgttttttaaaatggaayggaattctatgtgtatataccaaattttctttatctgttcatctgttgatgacacttatgattccataactagacagacatcagtaatttgttagggattacattcaatatgtagattgctttgggtagtgtggacattttaacagtattaattcttccaatccatgaacattgtatttttttcatttatttgtgttctctttgatttctttcatcagtgtttwataattttcactgtacatttcacctccttgattagatttatttctacatattgtttatagctattgtaaatgggattgtttttatttctttctcaatcattcattgttagtgaacagaaaatactactgatttttatgtgttaattttgtatcttgcaactttattgcattcatttataagttcttgcagccctttggtgaagtcttttgagcttccaatatataagataatgtcatcaccaacagtgaaaattttacttcttccttgtcaatttggatatttttcatttctttttcatgtttgattgctcttgctgctacttccagtgctactttgaaaataaatggtggcagtgggtatccttgtcttgttccagatcttaaaggaaagtctttcaattttccactgttaaatatgtaagctataggtttatcatacatgccctttattgtgttgagraacattgcttgtatatctaatttggtgagagttttatcataaaagagcattgaattctgtcaaatactttttctccatctaacaagatgatggtatggtttttacccttcattctgtaaatgtaatgtatcacatttattgatatgcatatgttgaacaatttttgcatctcagggataaatcccacttgactaggtagatgatccttttamtgtattgttggatttagtctgctagtttatttcgtgtggttggttggttggtttagttttttaagtgatgagcttttgctgtgttccccaggctggacttgaactcctgagttcaagcartcctaccacctcagccacccacaggtgtatgccaccatgcttagctgctatgctagtattttattgaggatttttgcatctatattcatcaagaatattggtctgtaattcttttttgtaatgtctttttatgacattggtatcagggtaatgcttgcctcataaaatgagcttgaaagtattccttcctcttccagcttttggcagagtttgagaaggattggtattcattctttttaaatgataagtagaacctagcagtgaagccaacagttattaggcttttctttaatggaaaactttttattactgattcaatctcyttactcattatttgtcagttcagattttctatttcttcatgattcagtcttggtagtatgtatatgtctaggaatgcattcatttcttctagatcatccaatttattggtgtatacttatgcataatagtctcttatgatcctttgtatttctgtggtatcagccataatttctctttcatttctgattttatatatttaaggcctccctcttttttcttagctaacctagctaaaagtttttgtctgtctttttaaaaaaacaattyrgtttcattgatcttttgtattctttttctagtctctatttgatttatttctgctctaatctttattattttcctttcttctgccaattttgagcttastttgttcttcttttcctacttctctgaggaatatcattagtatctttattggaaatttttcttcttttttggtgtttattgttataagctttcctcttagaattgcttttactttatgctatgttttgttatgctccatttccatgttcatttgtcttaagatatttttgaatttccttttaaatttctttattgacccattggctgttcaggagcatgtcatttaattttcatatatttgtgaattttttctaattcctcctgttactcatttctagttttcatagtattgtggtcagaaaagatacttgatacgatgaaaygatttcagtcttcttaaatttgctaagacttgttttgtgggctaaaatatgatctatcttggagaatgtttcttgtgtgcttgagatgaaatgttctgtatgtatccattaggtctatttgatctaaagtgttggtcaagttcaacgttttcttattaattttctttctggataatctatccatttttaaaagtgagatgttgaaattccctgatattactgcattgcaacatatctctcccttcaacctttaatatttgttttatatatttaggtgctccaatgttggatatgtatagatttacaattgttatatccttttgatgaattgacccttttatcattatataatgttctcctttgtctctttgtacagtttttgactttaagtctgttttgttgaatataagtatagctacccctgctctcttttagtccccatttacctagaacatctttttccttctcttcactttcagtctatgtgtgtccttaaaaattaggtgagtctcttgtaattagcatatgtttcggtcctgtttttttaaatccattcagtcactttatgtcttttaaatggggaatttagtccatttgcattcaaggtaattattaatttaaaaatgacttggtactaccattttgttgttttctggttgttttgcttctttgttcctcttttgctgtcttcctttgtggtctgatgttctgtagtggtatgatttgaatcttttaaaatttttgttctgtgcttctattaaagatttttgccttgctgttactatgrggtttacagtcaatttcaagctgataacaacttaactttgcattctttcactcccccacacacattttatgtcgttgatgtcagaatttacatattttgtaatgtgtatttattgacaatttatttttagctatgcttgttattaatattttgtcttttaacccttgtactagagataaaattgctttaaataccatcattacagtcatagagtattttgaatatggctctatattacttataccattaaattttgtgcttttgtgtttttgtattattaattaggggccttttgtttcagcttaaagaactcccttcagtaattcctgaaggcaggcctaatgttgacgactcccttagcttttagtttgtctgggaatgttttatttctccctcatttctgaaagacagctttgctggatgaagaattcttgattccatgttgtttttatttttgttttccttcagtactttgaatatattattccactctccctcagcctgccgggttmctgctaaaaatccatggatagttgtattggaattcctttgtatgtgatatgtttctttatcaccttctgcttttcagaatttttttttgtctttgatttttgatagtttaattattgtgtcttagtgagcagttctttcatttgaatttcactggagacctctgtgcctcctgtacttggatgctagcatctatcccctaattagggaagttttcagcccttactgcttttttttttttctgattctatactcttttttttcattattgctttaaatgtgctttatagtctctttcttcttcttctggactttctttaatgcaaaggtttgatttcatgatgatgtcccataatttccataggctttcttcattcttttgtctttctgctcttctgcctggataattccaaatactctatctttgagctcactgattcttctgcttgatcaagtctgctgttgagcttactttgaatttttaattttagtcattgtattctttatttccaggatttctatttggtttctttttgattgtttctatttattttttattttacaatattagctaagttgcagataattgtttctatttcttttttttttatactttaagttctagggtacatgtgcacaatgtgcaggtttattacatatgtatacatgtgccatgttggtgtgctgcacccattaactcgtcatttacattagctatatctcctaatgctatccctcccccatcccctcaccccacaacaggccccggtgtgtgatgttccccttcctgtgtccaagtgttctcattgttcaattcccacctatgagtgagaacatgcggtgtttgtttttytgtccttgcaatagtttgctgagaatgatggtttccagcttcatccatgtcccaggaaacaacaggtgctggagaggatgtggagaaataggaacacttttacactgttggtgggactataaactagttcaaccactgtggaagtcaatgtggcgattcctcagggatctagaactagaaatacatttgacccagccatcccattactgggtatatacccaaaggattataaatcatgctgctataaagacacatgcacacatatgtttattgtggcactattcacaatcgtttctatgtcaaacttctcastttgttggtgtattgttttgcaaatttcatttaattttgtatttatatattcttgtagtccactgaatttcttcaagaggattattctgaattctttgtcagtgatttcatagatctttatttctatgaggtcaattttttgagcttggccagtttcttttggaggtgtcatcattccttgattcttcataatcctgtgtccttgcattrtttgtgcatttgaggagaaagccacttcttctggtttttataggtattctttggcagggataaaggtttgctatttagtctagcctataattctggaaagatcagttggtgacaaccttgagcaggcagagttttcatgggttccctagttggctgggccactgcctttgcycttatgtttggtagggccactggttgggccttgctctctggcaagatcactgttttgtctctgctatctggtggagctgctggctgggtactacaatggcctctggtcaggccagtcacaagatgtgttgcctggctggatgattctgctatttgggacctgaagttaggcagggtcacaatccgggctgtgaggttaggtagagttgttgcttgggatgggcagaaataaatactatacttcttagatgtgcataatagaggattgctaccccacccttgtgaatggagccatggagtgaggttttggctgagttgagctaccctttagactcccaggtcaagcatatttaacccctacacttctatgaaatacacagaggtggtgtctgctacctgggtggggtcactggcataacctctgaagctgggcttacagactggccatctggaaactcaagctaggttgaacttcccaacatgcttctgaaagtgaccagctcagttttgcagatgggctatgcagttggctggtatctctgaatgggtgccatagctggcagaaacacagaagcactaccaaaatccacatgctggtcactgtgagctctgtccttctttgtttctacctgacctcattacttcctgtgttcccggtgaaatgagaccagagtgggcttcctgagaagtgtctttgaatacttgagaatcttgatgtctacccctggttctcttccccgctgtagaaactgtgaccccagggaactcctctctatctggcattgtgctaacctaaaggagtgggaacaatgacatggtcaaagtgagaccattcttcctactcttctaatttgtcttcactcagttctatgaacaatgtaggtgtcctagacttgtttccaagtattggggttttcaaaatagattttctgatctgtggatagcagytagttggactttctgtggagggaggaagatcctgagactttctagtccatcatcttgctttattctgaattttaattgaactacaaaamgaaaatcctcctctttattacctaaatgcatttatacttccaccaggatacatttccatagtgttatatttgccatcatctgttaccatcaaagtttttaattttaatttttgccaaaaatttagaaaaaaaaattttgctgttgttttaatttatattttcttaattacaaggatgaccttatttttgcatgtttattaattgcctttataatctttggctatttgtcttttgagtagtttttttctgactcagttgtatgacactaattctttatctgttgaatatgttgcagatattttctttcacttggtcatttttttaactttgtttatggcatctgtttttttacaaaagttttaacattaattttatgagaaagggaagataactgctacatttttcatttgtatataattcaccaatactaaaattgtagtaaatgtatgttcatcartagcagttattttattttcagtgagtcaagcattttattttgcttagccatttgtcctttaactatgcttatggcttttttttaagaaacattttaatatgaattttatgaggaagggattcagtatgaaaataaatacyatacttctctcattttcatttcatataatttaccaagattaaaatggaagtaaatgtatgttcatgagtagtaattattttattttcaatgcatcaaatactgttcgtcttcacttccttaccctcaattttctaggttttccataaaaatactatctttgtatatgaaatttgaagaaagaacatagcattattatagaattcaggaccttttgtgggtaattttacttatgtatacttatagggctttgttgttggtgttttctccatacaactgttgagtaaggaagttggtggtgggaactaaatagatcatcttgtgataaccgtcttgtgtcagccatcagwwgacagcaactgaatcacaacatcaccaggctcttacaatttgttgtcttatttggcatgcgattctacataaattactgaaaagatcattgaagaagaaattctgaaaatcacaggaaaccagtagcccatttttaagatatttatatattactgttgtattaaaggcggacaacttttcaggaggagtttaggtataaggcatagtcctagcttctgggtcatagagctgtttagaaasatataatgcagaaataattttcatatgtctgatttgcttatttctctaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctcttcttctttgggcttgtttattgctttcaatcatacttctatccctggaagaatcatccttcctaaaaattctcaatttctaagctcaactaattatttctgcttaatgactttgatagatgataatctccaagctttatgacttcccatctctcccattctctaggagacatattaggctctgccatgcaaaacacacaaaatcttctccagatgccctatggctrtggagagcagaatatggtcctctttgctcctaacatctatgtactggattatctaaatgaaacacagcagcttactccagagrtcaagtccaaggccattggctatctcaacactggtgagtgattacttgagtaagggaaaacttgaatgttatttcaactggatttcccagtaggtttcagttacttatgaatattatgatacattagcttagctcactatgatagctgctatgatagttaatttcaaggaaactatccactctccaacctccaataaaatatttaaggctcagaaactcctaatctatgacaacaaaatttaagaaatgtcacaagagaagccaaggtacttttagtaatttctccaccctcagcatgcacattaatccattgtgctgtttcgttaatcttcctttccaggttaccagagacagttgaactacaaacactatgatggctcctacagcacctttggggagcgatatggcaggaaccagggcaacacctggtaaggaaagaacaattttttgagcttctttttgtgtgccagctcttttacatgtattacctcaattatattcacagcaacactatcagatatgtattatcagaccgatggtttgttatactagataaatccaccaagattagcaaggtaatcagaagaaaacctgatatccaaatacatgttatgttaggcttgtttccaraatggatcctattaataatgtaccaaggttttctttctgaaatggctattctttctaaagtagctaccataaccatgagttttaaaatgatattgccagtgaacatatataacttccagataaaccatgttaacttcagcttatattgtcacattctaagtcattcagcttgacttggaatgaattcattaataagaggaaacaattgagaaggaaacagtaatataaaacatttttttaaatccctaaagtaaagcaatattaaaatttactgcatgtaagagctgcatgtgagaagattctgtcatctgcagaaggaaatctctaaagataagagagatttaaagccttactcaagtaactaacaaaaataagtacattcaaattacttgaatgtaaatttgttcaaccattgtggaagacagtatggcgattcttcaaggatctagaaccagaaataccatttgacctagtaatcccattactgggtatatacccaaaggaatataaatcattctactataatgacacatgcacatgtatgtttatygcggcactatttacaataacaaagtcatggaactaacccaaatgctcatcaatgacagactggataaagaaaatgtggtacatatacatcatggaatactatgcagcaataaaaagaaatgaaatcatgtcctttgcagggacatggatgaagctggaagccatcagcctcagcaaactaacacaggaacagaaaaccaaacaccacatttctcactcataagtgggagttaagcaatgagaacacacggacacagggacaggaacaacacacaccagggcctgttgggaggtgtggggtgacgggagggaactaagcggatgggtcaataggtgcaagaaaccaccatggcacaygtatacttatgtaacaaacctgcacrttctgcacatgtatctcggaactaaaataaaattaaatatactwagactccctgtggcaaagagagagttagcaaggaaatactacatctagcagattaatcaggcagactaaagattaatcaaggagataagmtctctaagtacacaagaattttgttagctaactcacatcatatgaagcctgttgctgtgaagtggttataaaaccattttgacaacataaacatcatgattgcttcctccctggtcaggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaaggtgaatcattctggagctagttttgatttgtccattatgatatctgcaaggatgaggataggaagtgataatgtgaaaaattctaagggaaagcctcagaggaaaataaaacctggatggcaccaaaaaagaggggatagaacaaaagttgattgtgatactttgycctatagggatggatatgggtaaggatgaattccatgacacagcagaatagaaagaactaatcaatagcattctcagaagttgaattattcaratctctctctygtattcacagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcrtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttataaaatctaggatttcttaatcaaatcagaaatcaraagacaagaggcygtgcagatgcttctcaattacgatggggttatatcctgacaaactcattgtaaagtctaaaaaatcttaagtgggaccattgtaagtcagggaccatctctatagtatgctggtaagaagagcattctctggagactagctccaaaatgtgctacctatgtgagcttgggaaagtcattaacttccttgtgtttcagttccttcatcagtaaaatggggataataatagtatttacctcacagagctgttgtaataaatgaattggtacacgtaaaacacttagtagagtacatgtcacatagcaaatcctataaaagtactagttattacaaytaacatatcagttctcaatatatgcccaacccttacctggtacattatataaccttaaacataagaaaataatcatggaagtaactccttgaatgaattctggtattttaagcccatttcataagaccaataatgttgaccaatctactcatattcacacagtacttctacatataccrtggtctatatgarcrgttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacarctctctcatagattaagaaatagaaaattaccgacrtgggaaaaataaatcccttgtgtatcactaccacctccagaggcaatcattatcctgaatttgtygttacaattccatggatttccttatatttttgctgcatatgtatccctaactaatatttagaatcttcacrtgtgtttcatcttgagagaaacaagatttttatttctctcttrttcaagaaacaagagaaacatttttgaatatttcagcagcttagttttttgtttgtctgctttttattttctaagttcaacactatgttgatgaagacccctatacmagtatgtgcagagtcagctcattaattttcactgctgcataatatattacagtctataaattagtcataatttacacatcgagtttctcctcatggattttttttatgttttgctaytaaaaamaatgctgcaatgaatactcatgtgcctgttttcttgtgcatctgtgtttctccaaattatgctttgagaagcataatgactgattagtgggctaagcacatcttccccattgctgaatattgccaaagagcagttggcttcccacagcagtgtatwttggttcccattgtttcacatccatgtcagcctttggtatttcaaggattactgtattttttttttcaatttaatgagtasaaactctactatttcatgtgatctgtgatcctcacaagaaactgataaagacacactttataggaaatgtaacaaactccagctatagtctaatataacatcataaataggaaatagccagactcaatgagacaactgctgtgccatttctttctcccaccaacccgactatagcaacgatttgaaaacatagataggcataggcttctgactccagcatcaatatctgccttagctgggctaaaacacaccaaattcagatttacatgaagggaaaagcatctacatacagtacaggggattataatgggcatgcaattctcatttcagcactggcttgggtactttcaccttgaattaaatataaatatgtaggcacttataaatatctttttctcatctttaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggttggtgatttgccaaaaccttttatttcaccttcaggtagcaaaagwtttgaatgaaaaagaaacaracacatccaagaagaaaaaaatacagatgwcagtaacttgaaatgaggaaaagttttcagtatccaaggataatggaaataaaagcaaatcaaagtcaaagagrgccaaaaggaaatgctcagaatyccggcaccccatcgctgtgttattatccatctcctatttcccataacaacactgccttcctcaagcagcagtggagcaccagcagaatgaaggagatgtctcctgccattctcctgaaagctctagggtctctttcaaactgttcaaaggaactctactcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaagcgattctagtgcctcagcctcccaagtatctaggattacagtcatgtgcaatcatgcctggctaatttttgtatttttagtagagacgaggttttgccatgttgcccaggctgatctcgaagtcctgagctcaggcaatccatccgccttggcctcacaaagtgctaggattataggtgtgagccactgcgtccagccccctattcacctcttaatacacaaacatttattcatcaggagcataaagaactgtctttattcatccaacctcctaaatctagctatataaccatgtatctgaacaattcattgatatgtacacagcagaaagttttatcttcagagaattyggatgtttgcttatataccctaaaayggaaaaaatgtgacaaaatggcattccatcctatttccattgtattaatcttttatcatatgaatgaaaaaaactaagtaattttgttaaaggttatcattcatttattagaaacatattatttgaaggaggccaagcaggtttaatgttgttgaggatacataccagcagacattcactgggaacaggaaatcatccaataaaaagggaaagccaaataaaaatgtcattaaatccagaagataattataatactcatcttttatttcttttggagaaactgaagcatgactctgctcatkgctgcaaagaaccttgggttctctccaggacactgacctcagcaactgagcaaagtttaatatgggagagagccagactgaactttgcttgagtggtggcagatatgagcatagttgtcaagaaagacatgttagcaaatagctgatgccaataactgattgccattcacatgttttccacattccatgtcccacatatacttacagagagaaaaggatcaattttctgataaataaaataaacatgtagggcatacagtccaaggtagatatgtgaatgttatggttcttcaactatctaaagattataatcaatcttgaaattacagctcctatatttaagtagtgagggaagtaggaaatcaaagtccctcacatgggtctttgaaaaatatctcagccctcaaagccttataatgcccaatgggttctctcactcatctgtctctaacaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaargtgacaggagaaggatgtgtctacctccaggtgagactcttgggcaggtgaggacaggacagatgaggacagcagctgttctctctgagaagtcctaactcagaaaacaatgggacagatcagagaaagggttagggacrtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaatagaaggaagtagtgactccttagttagaattcctactggcaataataaatctcaggttatatatgatataattaatttggggggaagatacacttatatgcatcaatatttaaatagctgcagatctgataaaaaactctctctccacaaacatattattacttggttggagatactattcaggaaaaaagttaggacaaaatacatgtaacaaataactggcacacatcaaaaagaatgagatcatgacctttgcaggaacatggatggagatggaggtcattatccttggcaaactagcacaggaatggaaaaccaaacactgcatgttctcatttgtaagtgggagctaaatgatgagaacatatggacacaaaaaggagaacaacagacaccagagcctacttgagggttaaggatgggaggagggagaagatcagaaaaaaacaacaattcagtgcaaaatttagtacccaagtgataaagtaatctgtacaccaaacccccatgacacgagtttacctatataacaaacctgcatgtgtacgcctgaacctaaaagttaagtatatatatatatwtttttttcatttaatttggtgtatatatatgccaaaaaataaattaagcagtccaaatttcggatgcaaactctrrgggacaagacgctaggtgtttctaagtgttttgttgaaagccagtgtttaagtaaacattataaattattgttgtttttgtaaataatgtagactgaaatttattattcataatatacatcattttgtcagctgaaagaaaataaaagtaaacaaataaataaaataactggcatagattagaggtcacaaacagcctgtgcatcacttgtagagctttcttaaaatgcagatcctcagccgggcgtggtggctcaygcctgtaatctcagcactttgggaggccaaggcgggcagattaccttaggtcgggagttcragaccagcctgaccaacatggagaaaccccgtctgtactaaaaatacaaaattagtcggamgtggtggtgcatgcctgtaatcccagctactcgggaggctgaggcaggagaatcacttgaacccaggaggcggaggttgcggtgagccgaaatcatgccattgcactccagcctgggcaagaagagygaaaaactccatcaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatayaatcacatgtgtttgtatgaatgctgaccatgtgcagagcactgygctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaaggraacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaratcttsacaaaatgtgtttattatgttgacaagttttttggatacccagtaatayaaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagahcctctttgagtctacgcaagtattcctgcaagacagagaagtcaaactataccaaatctctggatattaaaaaatgaacacagttagtcrtccaataaaaagtatatatcatttacccccatgaacagagctatgtattggcattgacagaggtatatgcrttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcytcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcycctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgycccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccwctgtactgattaggtttccttgggcactatgctacccagaactaaggsaaagaatactctctgctcatggagacccaaatctgtcttaattttttttctttccaatgtcacagatcttggaaatgcttgaagaccacaaggctgaaaagtgctttgctggagtcctgttytcwgagctccmcagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgyaaagtgtgtttggttatgggaataccctatgaaaaacccaaagggtgaatttttatgagaaaataaaagactgacttcaccagaaaagactttttacattaaaatgaagtagaatgaaatacaacattgaacakgtcatattgagaggcaagataattgggacttgacctgaattgggagtgatgtgtcctatgttacamcaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttyttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggmcccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagmcagatgaagaggagcattactgagcaatggaacagaaggataaggaagatgaagaggaaggagacctgcagttagtagctcatttccacagtaaggatgtyctttccacagcaagkgtgtcccaacgagtgttcagcttctagcagaamggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggcttcaagccctcaccagcttsagggtgggacttcactggggacccatccccttccacccaggaacctgtctgcctcctgctcccaggctgttcatgccaaggagcgcctgmaagtcagtgtccagctgtcttcagacccctctcagcctccctcccacgcttgttggtgcccaagttccaaagggggccgagacggcagggggctggcgtatcagcactgtcctgagcgtgtgcacgctcggccaggctgtgacagtacccaggctcggcccgaccttgctctgagttcagagtgggtgctaacagtggagrgaagccaggcagccggagtaggcaccctggagcctgcagtgggcaggggactttgctgggcctctgagagcacagaaaatgtccacagccgcggcaaggtggctgcagctgcaccctgggagctcctgctccaccagttcggaaggggcggggctcctgcttgtccctggctcacctgctcctgagtgtgcaggtccggtggcgcctccttgcaggctgggctgatgggcgggggcgggggsgsgggggaggaagggaatgttccaggtcctccctgggcccgggactgtgtccggggcagggatgacgtcgctgcaagttcttcccgtggccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactaccttaacaaatgaaattgaagcagagacatgtaatttgcccaaagttactaagttagtgacaaagctagaattcaagaccaagaagtctagcttccatgctcttaacttccaaccatggtgacacctcaaacaacttcagacaaaaaggccaggagaaagtatatttcagagcttaataaacattataattagctgtcaaattaagtatcaagccagggcacagaacataaaagaaatcagagtatggctatgggaacaagacaacaggattataattttacctcttggttctagtttttttctttgttcatatggaaatcgttactgaaaaggtactttaaggatatgcttgttgcaaatcattagctgtatcactgaccaagagtgtttattcctgaaatactaactgattgcctactatctgccaggcacaatatcccatgctataatacaaaattaaacaaaataggattcctcccttagaaaaactcaccgcagagtaaaagaaaaagatacacatctgggtcattataatgatcaggtgctcaagctattcattgccccagtggactggagatacaatggccttctcaagttttggggtattacactcaaattcatatgtaatactggagaaaaggcctaattacaactwaaactggatttcccaccagcctggtggcatgggaatcttggaattaaaattacgtagaatttttaaaagtgatgtatcttctacatctgattttgtgaactgaagtttattctttccaggaaagcatatagatacacgacaggaaatgaaatggatacttgttggggtcagttttatgtatagtttgtattttattttgaaatatgatacactgctattctcttgcattttcttatatgtgactcaccactaaccctatattcccccatttcaggccagttggtcataagcatccatttgcctcagagaatactgggttgttatgacaagaatataaagttggaaagaaatagaatatttgagtctaccctgtaagaataaaaagaataaaaggggtttaaatttatttagaccctattgtttaatcaagaattctggccaggagcagtggttcatgcctataatcccaatgctttaggaggccaaggcaggaggatcatttgaggccaagagtttgagaccagcctgggcaaattattgctcgggaaaaaaaggtcttatttagtattttagtctttacaatgtttttttctattatgcaatattctctcaaatactttatgtccatccacgttgtctgagacatgccactttaacattctagttaygctgtagctgtcattttaccctaagccgttagtagtactgatccacataaaattgggctgtttaggtgtttaactgtttaaatgtataatatatctgatatatttatatattgtataaaaaatcacctaacacaatagatatttactatgtctgctataaatatatatcatataacatataacaatatattataaatgataatatactataatataaaatataataaatatattataaatgtacaatatatccgatataaatatataaatatgtcaactatattatacatataaatgtatatgtataatatatacatatatgtataatacaatgtatttattatgtatatatataaatgtatatgtataatatataaatgtataatatatctgatataaacatatcagatatattatccatctattgtgtcaggtgattctttatacaatatataaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatataaatatatcagatatattacayatctattgtgtcaggtgatttcttatacgatatataaatatatcagatatattatccatctattgtgtcaggtgattttttatacactatataaatatatcagatatactatacagttcagcccatcaaagcaccatattttggggggttggtttccgtgtcccaacactagctacgaaaatattagctattagctacctataactcttcagtagtaaattcaagaaacgtaaagtaattctcttcattaagttcttgccttgtctactaaaaaaatggtcatcaccgatgtggacaatgaagacctgtggggttaaaagctctaactagtatgcctccaagattctttgattgcctgccatcatgatcgaagaataaataacttctttttcatcttatttatttattttttgtagagatagggtctcgctatgctgcccaggctggtctcaaactcctgggctcaagagatccttctacytaagcctctcaaagtgctggaattacaggggtgagtcaccacgactgaccattaataatttctttcaatgacactttaacataggctcattcatctttacctctaa

SEQ ID NO: 13311 - DNA, 45038 bp, Homo sapiens
  misc_feature (1)...(45038): n = A,T,C or G, or insertion/deletion polymorphism (see Tables 1-2)
gaaagtatgtcataatcctattttaaagacttcacatgatctctatcacctactctgcccttaggtcattgatgacctgctatatttattttcttctattgcataacaaaatacaagaaatttattgacataaaacattagccttttattatctcacagttacaaggagtcaggaatccaggcatagtgtggctggggtctctgctcagagtcttacagactgaaatcmgggtgtttgctgggctgaattccttctggagcttggggttgtgggcagaaaccagttccttgtagctgtagaaatgacatcctattttgtctttgctggttggtgagagtcactcttagcctttgaagggggccatgcggctaggacctgaggtaagtagttcataacaaggccatttgcttctttggggccagctgtgaattactagacagtctgctcagatggagtctcatataacagcacctaatcaagggagcagtgatcccattatagtcacagatcccacccacaaaaatggagaggggtgccaaagaygggaatctygagggccatctcagaatcaggtctgcaaacctgcaacttgtcgcatccagtcgggaaacttcacttcttttggtatttgactctagaacagttggsaccattgrccactcccaccttgaaattcattcaatgactcctatttatttattatttttattttttatttttggctstcactatgttgcccaggatggagtgaagtggctatttctaggtgtgatcattgcacactacaatcttgagctcctgggctcaagcatgggacactgagcccagcccagcttatccattctacttttgatgaccatttgagggatctctagtttggtgatttgtattagttatcttgctgtgtgacaaatcatgccaaaacacagtggattaaaacaccatgtattacgtgacagtttctgtagattgagactccaggcatggactcttggctaggtcctctggctctggtctctcacaagactgtaatcaaggtgttagctggggctatggtctcatcttaaggcttgagctggggatgattcgatgctgaattcgcttaagtggttgttggcaagaaccattttatcacaggctgttagactgatggcttcagttcctcaccagctgttggcaagaggcttcccttgagtccttgccatatgggtccttccatagggcagctgacaatatgacagccagcttcatgagagcaagcacgcaagagggccagagagagagtgtgagcaaggcagaagtcacatccttttgtaatctaatctcagaagtgatatcccatcaattttgtcatgctctatttgttagaagaagttgctgggtccagttcacacttaaggagagaagattacagaaagrcatgaatatcaggaggcagaaatcttagggagccatcatagaagctgtctagtacaaaggatataacaaacaatgytgccttacagattttcgtatatatattgtggcatatgagcatatcaggttatgcacctaggcatggagttcctaggtcttagggcatgtgaatcttcaagtttccatgacagtgccaaacttctaccaagtggttataccaattcacatttccactagcaacaagtgagaattctgtttgcwccatatcrtcrccaacactttttattrtcagacattttatttttggccaatatgatttatataatatgtgatgtattatagctttaatttgcatttctaagatttctaatgaggtttggtactttttcatttatttattggtcatcttatatttcctcttttatgaagtatctgcctgtatcttttgtccatttttctactgacttttcttactgatttgtatgagttctgaagataatctggatgcttgggctgtggcagttatatgtgttgcaagcatctctctggttttgtttcctatctttttattcttttaaatatgtcttttgatgaacacaaggtcttcattttaaggcagttgaatttatcaatcttttcctttatgaactcttggactaagcctgtcttctagctattgttttccgcctatgtctccaactgtccccccatctttgatccccccattgtctccatataaacatcttttctatgctctggacacatgacttcaactgctcactcgatggctccacctccatatcccacagtcagtccaacaccagtttatcccaaaatgaactcatccctccaagttcaccttccgccaccctaccacccctarcttgtatttcctaactccatgactgacacaactatccaccaatcacaaagccagtgtcttgtgaatttgccctgactgctctttctcttataaggatccagtttttctgattctacaatctaaaccttgccccactctgtcttctcctctacatctccagtgccagaatgtaagttccatgagaccagggaccttgtccagcttgttcattaccacaatatcagtaagggatggtgcttaacagcatgaattttgcagcccaattacctgattcaaatcctgactccatcaattattaggtatctaagtaagtggaagttatatgacctcttctcccgcagtttccccattggtaaaatgggggatgataatagtactgattcatagggttgtggtgagggttgmatcagttaatgcatgtatagtatttagaaaagaacaggacacatggtaagcactcaataaatattgactattaatattataccctaccacctagcatgggatggggtataatattaygcatcaaaatrtattttaagcatcaacaaatatttatcatcaaaaaactaaccatcaaataatatatatcaacagagatgaatgaatgccactgctttaatttagactcttattatcgttgcttagacaattgctgtagcctcctaactgggcttactttctgctaaccatcccatcccccattccattcattttacacactgccattagggttataacttcttgtctataaatatgaaggtgtggtgccactccattgcttaacaccatccagtggatccccaagccctacagggaggcagagcatagcccagactcctcagcagaacacatgtrcatgaacgtgkgatctggtgattgcctacctacctcttcaaccgcctccatccttcacacaacctgcgctccatttaccaaaccactggcagttccccaaatgagccayattccttcattcgtctcctgcccagaatgccctccctctgtcccrtccaggtgacaaagtcatctttttctttttcaccaagtcccagatataggcactcccaggcagagttagatacctatattattgcagcatttatcaaattacactataaccatttatttacatgtccaaccctactcccccaggctgcaagctcctgagagccagatcgtatttakatttgtatttctggcaagaagcacaagggctacggaagcttaatacacatttgttgaatggatggttagttttaagaagtacctaataaaccttggtatttgtatttccttgaatcttgttttggttgctaccttttttaatggaaatagtcactactgcttatgtttacaagtttattgagttctaattttatcttttaagataaagattgctgatatcattcattcactcattcattcatcaataaatatttatagggagacacttgtcagatactggatttgaagtgaacaaatcagacatggcccctaccctcgtgaggcttacagtctattaaatctattaagtatgaaggacaggctgaccttgaaccaataaacatgtccatgtaaaatcataaattgaaatgagagttgtgaaggaaaagaataggttataaagaggaagaataatgggagggacctaatttaattagaagagttagggaagttctctttgaagaagttacattacagggaacactaaaatgtgggtaggagtgagctaygcaaagtcatggagaaagagtattccaggtagaagaaatagcatgcgtgaagaccttaagcaagtggaaggcagctgctgaggctggggactgggaggttggggctggaagcagacaagcctagagaagttstcaggggctagacgatggggttttgacctagaatataaactttgtttgtagttcatagggaagacattgaaggtttaatatatgggaatgacgggaacctctggcagggctctgcctgtgagcatcacatagcaccccgaggatgtgtttgctactctaggtttcagtggagaaaaaagcaagtgamaacccttctgttcctgctcagcaaaagctttgatcaccagcccccttcccctgaatatactggagaaaaataacagaagtgcatttcaaggtccacatgtgagaagaccctaagctgtcctggctgttcaggtagaagttgtcatcttcctcaatgatctcggmtgttggaagacatggccaggcagacagaatctaaaagttcttccaggtgtgacatgagtccctggagctcagtgacagaaaccagtgtccaaaaccagatgccaccctggggagggggctttgggagttcctgggaggccataacaccgtctggaaggctcctctctcccacatattcacaaagttgcatgataagccaggcccctgctggtcttgcagcatccacctatgatgcagagtaaacagtgccacacgtcaagctgtccccaaccttgccctcggttccactaccaaaagagggaacactgggcttgccccagcaaggtgttatttatgtcaggctagggccactgtggctcccagctcttactgctttctaggtgcccttacagacttccccactgccccctgcatatgccagagtgtgaacatcccctccctctccacagcccccacagtggggttcgggtgggcagggaggtggtttcatccctctacatacagcccttggagacctacctaggcaatttgtcactcaggcttcaagctgccagccgaggaggggagctgagaagactctataatgagatctttgcactgtwattaagtgccaggctttgttttacacctatctttcccgccttgcccgatcccaccgccaagctcctccaggcagtgagtggggagtgtcagctgctctgtgattacaccccaagtggcaggtggcagggagctcctccgcctgcagtctgcgccccacccccaggcttcccccaccaccagtcttaactcaagacagtgctatttctgtccttgaactgggtttcaccccagaaagccactccaccgctttctcataaggctacctccttttaaccctgtggttgcacggcctctggggtgtccatttctttcttttgacacgtcccttttcctgaaagtttcagcaaaccccataggcagagggrgttaraaaaaggaaaagagaagttagggcaggaggagcactgttcttataggacaggaagggtctgtcttctctcttgggtcctccacacaaaatcggagcttccaaacaccccagctcccaaacatatgcagcagattctgctgacaggaatgtgtcactgtgatcttcacattttagcctgaagtttagcctacctgaagaagcaccggagtgggagtgggagaacatgggatggtgcttctctttggcctggctgtgcttttggacacttcaggtcttcggcctgggtttcctcctccgtacgatgaggagaggatgggagggggcaatgctggcatgtgtgatctcgatagacactgtggaagtctgcagagaccggagcataacctctgcctcctctccccgggcctagcctctcacagccctcagagaaaaccctgagctgcggcdtggccgagacgggggcgtggcctggcaggtgggcgggcccttccgtgggcggggccgcgaggttttcaggakcccgagcgagggcgccgcttttgcgtccgggaggagccaaccgtggcgcaggcggcgcggggaggcgtcccagaggtgagcgccctgcagcggcaggggatgggccgggggccctaagtcgtaggcagcgcggggcggggacgcggctgcctgcggaggtcggactcctctccgccctcctcccgggctgtccgggtctattttccagtctatgtccaactcgcgccgcctcactaggcggcgctctctgccccgcggcacccgcgagacgtggggtccctcggcccagggacggggtgagcgtgtcatgtgggtgccctgtgcccggcaggttggagacgaagagacctcggcacagacgaagtcactcacatcctcgctttgaaacagagcgggtccttcttgtgctgtctcgctgtcactctcgcccccaccctgtggaagaggcaggtggcttgtccccagtcactttcttccttggaaaagggagacagagggccatctccagcagggccatggaaatcccagaaagtcactgagctgctcaacaaaaggccctaaacaccccaccccacagcaccaggcagtgcacactggccaagactccgtggtaaatattgctggcctttatgttgagagggggaaaaaaaagcctgcctgtgaagatcatygcccagtggccatgctcctgtgaaaacacaattggaaagccatttcctaaggggcgagggtgggtctgggaccatgctgtggcttgggtgattggtggttgcaggagtgagggtgctgccctgggaaggcgctgaggccctgttgggtgggaatcgayggctgcggctttctcccggaggagggagagcggtgttgttacctagtgttgggaacacatccgtccagcaccgtgaactgcaaacaagcagagtaaccctagtgtccttcagatactgttgctgagcagtcacctagtcaatgagatgatctgtttggacggcaagtgcatctgtaatgccgccctcttgctcagtgcctggaagaggcattggtgactccccgctaatgctaggggtagctaccgtgcaggagcagtcaggctcttgcagggccwatgtggtttcatcaattttctcctgcatttacccagcccctccgaattctgagaagtgcgtccaagatctcttggactccttgactcagttcacccttgttcttgtgggcagaaaacaattcccagtgtgccatgcacagccagtcagaagggaagccctggagcagggccctgggagaagttctgtggggctggatgctaattattcagttactggattgtggggaaattccaggggaggtcccagaggagagaccgtgctaaagctaattactaagcagtacaaaaataatctctctctctctctttctctctctctctctctctctctctctctmtmtatatatatatatatatatatatatgtaattttttttttgagacagtctcactctgccgcccaggctggactgcagtgacacaatctcggctgactgcaaccactgcctccagggttcaagcgattctcttgcctcagcctcccaagtagctgggattacaggtacccaccactacgcctgtctaatttttgtatttttagtagaaatggggtttcaccatgttggtcgggctgatctcaaactcctgacctcaggtgatccgcctgtcttggcctcccacagtgctggcattacaggtgtgagccactgtgctgggccaaaaataatctaaatttcaacaatcagcatgaccatgcctgtgcgtatgaccctaattatcagtctgactgattcttccttccaaaatgatggcagaggatcacctctttggatatttacagctctgagcaaagcaaaaagcatgtaggtgccattgtctgaatgcaaaaccagccatgccaggttttcggtgttgtttctgaggagggagcgcctctctggaggacggtgtttccagaacagtgcctccgttgttcattcccgtgcatcaggaagtttggctctgctgagtgttgaaagcaaaactctcctgtttatttgtctstgtatactracagacttaaacagcagacagcactggaatgtccagttactgcatccagatgtgtttgtttcactcttaacattgtggaaaagaatgcagaaggcagatccaaagcttcaatcagatttctgaagcttaagtgattcccagccttggtcccttaatgtgagagcaacagcgtatagtgtcttccgctctctgggacaaacccaagtttgaggcatagtccctgctgtccaaaagctcctaggtctaagtaggaagacaaaaccagcacctgtgaaacaattagagcgcaattaagtgcgaaagtatgtggcagcatctgctagctcaaagaagacagctagtgcagactgactgggaaaggaagagagagcttcacagagccagctggtgttcagcttgacttaagaatgaccatcaagggcttggccaggcctaggaaaggaagcatgaggatatatgaagctcagaataatgaaaggcacttgctgcccagagccaattcaaattcctgccttccgggaattctggctgtgggtcctgccactctcttcctcacccagccatgatgcccttcttatagcattctaaccatgccttttttttttttttttgagacagagtctcactctgtcacctaggctggagtgcatttgtgtgatcttggctcactgcaacctctgcctcctgggtttaagtaattctcctgcctcagcctcccaagtagctgagactacagtcacgtaccaccatgctcagctaatttttgtatttttagcagagatgggatttcaccatgttggccaggctggtctcgaactcctgacctcaggtgatccacctgccttggcctcccaaagtgctaggattacaggcgtgagccaccacacccagcctgaccatgcgttttttgtgtgcctcctttactttatgcctactctcctatgctcaaaatgctctgctgaccaatcccctacattttttaagaagcagctcaaatggcaccttctccagtgaagacttccctggcaggcccctacccgagtgtttgagcagagttggagggtttctcctttgttctccattggtccttgcatagacctctgttgaagctccgtattgtccataggagttaagggatctttgactcactcactgaagcagagctgtgtctcacttacatagggctcccctgagcygaatttggtgtctggcacataagaggcgtttgataaatgattcttgattgaaattcaagcccttataggtaacagtgaagtgccccaccaacttggagtagaaggcacaggttatgtgttacaaggagtctcagattggataaattagatggagccaattcctagaggccttgaggagtctgagtgtaatgcagtggtggtgctcaaaactcagagcaccccctattgccttcactatagaattctagagtcttcttgatctgcccccagcatatcctctttagcctcatcttccaccagctcccaccttgagcccacaaatctaccttctgagccactgcagccccaggtagctccccaggcctaggctctctcttctcctttgtccatgctrtttggcagccttggccaggaatgcctactgctctccctagctaattcctgatcattaatactccagatctgaatcccctatgtgcagaggcccctcangctgggttttcaaattctcctctgtgctccatagcaccctgcacakcctctaayagcatttatcacaccctcttatggctgctggttacttggccatctccctgctgggatggctccctgaaggcagtgattgagttaatccttgatgtatcccccatcagctaacattgttcctaggagatggtgtccaataagcattggatggtaggctgaaccagagtgataaaaatatcaaacgaaggacaaatctagagacatctggaaggggaaaactagaatttggtgatgagttatataaagagagtgtattagtctgttatcacactgctaataaagatatacctgagtctgagtaatttataaaggaaagaagtttaattgactcacagttccacatggttggggaggcctcacaatcattgtggaaggcaagggggagcaaagtcacatcttacatggcggcagccaagagagcatgtgcaggggaactcccatttataaaaccattaaatctcgtgagacttattccttatcacaagaacagcacgcagaagacctgcccccaggattcagttacctcccactgggttcctccctcaacacgtggggattatgggagctacaattcaagatgagatttgggtggggacacagccaaaccatatcaaagagtaagggacaaggttttttcaaacctatgaggcaggtggagatggtgtgctrcagctgtaggattccctggcctggggagaagtccacttatatgtctcygagtactacgcaaaaatttttttgtttcctggaggattttcaaaattcaaaatatcaagtcactttgagacatattgagtctgatgttaaaaaggaaatgwtctagagtcaactgaaacacacactttaagtacaagtgaggtcaggcctagagaaagattttgggagcatagtggcracagtttaacttgtgaargcaaatgtggtcactgatggaagaagcctgaagcagagaacaaggtcttggggaaacctrgaagccatgggggtgggaaaaagaaaagtatctgttggaaaatagaatgmtagaaagatagggaaaaaactaaggaagccaaaggaagagatatttcaagaagaaataggtggccaaagctgcccaatgctaaacaaaacaaaacaaaacaaaacaaaacccacaaggagattcataraagaaagaggctgggtacagtagttcatgcctgtaataccttgggaggccaaggtaggaggattgtttgaaaccaatagttcaagaycagtctgggcaacatagtgagacccctccacccccacccccacacacaaaaattatctgggcatggtggyacatgcctatagccccagctactccagaagctgaggtgggatgatcacttgaaccccggagttcaaggctgcagtgagctctgatcgcaccacttcactccagtctgggtgatacagtgagacctggtctcaaaaaaaaaaaaaaaaaaaaaaaaaaaaaaatttaaaaagccagacctgaggaggttaaagagaggctagttactgagttactgggcaatggaaacattgggtggggtttttagactttttgtctgaggaatttggccataaaagaaagaaggaaggaggggtctgctcaagagaagactttctgtttgttttatggtaagagagatctgcctccctttgaccacactagggaaggagctcatttatgctaaaggaatatggataaatattcatattgttcacttggttatatttcatttaaaccttcctctcctcctttcctgtcctctgcaagtgccccatagaactttccttctggggaattgccaaagtcatggtattgctaaatccagtgacagggtgttgcaacacagaaatcattggttctcacttcactggcctgtaatgagactccctcaaatgcttccaaacaactttccttcctaatagtgctagtcaggcattttctcttttactgtgcacaaattaataacacagtaaaagcagcaataatagcaaatgcatagatagcagttactctgagctacagactattgtgagtacctttgaggggtaagtggtgaaccagtattcaagcttagcatatttgtcttcagggtccatgtacttaaaccactatgctaaattcaagataagtaagtttgtattttaccatagattgatgttcatgttcctgacactactacaagattcatactcctgatgctactgacaacgtggcttctccacagtcaccaaaccaggtatctctctggacccaggttcactgtgggttggactagctttaatagtcaataaggccagggacaatggcacacgcctgtaattccagcactttgggatgctgaggcgggcacatctcttgatcccaggagttcgagaccagcctgggcaacatggcgagacccacttctacaaaaaatagaaagattagctgggcatggtagcatgtgcctgtagccccagctacttgggaagctgaggtgggaggatcacctgagccgggggagttcaaggttgtgccatgatcatgtcactgcactctagcctgggtgacagagtgagactctgtctcaaaaaaaaaaatttaaaaaacagtcaataaataatttgatagtcaacaagcaatctgccacatgcaaagtattgcaagggaccaaaaaatataagctatatgtcccatctcatttactcttcataaccatcccattttayagtcagggaaactgtctggatttgaactcagaagaccatgataaaggcaaaatcagaagtcacttttagtcctgagtttctggggtctgagattcctcctcatcttggtcagagatataactgggttcagatagcttcaagactaccttttcttttatttcccaacctgtgaaccaaaagggtagtgagtgtgaatctctagcatgcacagatgtgcaagaaatactgcctctcctctattttctagatattaatattagtttagagccttcatctcatctggccagcaaccatagaaatcaccccaggttgtgtcactgtgtcacaatttcagatctcttatgcattgccaagatcccaggggctcgggtgcaggtatctcctgctcccccatctggtccactcgggttaccactgaaggcactcttgtgcctgtcttgcctagcaagtcctcactgcttccagaccacatagctaactcactggggtcctgccagagtcctgtcttcctggtgctgacagaccccttttcccttcctgtcttcctgtttctagaagcatgtctctctgctttacccatcagcacaccccacccctcttcccccaacttggcaaagactttgtgtccccaacctaaggccctgtttggaaaatcaaagccagaagaacttgcaggctattcctggtagggttctgacatatacctgccctggaccaatgactagggagctggctacagaggtggaggtgagcctaggaaagcagaaatacaaggagagggggaaaaaaaagtcaaatctcaaaatatctagccgcagacataagctcctctgasggyaatttcttgaggggggaaaaagttgctatttaaagctaggatatatgtggwtccatttttttcatcggtacattaataacatcattttccactatgtatcttcaagatccggtgtaacagccttgcaaatttgccagaatgaagaaggaatgttctgcttcagggaggattggccctggtctatgattgctgtcatgatgatactcagcaagtttccttagataacttcagagttaacaaggatktaaaaatgcttccatttcaaactcaccgttatacatatgcagaaactgaggacaatgaaagttagagttgtctaggatacccagactgtggctgaaggaggactagaaccgatatttatcctctcccagcccagcatttttgccatggtctcatgtatctcgaaagtaaccaccactagcaagttggagccaaatcaactagctgactccctgccctgactcagaatggagcatagccaccctgggcagcctgcccaggcagattccacatgcagtaaacctccttcgggtcccaggacactgggcacagggtggggacctgtgcttccagcaggggtgcgctccccagcctcacctgtccctgcttacagtccctcaggcaacaccagtgaaatcatcttcctctcagggcatcctcatcctggcctgagtgccccccacctttccttctcaacctcttcagggcttaccttgcatcagggggtgtctccagcagctgcagggtgcattggattttatctgcctgggaagctttctcttgattcctttgctagcccagcacagactacacatccctctcagaacagttctcaagtgtttgatactctctcttcacattcccatttcgtatctaactgatcaggttaatagggttcctagttgccggtcaccacccccaccccagctgtttccaatttacatcacactccaaatgatttttgcagcgcttagcagattgtctgtgtcattactttcagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggtagggatgttcactttctgggcgagccaccttttcccgacgattttaaatgttgtgctagttgttcgtttttaataatcactaaaaattatttctttcaatcagatgctttaaaattgtgtgctaaagagttataatgtgcaaacaacggggaagccattctgtacctaaaccatgtgttttcaacataacttttcagagtatcagcgcctttgcttgctgctgtttttgctgttttttgatgctgggaaccaccacctaaagatagtaaagaaaacacaggaagctttccggtaactcatgctaaagaaacacaaaatcaccccagtgccttgagaaatttcctttccctctctaactttccccttcagtgttctaaagggaaggcgtttctggtaaggtgtagttgcgtaaatgatggctgcctacttcagcaagcaagaactgttggagtattaagcatgggtaactggatattctggtttgggcactggaggatccctggaagccggaagcaggctgttgctgccggggtaggggcggcgggggtgggaggtagaaacttattgctgtgattttataggcagtaaactgatgcttagagaggttcagcactcgcccaagctcacacacctactaaactgtggagctaggatttgaatccagctacaaatttagttgtcattgaaatgtctaaatgcactctactgcgcaagcgataggaacttcccagcggagctcagctcagggacgcttgcagctccccgcgccccgctcgactctccggccgcggctccgcgggctcctccccctcggtccctgccccttttgcgccctctgctggtctctagggaaagcgcatctcctgaaatcagaagtcgcacccaagctgtccygtttccttagctcctagtaaagcgatatgacccatccatcccctcctcctcaaagcctcacatgaatcttctttgaggtactctctgatgcttcactcttcagcgctgagaaaaatggggaggaaggggaagtgaatgtattagtatagccccttctcaaaaccaatcgtgcagcatcttagccatgccttatcctggaagaacgaggcagctcacgtgggcatgggggtaatgagcagggaggcaattacagactcttaggttctcaccgctaacagtgtggtcagtggaccagcagcagcatcacgtgggagcccgttagaaatgcagactctcaggtccttcagccacagccctgatgaatcagaatcaccgtttcaaggaggtctcaggcgggccgtttcaggttccgagctcgctttgaggctctgtggatgttttgcagcatattcaattttgttttgttcaaaggtcacagtgacaactaagtttgcagcgggattcaaatccgagctccacagtgtaataaatgtgagatcttagayaagtgcttaacctctctgagttaatcatctatcaaataatgaaaagcactataagccaactcttcaactttcaggacattgttcacccgaaacccgaaatccaataactgtgcactgtcttctaacacagccataatttacctagatgtacygcttagaaatgtctcactctcatrgtgaccttagttctatctgtccctagagagccgcaagaccattttgtctggargttctctgctcactggacaatagggacagtggaattgtcctcatccttgtgcttgagtctttggaaaccaaatgaccccagaaatgtcatgaaagagatttttaggtcccagaggaactgaatggcttagacacccaccttctgaacaagaggctgggccagagatttctcaaggtcccaacttcaaccttggtgttctgtccgccttgatttacaaaatggtcttgatcttttccaattaaaattcyatttagtagagatacacagaaagtttgcaattcttccacaagaaaactgctgtatggcatagaaaaatatctacataatattttttgtttcttcttcttaattagctttcctattttcccttaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgaggtaagtgcttctggtaaaaatgtgtcatagtgtgtstgtgtctgtgtgtgtatgatacrtatataaatatatgcatatttgtacatatatatatacatatgtacaaatatacatacatataaggtctctctgtcgcccaggctgaaataaagcagtgtgatcatagctcactgcagcctcaaactcttaggcttaaygatcctcctgcctcagcctcccaaatagctcagactacaggtgcacaccagcatgcctggctaatttttctgttttttgtagagacaaggtctcactatgtggcccagggtggtatagaactcctgggctcaagcagtcctcccatcttggcctcccaaagtgctgggattacaggcatgagccaccatgcccagtcctgtcttcaaaakattaatggagaaaaatattgctggggtacttaagttgtgccaggtactacagggggatcctgcatgaatgaaactgagtgcctgcccctcaagacttacaatctagtggagaaggcataatataataaaaatgccatgatggaaatgtacccagaataccaggggacggagataaagagtgcatataggccaggcatggtggctcatgcctggaatcccaacactttgggaggccgaggcaggtggatcgctggatcccaggagttygagaccagtctgggcaacatggtggaaccctgtctctacaaaacaaaaacaacaacaacaacaacaaaaattagctgggcatggtggtacaagcctgtagtcccaactacttgggaagctgagatgggagcatcacttgagcccaggagattgtggctgcagtaagccctgattgcaccactgcactctagcctgggtaacagagcgagatcttgccgcaaaacaaaaaaacaaaaacaaactagtgcacatagaagtgtgagaagtgcatgtagaattctcatggcagaggtggcttctgaggtggcctttgacgggggagttggaatgggatgagcagatgagacattcacgagcattccaagccccaggaccagcctaagctgagagaatggggatgagggcagactctgagaatggcaagttagatctcgagcacaaggcagtgatgggatgccagtgtagatacagccaggaaggcagggtggctggagtttcctgctctgtgaaatgaaagggttcaagccctgagggcctctctagtcaaccattccagaattcacttagagtctgtggtggggaccctgaggtcatcctgaagagtttgagtgatatgagcatgaggagtcagtgaagacttctaatcagagtcatgccctaggaagccccctcagatagtaagtgaggggtgtgtgtgtcagggtcaggcttactatgggagactagcaaggtggtgtctcccatatctagaggggaggcagtggagccttgcagccaagcagtggctgcagaattggaagaaggggaatggatgctggaggcatcctgacgtgaaattcacagaactggccaccaacagcattgatgccctgcttaaagcttcttccagctgggaattaaggaaaccagaatgacctcaccctcctggttagattttaaggatatatacactaaagacagaaataaggatccatgagcaaagatgaatatcaggcagtgtctgaccagtgagaaaggtctcagaatggctatagccctaaatgctctgaatttgggggaaatgctacaaagatgcaaaatgatttttcaagctctgttcagataaggaagaaggaagcaacaagctcactctcagaagcagatggtgcaatggtataatactagcagataaccactccctggcaggagagaagtgatggcccaggtaggagagaaagaagcaagcaagtgacgtggggctgttctgaatctgcccaagtccttctcagaccggcccatccaaggaacccagagaactggcagaggagccctctgcacctggcagccttttctgcagggccacgaagagggagggaggcaccaggcaggatgtgagcaaattcattcattcagcagatatttgccaacataatacattctaggtgctggcaacacagtgagtcaaagagaaccaaacaatacctggcctctggaacaaaattctgattcacaaaaagggacacaggtgggcttttaaaccacaaaccagcgagcttgacaacaactgtggacaaatttctagaagaggtttagtaggtggtctgcagctctgtggaacggtgcggggatccctgtatgtcagcttgtgtttctgaatggccagtcacagagaactcagcttgtttccatcctgacagggttacccttttctagcaactctaggaatttggcagggcatttgatagtctctcagggtacgccccagcccccacccattgctaatggaataaagactgcacataaaagtgcacataaaagggaaatttaggctacacttaatagacgtgctttgtattatggaatcataaagacctagagaggcaaacagaccctaatgagaccaccgggcatcagtaaataaatcaaccgttctgcagtgcacagaaacctcgtgtgctgattctctgagtcctctttagagaacagtagttagttgtcagacgtttagcccgctgtgttaatccctgatgctaatgactgttgctgctcaggcgtgtgatggctctgaggagaaacctgggtaggagctcgctttccattttgcccgcatgaacggactgcctgttcctggccgtggagtgcattttgcactcacgtttgcacgagtgagctgccctccctccctgaccttgttggcctgagtgtgactgcctggggcccagtcacacctccctgaccccagtttcctctcccagtggcgctgctgggtgctgttccccgggactgcggcagagccctcctcgcgggccygacacggtgtccggccgcacggatgaccggtagagggcagcagcgcgctccgggtcggtcgggagcagggccttcctagtccagaaaccgcggcaggtccgctgctgagggccagggcctggtgggctaggggcaagagcaacgtggtgaaccggtgggctcactctgcaggaagaagagaaagaggagacgtggagaagtcgtgctgaccacatggcgtatcggacactgcacatttatgtgggccccaatgtgcctggcgcatggtttctgcgacaggagcccagccgtcaggtgtagacgtgcaggaggctggcagatgggctagaaaagcaaggaggctcagcacttggaggtgtcgaaagagggtttgaagagaaagcccggagtgcctggaatggtggggaggcatgaagaggctgacaccatgaaaggcaaggacagttcaagggcactttcaaggccttcagggaatggtgcagagaagtgagcgcgcgcaacagctggagagggcggttgtgaggaaggtcggagagaaggccctcctgtcactggcagagggtcttgactgcaagttgtccaggttcttggcgttttgaacaaagaattggacaaaatacccagcaaagcaaaaagcaaccaatcggaggctaggaagaagctacagttatattcctatgcaaatgaagactcgacaggccatcagtctgatgggttgtggacagcagtcattcagaggctggagtgaacttacaaagttgcaaatgaagactcacctgcagtcagtctgattggttgcggacagccaatttcccatctgccacacagaaaaggacaaagggagtagcgtctggtccttttgttacttatgcatggaaagttaggattttcctttcaatttagttctgggaagtcggtgtgaaacagacttaggttccctgcctccagaccctattctactgcctcactcccacattgttccattgtcaggaataaacgactctgggggtaaggtggacctccagatgacgacgaaggtagaaggggaggagaggctgagaggctaacctgccactgggacccagggccaaggccctttgtgattgaggggaagtgaccacagatcagcagatgatgactgagagatgggctggagcaggaccgtggtccggtcctgaacaacacatgcagccatgcccagagatgctaggcttagaggctaacatgcagtagacagctgcgtggccttaagttacttaacatctccgggcttcagtttcctcatccgtaaaatggtacctacagtaatggtacccagtaatagtacctacaaaagactgggaggatgagggaagggagggagctcccagctgtgtggggaggagcatacrggcgagggtaaccccccatatggtattatagggatttgcgtctatttctgtcctccctccagactctagcctcatggttctcagacatgggtatgcatcagaatgacccagatgcattaaaaacactgccaggtcccagccccagagcttctgattcagcggggctggggtaaggcccagtaatttgcattgctcgctaagcccaggtgctgctgctgctgcttgttcccrgactgcactgtgggcaccactgctctggagtctgcagagctccagcagggactcctgttgargasagacgggcatatagtgggagcccaggcctaggacgagtaactctaggacaaacaaaaattccagatacagtgcaagaagaggtagtgatgaatgaaaaagcgatcactccagcagagctttcaagtcatggtggtttatgaagggagttagaattgcacctggggagcaagtgctgaggttaatggcastgcaatyccccgtctgttttaytggaactgttgtcagaggcagaatgctgggctggagggactgtggccctagcaatgttttggacttgacaatgcccatttgttgggcatggttccggtgggatgctgtattatgcagctagagaatgtatttgtcctggaagagttcactttgtycactgccctcgagcctttatccaaggctaaacccacatgctgtacctacttttggaattggtccaggaattttatacctgtgtgaatktggagaaactctctcagacacccatttggaaatgmattagtgtttttctcagtgagtcctccatgcttgctgttccaatggccctccaggtttgggcccagcacctgccaggagaagcattccctctatagcttccacctgaccacagccagcccaagccctgctcagaaccccaggcctgccagcgagcctgtgactggaattatctattagggakcaagcattaacttgacacaggagcagccctggctcagctggaggcatccgcatgctgtggtgccccaggaacagaggcaccccygaaatgcargctgtgtgtttgctgcagagacaccatggcccataactccccaagcataagtgagcagctctgctgtccaggcaatgaagtcaagaaagggaaccaacccagctaatggctgggattaaagctaaatgaattcagctcaaatgaaagggatactgacccttctccctctggcctcattaacttaattaacagtgcttggcaggagtattgaagcctgcattgattgttctgtttctgtttttccccctcaaagccctagatacaagttaaatcagccttaataataaaaacccaatactcaacagccctcagattttcttaccagcccttcttcctctaagagaatcacttggtttctgagttggaggggatccattagaccaacacttctcagagcatggcctgagaccactagcttcagagtaactgggatatggctataaaatgcactttccaggcctcagaggcctgtggaactggaatattgagaagtccagtttgggtatttgtagtgggttttgggggtttaatttaatttttttaattgtggtaaaatagacatataattttcattttataaaaaatgtccattttaataatttttaggcagacagttcagtgacattaagtacattcacyactgtttgtctccagaatgttttcatcatcccagactgaaactctgcccattaaacgctaactccccatcctcccctcccagcccctggtaacttctgctctgcttcctrtctctgaatttatctattctagatatcttgtaagtggattcatgcaatatttgttcttttgtgactggcttattttactcagcataatgtcttcaaagttcatccgtcttgtaccgtgtgtcagaattccattcctttttaaggccgaaaaatatcccattatatagacaacaaattttgttcatttattcattcattggtggatatttgggttgtttccaccctttgactattgtgagtgatactgctatgaatattggtgtgcaaatatctgttgagcttctgcttccagttcttttgggtgtacacccagaagtggaattgctgggtcatgcgacagttagttctgtgtttcattttttgagtcagtactgtttttaagcagcccacatggttctaagctgcagtcagggttgcagccagaagaccaggtgatcagactctctgctggtggagtcacctgaagactctgaacaaccctggatgcccaagccacactccacaccaactaaatttgtaattttttaaagtctcctggtgattccrgtgtgtagccaagtttgagaaccattggtttccatcagtgattctcaaatttgagtgtgtataaaattcacacaatggctaaggatacagattcctgagagagcacaccaccacccccccaccaacaccacaacccccaccgccaccaccatcaccaccaaccaccgccaatcccaaagaggctcatttaatgcatctgtggtcagtctgggcttcctgggtctgaagacttcccaggtgattctagtgtgtagccaaggctgagagctactaatcttgttaagtctttcaatgaaacatgagaacactgagagtgtgaaaggtgacacactctgcccaagtccctgagctcgttaggttctgagtctgcactcattcccagggctgattttcaagacagtcccacgggttctccatactcagccttgcaggtgcagggggtagaatcttatatagaacctgcatcttttctactcttaatttgaactgtaatccttgaattagagtgtagtcagtgctgctataatgcttgttttggaatgtaaatttgtttctaacgtgattgatgtattagggaacaatattaatgtgttagggaagactattgatatgctggagaataatattaacatattcaagaatgtgaatttcacatttgcttatgtgcaatttyttgcatgtaaaggcagaaaactgcacccagctgtgccaaaacacaaaagaatacacaaaatacacctccaatattagtcagctacctcattctccatgtgtgatttgagccacatgcacccacatctgttgctgtaacttcccctctgatatcaaacaacccttcttcccccattcacaataactcactggcggagtgcggtggctcagrcctgtaatcctagcaattctgaaggctgaggcaggtggatcacctgaggtcagaagatcgagaccagcctgtgcaacatggtgaaaggctatctctactaaaaatacaaaaattagccaggcatggtggtgcacacctgtaatcccagctactcaggaggctgaggcaggagaatcacatgagcctgggaagtggaggctgcagtgagctggattgcattccagcctgggtgacagattgagacttcatctcaaaaaataaaaataaaataactcacaagctgcaatctttcggatgtccacttccacaagcaaactgcaggtcattttcaaagtcaagtgctgtattatgtatttttaagaatttaacttggctaaaactgtgctaccttaagggggctccaatcctttttttttcyttttctttttttttttttgttttagayggagtcttgctcttgtcgcccaggctggagtgcagtggcatgattttggctcactacaacctttgcctcctgggctcaagggtttctcctgcttcagcctcccaagtagctggaattacaggcacccaccaccacacacagctaatttttgaatttttaatagagataggtttcaccgtgttgtccagactggtctcgaactcctgacctcaggtgatccacctgcctcagcctcccaaagtgctgggattacaggcgtgagccacagcgcctggcccaatcctttctttataggccactgttaagttttcaagtgtgaaacaccctagctctatttttcccatgagccttgtggtttttattgtgtgattttgcatagtgtaatgacttgtaaaaaggaatgtatgtcacctgatagaagaactaactgtagatgtaattatacacattgctttttagcatccttttaacaatgagtgagcagctcactgcccccttgagaattttagttcctgtccctctctttcctccctctataaccactagatggcgcactcctccgctggggtcgggcgcctttgcagcggcaacctcaacagcgtggacgccgttcttgaactctcgtctcactgaggtttgattgggtctggaacaacttcacagcctggttctcctctttagattggatttccccaatcccagtgctcattcaagatttacttccgcccactttagctctggcttctttttggatggtacttcttcccaggctatctgcaggaactgcctcgctgcacacacctctgctcacctgctcacctggttcctctgctcacctgtcctgccatttaacccacagagatctacttcagagacaaaaatctcgttatttcatgcctttctgtacttcataaagaaatctgtctgcgtggtatctttgtaatacgacataagcccagacaatgttctttcacatccatttgttcagctggccttatccaccttacttacttactttcattttagcttccctattaggtacttgaaaattcagtatcctggaacatatttcgtttggggctgtctttcacttatctttaccacaaattcaaggtcacccagtttggtggcatgtttgggaaccggcattgagtcatccataaaaacaaagaatttaaactaaaaaatgtaactgttcttcagagctggcattctcactcccatgtctgcagggatttctctggtttcatgagatgagaatttccttctcgtgtttggataaaatagcagctgcaaaactgtcagcaacttggggtccaagtttgttctttcctgcaaatactggtagttcaatattggaacatatttatatcttagagtcacttaaaatcctcatttctgaaatcaaattttctattctcttttcttctagaatagagatcagcaaactacggtctgtgtttggactgcaaaacctaaaatatttaccctctggccctttagagaaaatgttttctatctcctgttctagagcctaaagtgtgattgtttaacagaaactaagggtcctcaatgtgacatggagatggacaggcctcaggaagtcagcaaatcctctgaaactgggttcaaaatttggtttgtgatgcaaatgtgcatttttataggaaaaaggatcaaagctatcatcagagtctcaaatgggtccaagacttcaaaaggtttaaaaacatgttgtctacttatgggcagtgtgactgagcatgagagcccaccataacatcctaggtgtgagcaatgaagccaacatgcttacatgccttgttagggcacttcagaatctacttcatactataagatgtggaaaaggttatgtggaacccaatacaaatatggtctttccattaccatttattttcctccttgggtgtcaaggcctgttctcccccactattcttgtctcatctgaagtacatcttcagactcttcaccccaggtaccactgagtaagggctcatgcttcctaccacacacccttatctctgcctcccaggattatatcagcttctagaatcacagccttccaattgcacgccaggaaccctggagctggatttagggcccattgcaataactgcctctcatctcatccattgtgacatctgtccctctcttcatagattctattctgccctttttaggttggtttatcatcatgatgcatatttgatattattgaacactgtggggtgtcaatgctaaatgtgtaattgaggatggcagggacagagcagagcacctcccatggcacctgagaaagcctgtcccaaaccttggaggtaggagggatggtgcttgcctttaggagtttcttctgaactgtaacaccctcatctgccctgattggtttctattttctttcaataattcttcattttatctattgagatcactttgaacttttatcccattttccaaaatgcagcctcctgcctgtgtgtgtcatctataaatacaaggtcattasctctgaggcccatttgaagccacaagaaattcactgagacagaaagtggctactttgtttgcattactcaatctcatcacctacaaaagaaacaaacactggccaggcacatgcctgtaatcccagcagtttgggaggccgaggtgggctgattgcttgagcccaggagttcgagaccattctgggcaatatggcaaaaccctgtctctacaaaaaaagtacaaaaattagctagcatggtggtatgcacctgtggtcccagctattcaggaggctgaggtaggaggatcacttgagcccaggaaattaaggctgcagtgagctgtaatcgcaccactgcactccagcctggacagcagagtgagaccctgtctcaaaacaaaacaatcacaaactatgtagrtggaaagaatacataggattcgcagaattcctggctttagtcatcagagtgcctgtaaggaatgtggaaaaagacctggaagctttacctctcggcactgcagcactgtcagacccaggcctctgttttataacaaatatttgaaatgacctctttattattttgaaatgacattcatagctgtaacataatccacctacatacataattttatagaaatcaatatactgtcctaacttggatataaaaaagaaataaaaggggaagtaatttataatgagttggtacatgtctcaatgtgtgaatgcttatgtgcaactagaagatgaaatgagttaaacactcacacctacttataaagaagatgcttggatttaggagaagtaaaataatattcaactgacccttcttaaacattttttttccaaggcagggtcttgctctgtcgcccaggctggagtgcagtggcacaaacacagctcactgcagcctcaaactcccaggcttaagctatcctctcacctcagcctcccgagtagctgggactacaggtatgcaccaccatgcccagccaatttttgcattttttggtagatatgggtttttgccatattgcccaggctggtcttaaacttctgggatcaagtgatctacctgccttggcctccccaagtgctgggattactggagtgaacctccacaccctgcctcttctcaaacttttttattacacttgacattttgaaatgaggactaagtaaatttgctcacacataaatgctaccaccatatgatgcagatgggcactgtttgtgacattgtttgattctccacagaggcactggccatcatgaagtgattttctgaaatggtgaataacactgtcaataaaaaaaagtcaaactctgcaaaatatttcgagagtttattccaagccaaatgtgaggaccatgacctgtgacacagccccaggaggtcctgagaacatgtgcctaaggtgttcaggctacagcttggttttgtatattgtagggagacacgagacatcagtcagtctatgtggggtatgcattggtttgtccgaaaggtaggacaactcaaagcctggggcttccaggtcataggtggattgaaagactttctgactggcaatttgctgaaagaatcaagtttttatctaaaggcctggaatcaaggggttgtgaagaaaggttcttatgcagatgaagcctccaggtagcaggctttagaaagaatagatggtaaatgtctctttcatgagaactaaaaatgtgccagactcttaattaaatccctcctggatcaggaaaagacctggaaagggaaggggattctctacagaatatagattttcccacaagagacaactgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgcaacctctgcctcctgggttcaagtgattctcatgcttcaacctcccaagtacagatgccaccaccccgcccggctaattttttgtatttttagtagagacggggttccaccatatcagccaacctggtcttgaactcctgacctcagatgatctgcccaccttggcctcccaaagtgctgggattacaggcatgagccactgtgccaggcctgttgtgttggtatcttattgctacaaagagtctgttctatcagtctgaagatctctgttttaatgttaacactggtcagttgtgcctgaattccaaagggaggagggtataatgaggcgtgtctgaccccctcacctttcccatcatggcctgaactagtttttcaggtttttttttggaatgtgcttggccaagagaggggtgcatcagtcagttggggagcttagaattttatttttggtttataacactttattaaggtccaaactaaacaaggtagtctttcctagattgacacagtagttgcattcctgaaaaattcagtatatattaaaaccgtgcaaaaactattttgttagcatgtaacacaaagttaggttctgaggkaattttgagcaagtttttgacccttggggactttgggcaggacatcctacagctgtgtggatgctggctgattctgcatggtacgggactgtcatgcacgtgtcaaccaaaaattaaattctaaggccccacaaccatctgaatggactttctttctcttctttttcatttcttttcttttcttttgagatggagtctctctctgtcacccaggctggagtgcaatggcacaagctcagctcactgcaacctctgcctcctgggttcaagcaattcycctgcctgagcctcctgagtagctaggatttcagacacgtgccaccatgcctggctaatttttgtatttttagtagagatggggtttcaccatgttggccaggctcgtctcaaacccctgacctcaggtgatccgcctgcctcagcctcccaaagtgctggggttacaggcgtgagccaccgtgcccggcccatctgaatggacttccttctaggtcagggcactctaaaatttaacctaaaagtctggtttaggccatgatgggaagtggaggctgaaaatgcctcattatacccgtcagcattaacatcaacacagaccttaagtctgatgagaggcatttatattatattctctgtagcctgctacctggaggcttcatctgcatgatcaaactttggactccacaacctcttatcacaacccagacattcttccctattgataactctttttttttttttttgagatggagtcttgctctgtcacccaggctggagtacaatggcacaagctcagctcactgcaacctctgactcctgggttcaagcaattctccttcctcagcctcctgagtagctaggatttcaggcatgcgccaccatgcctggctaatttttgtatttttagtagagatggggtttcgccatgttggccaggccggtctccaacccctgacctcaagtgatccacctgcctcagcctccaaaagtgctgggattgcaggcgtgagccaccatgcctggcctctattgataactctttcaaccaattgccaattagaaaaattttaaatctacctataaattggaagctccctcgcccctccagttgtctcatgcttctggaccagaccaatgtatatcttaaatgtatctgactgatgtctcatgtctcccaaaaatgtataaaaccaagctgcaccctgaccaccttgggcacatgttctcagggtctcctgagggctgtgtcacaggtcgtggtcctcacatttggcttggaataaacctctttaaatattttacagagtttgactcttttttattgacagcgttattcaccatttcggaaaatcacttcatgatggccagtgcctgtgtggagaatcacatatgtggcactcatatttagctcagaataaatctcttcaaatattttacagtttggctcttttcattgacatacattatcatgacatcttgattacaggggtgatacccacccctatcactgtgacaaccaaaaatcatccctgcaaaattacagtttcctaggaggcagctgtccccatcaagagccacggcttttagagtgttacagataaaatgcactgaggcaaaggtcctcgaacagatccaatccctttatctttctgttgatggcagtgttgttcattcaacatactctttcctttttttcttttcttttctttttttttttttttttgtgaacaccatgcttctttctgtttgctgtatggagaatatagtctaccaggggacagagatgataagtattgagaggtgacagcgtgctggcagccctcgctcactctcggtgcctcctcagcctcactgcccactctggccgtgcttgaggagcccttcagcccaccggtgcactgtgggaggccctctctgggctggctgaggccggagcaggatccctctgcttgctgggaggtgtggagggagaggcacaggcaggaaccagggctggggtgctcacgggccagcgcgaattctgggtgggcgtgggcttggcaggccctaactcggagcagccaggggcagtgaggggcttagcacccgggccaggagctgcgaagggggccccgggtcccccagcactgccggccccgccggcgccacactcgaattctcgacgggcctcagccgcctgcctgcagggcagggctcgggacctgcagcccgccatacccgagtccccctgtggtgggctctcacgcggccaagcctccccaacgggcgccgccccctgctccacggcgcccggtcccatcgaccacccaaggactgaagagcacaggcrcatggggtgggactggygggcagctctgcccctagccctgacgcgggatccactaggcaaagccagctgggctcctgagtcaggtggggacttggagaacttttatgtctaggtagaggattgtaaatacaccaatcagcaccctgtgtctagctcaaggtttgtaaatgcactaatcagtgctctgtgtctagctaatctattgtaaatgcaccaatcagcaccctgtcaaaacggaccaatcagctctttgtaaaacagaccaatcagctctgtgtaaaatggaccaataagcaggatgtcggtggggccagataaggaaataaaagcaggctgcggcggccagcagtggcagcccactgcggtcgtctttcacaccgtggaaggtttgttcttttgctctttgcagtaaatcttgctgccgctcgctctttgggtctgcactacatttatgagctgtaacactcactgtgaaggtctgcagcttaattcctgaggccagcaagaccatgaacccacagggaggaatgaacaactccggatgggaagaatgaacaactccagacgcgccaccttaagagctgtaacactcaccgtgaaggtctatagattcactcctgaagccagcgaggccatgagccccccagaaggaagaaactccraacacgtccaaacatcagaaggaacaaaycccagacacaccacctttaagaactgtaacactcaccgtgagggtccacgacttcactcttgaagtcagtgagaccaggaacccaccaatttcggacacagtatgataaataagcaaatagacaagacaagtaagggcttgtgatcattgctttgatggaaataagatggtttttgaaagagtaacayggcaggggatttatttcaaatagtgtgtgcaggagaagtctcgctgkggaaacactgatgtgagatctcgccrcagtaagagcagagagaagagggttcacatgaaggaagcagcacttgcgaaggtcctgaggctggaaagagtttggaatgcgtaccatgtgtgtattccaggatggctggtacttccaccctaggaccttggtgctggctgctcctttccctcaaacgttgggcctctccacatcctttccttacttctgttagacacctgctctaatctcattacatcagagacacccttcctgactcctctctataaacagcagccaccacccgagccatggcacccccatctcctttttcccactttactttcttccattgcatttacctctrcctgtcagtacctatttcctcttccttttgttgtctatcacctcttccgtccaccagaatgtaagctccatgagggcaggcttggtccattttgctcacagctgtatctccagctcctaaaacaatgcctgaggcttggtgtgctggctcatgtttgtaatcccagcactttgagaggccaaggccagtggatcacttgaggtcaggagttcaagaccgtcctgggccaacatggtgaaaccccatctctactaaaaatacaaaaattagctgggcgtgctggcacacatttctaatccaagctactcaggaggctgaggtgggaggatcacttgaacccgggaggcggaggttgcagtgagctgagatagcaccgctgcactccagcctgggtgacagtgtgagaccctgtctcaaataaataataaataaaacagtgcctgacacataatgggtgctcagcaaatttttttaatgagttattgaggagaaaaactattcaagataatgttgacaagacagccaagagctgaatcatgtaagtactcacaggattttattccaagtacagcaggaaggaagggaagggccctgtacaaagaggaatgatataaaccagattatgtttttgaaagaacatgctggctgctggctggaaaatgaaagcaagaccagaaataagagagccagtgaggagtctccagtctggcccaygcaaagagatggcggcggcttacagtagggcagtggataggcttgggaggtggcaccaacaggacttgctgagggattggatattggggggatgtttaaaagaatgatgtttaaaagactctgctgtgttgtcaccctgagactctggatggatatggtgaagccatttactgagatgggggagaaattcagagtggtgataaacattctcaccaagtttttcctaacgattattagatgcctgagtttgaaactttgagtcaatccaggcatccatgcctacttctgatttgctgtagcttgtgtgccacagcctcccagtttctgtgraaaccccaccatacatcagccccagcacaaagcacaacctcgtcagagctagcccacctccagcacyktgactgctccaggcttaatctctcctggtgttgacacttttgccagtgatggtgtctcatgggattcatgctctttataaaccattgccttcttcctatttctttcatttatttttcctctcattctcctgccctctgagctatataactcttcctttmccttccaacagaggcctttcattacatttaaagcaaatggaatgcatagtaggcaccaaagatggaggtgctrtgcaaataatagacaccaagctctctgcaggtggggtccttgtgtgttttctcttcatagcacccagcacaatacttggaacataagccagacacgttcattgagcaccatttctgctgcacccatgaaaaaaacactcaacccagacagatggtyagctccccgacaggacttaagcaagtgggccagtctctgtttattgtcgtacactcacacaatcacacagctgccaggcgagcactaggcacttatcacacttttattaaaccgatcacatctggctctttgtggggtgccagaaagtgcccaatttctgcatgatgggatggactgtgtgtggagtaaggtcggataaatggagatgggccagtagcctagacaaattaagggagaaaaacagtgaatttattttccactcatcagccgagctttctgtgggctaggaacggggtacccggctgaagtgaagcaacattgtgtctcttcctgctgttttctccacctcccctcagcaaatcatgaatgaataaacaaacgaatgaatgaasaaacatagagttattataaggattaagtgaaggcagggtgcagtggctcatgcctgtaatcccagcatgttgggaggccaaggtaggaggatcgcttgagctcaggagttgaagaccagcrtgggcaacaaagcgagacccccatctctatatttttattttaatttagaataataaataaaatttttttaaaagaaaagattaagtgaaatgttttttaagtacctagaatagtgcctagtatacagaaaattcaacgtaagtgtttgatagagagcaagaataggccaggtgtggtgactcacatctgtaatcccaacactttgggaggttgaggcaggcaggtcacttgagcccacaagttggagaccagcctgggcaacatggtgaaaccccatttctactaaaaatacaaaaattagccgggtacagtggcacgtgcctgtagttccagctaatcaggaggctgagatggaaggatggcttgaayccgggaggcggaggtggcagtgagctgtgatcatgccactgcactccagcctgggcaacagagcaagaccctgtctcaaaamaaacagaaakagagtaagaatagttttgtctgtatctgccaacagccacgtctgtggagtcagaggaatgaaggggtcaaagggagcaggcacatcatagagaatacccccaagatctgaagaccccagtgcaatacctcgagcttaaatgcctgtgttttcattctcccttcttctccataggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtyactgcttcatccttcccctttctggaacagctgcagctgctggagctcgggagccagtatayccccttgactattgacaaggaggccttcagaaacctgcccaaccttagaatcttggacctgggaagtagtaagatatacttcttgcatscagatgcttttcagggactgttccatctgtttgaacttagactgtatttctgtggtctytctgatgctgtattgaaagatggttatttcagaaatttaaaggctttaactcgcttggatctatccaaaaatcagattcgtagcctttaccttcatccttcatttgggaagttgaattccttaaagtccatagatttttcctccaacmaaatattccttgtatgtgaacatgagctcgagcccctacaagggaaaacgctctcctttyttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctcygagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctyctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcarttggcttaatcacaccaatgtcactatagctgggcctcctgcagacatatattgtgtgtaccctgactcgytctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatytccaggatgttggctggtttcttcataaactctctcaacagatactaaagaaagaaaargaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcccttagaggtttccagtctccattgattttctttcagatccaataataccgttctgtcctgctgtgttgattatggaatgtatcctaatcatgggaagggcaccttgggagaagttgcagatggctgacgtgctttctctagcattcagctaaaaaatgggatggtccatgattctgygttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtgrctgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttctttcgttgccctaatgaccacaagagaacacatacactgaaggcctcctggggggcagttgcaatttcactgaagttgtatttttttatcttaaatgaaatctatgtgtattttccattctgttctttttttcatgtttattaatatagaaatgtgtttttgcaaaaggattaagaatacttaaaacaaggaaactgtgccaaaattaccccatagcttcacacactgcctcctccaagtccagcgtaactccaggtcagctcctgcagtttgaggggtacacatgggtctgggactcagctctccaaactgtcaccttcttcccctcactgggcccctcaatcctgactcctccaacacacacacgcgcgcacacacacacacacacacacacatacacgctattctcatcccaacttcttttggccacttctaatcaatgagaccgagctttccctgcacccagcgatggcattattttcacgcacaccatgcagtccccactgtacctctttcctctggattcttctcccatctctgcacatccatcctacgttttcttcgttttcttcaaaatccagcccatgaagctccctgggatccctaacccaaagtcctctctcccttttgtgaaaactcttgacactttatctggtcttttaaaagtagcacttactactacttcctctatccttttttctgagcctgcccggcygccmgsctctctggaagataagttccctgaggaaagaccttgtcttctgtgtcctgccctcactggctgtagcagatcacttatggtttggggaccattcaagggtttcccacytacacatctgcccatgcttcttcctccccatggaatttcttctccccatcctaccactcgtctgcctgatgaatttccttgtttagcaagactgcccatccctcatgaccccagtgacagattttctgtcactgatacatgacattgtgttgcgccagtgtgtttatgtatgtgtatggacggcttagtttgtgagacactgcagtcaggatcttgtcttgttcatctgtgtatcgcaggcccagtttgtgcctggcccacagtatgtgcttagtaaatgtcttgtggatgagtgragtatactgggaagcccagcctccctcatrkcaacacctgctgttattagactttccactggaggggcagggaggatgagggcctgagagagcaagatatccatggaggtgctgagtggtaagctgaaaagggcaggagaccacaggctgtcagacacccctgaacactatttcaaatggccaggcatggcacaggcctcctgggtagtgggacagtggcagcctggattagcagctaggaacggggctagaatggagagctgagggggtggggaggaaaacagaacccacatgaatttgcagtgaataaggtctcctggaaccctgtgctaagaaatacagtaaaacagggccaggcactggtggctcatgcctgtaatcccagcactttgggaggctaaggtgggccaatcacttgaggtcaggagtttgagaccagcctgcccaacatggtgaaaccccgtttctactaaaaatacaaaaattagctgggtgtggtggtgcacacctgtaatsccagctactagggaggctgaggcaggagaattcctygaaccsaagaggcggagaytgcagtgagccaagatggcactactgcactcctgggtgacagagcgagatcctaactcaaaaaaaaaaaaaaaagaaggaaggagacaaaacaaaagtatactgtgtcagtaacaggtataaccgcaaatcaggaagacwgtggaaagaccactctgctcggtttcatgccctcctgtcccacctgctgctcagccatggttttcccccagctctagggggygggaggggcacccaggacactgaagaaatctcctggtcagaacaccttgtatgaacaggactcctagggaaaggggtttcctagtccggctaggggttggaggtagtgctacaccagggacctcccttggtttgggtgaccatcgctatgactctgttttccaaaccaaacctgggacatgtaaaatgacaagtgcaggtgtctttacaggaagaacaagctgaaacacagataactctcaacayaggaaaggagtctatcccacagccttttctaatcttyttatttaaaaacacgaattacaggtaattttcctaatgaaacacatttaaaaggcatcttttgtggtctctgtatagagtgtatgggggacctgttcaygtctacatcctagccactgttagtttcaacataccactctatttcaaaacttcccttttctggcaaagatccaaaacttactaaaattcttttgtmttctttcccatggtcaggcccagcagttggaattctttttgaggccattttcccaagtctttatcacktcacaagacttgctgygtacatggcaaaaggaaggcccaacrgagccacattgggaagtgggccctggggagtctgctgagacactggttgctaagtgactgccctgtcttccatggcgcagtgattcaaagccaggcctcaggaaatagataaattccacatagcacagacctctggggtcactccaaaatggtgagaaactaccacagttcaatctcagaatggctagagctttctgtagttgaaactgcaactattctggaaagatctagaatattgactagagctgctgaaaacttcaaagagaatcccactcatgccaaatacaactgactctgaaaatcccttgccaaccacgtgcacttgcagtgaagaatgttttagagagtcttgatattatgtaaagcaaatgcggtttgaagttttaaatcatgaaagaaccacgttaagaggacaagagactgtggagtaaaagtttaagatagttaaatgctcatgtaccacaatgtaaaattgattacaaaaaagtctacaatattaaatcaagaaatagtgttccaaatatatatatttagaagtatgaaaatgccagaagaaagaaccatayaaattaatgatgattgcctgaggaagttctgcccagttcttccattgggagcatctagaaaagctggagaaactatttttttagaatctatttaaagacacgggaaagttgcaaggtagtaaatagggccaagaggcaagagaagaaggaaatcgagaaagctgactacaatgcaattaagaccatctattaccaaaaaaagactatcagtgaatgaaaagggaaactttagcatggagggagatatttgtaatacacgtatccaaaaaggactcacaggcaaaatctaaaagaacttctacaaatcaataagaaaaagactacagaaaagaaaaatggacatgacacttaagaatttcacaaaaggctatccaatgtccaataaggaaacgaaaagatactcaacctcctttagtgatcagagacacgcaaattgatacaacattgcaatcccactacccacccaccagaatggctaaaattaagatgactgacagtaccaagtattggcaaggctggggagcaattgaaactttcctgcgtgattggtgagaatgtaaattggcatactataaagcagggttccccaacccccrggccatggacccatactggtctgttaggaagcgggtcacatagcaggaggtgagcggcaggctagcaagctaaacttcatctgtgtttgcagccactcctcatcgcttgcattactgcctgagctccacctcctatcagatcagctgcggcattagattctcataggagcttgaacttcgtgtacgagggatctaggttgtttgacccttatgagaatctaatgcctgatgatccatcattgtcttccatcacccccagatgggaccatctagttgcaggaaaacaagctcagggatcccactgattctacattgtggtgagctgtataattatttcattatatattacaatgtaataataatagaaataaagtgcacaataaatgtaatgggctcgaatcattctgaaatcaccccacccctatcccccgccagtcggtggaaaaattgtcttccrtgaaacyggtccctggtgccaaaaagttgaagactgctacttttattttttattttgktttattttttagatgaagtctaactctgttgcccaggctggagtgcagcagcacaatctcagctcactgtaacctccacctcccaggtttaagcaattctcctgcctcagcctcccaactagctgggattacaggtgcgtgccaccacactcagctaatttttttgtctttttagtagagatggggtttcagcatgttggccagactggtcttgaactcctgacctcaagcaatctgcctgcctgggctcccaaagtgctgggattacaggcgtgagccactgtgcccagccagagactgctaccttaaagaacagttagtcgtctrctaaagttgaaccacacatgccctgtgatgctgaaattctactcataagtatatacacactagaaatccatgcacttatgcgtgaaaacacacatagaaaaacgttggtagcagcattatttgtagtagccaacattggaaacgacccacatgtccatcaaccacaaaatggatcaataaattgtggtaattgaaagccctacagaaatgacaattagccaattatagctacaggtaacaacataagtgaatcttgaaaaaaatgttaagtcaaagaagcaaggcataatgatgaaataccaagtggttgcaatttgagaaattttaacaaggcagaactcatctgtggtgataatgaggacagtagccacctctggggaggagtgagtagcgctggagggggcttccaggatgctgtgtatgttttatggcctgacctgggtgacagcaacacttttgataatacatcttatcggcactgatgaatttgttcacttttctgtgagatactagttttccatttaaaaaacaattttttgagatggagtctcactctgtcacccaggctggagtgcagtggcgtgatcttggctcactgcaacctctgcctcccgggttggagaaattctcctgcctcagcctcccaagtagctaggattacaggtgcatgcaaccaggctcagataatttttgtatttttagtacagacagggtttcaccatgttggccaagctggtcttgaactcctgacctcaggtgatccacccacct

SEQ ID NO: 13312 - DNA, 130472 bp, Homo sapiens
tgtgccaggtacacagctggagctcaataaatgtactgtgacctcaggcaggaaaagccaaggaggggcgggccaccctgggggctggtctgcagagtcttcagggaagaagccaggacaaggacaaggaccctggatgaggacaggatgagaggatggctgcataacagcagggaggctttgggcaggcaggggagcctttccaggtgagtgaatggcaggaacacaatcttggaagtgagaattcctggggtgccttctgggccttgaagcagggctcacagagggcaacaggaccccgctggagtgaagaaggggactggagggtaaattaaaagaatagcagcttgtctgccctcatccccggtgtkgggggagcagcctggcatggagtccaaatggacctcatatttcccaaagactcaaagcatctggggcctacctggaatgtcccaggaacacctactgcccggcccctcctctttcccctcaccaarcatgatgactgcaatgtctcataattatcacactctgcttttctccatctctgtggctttacatattctcagtgttcagctcttggtctgcaacatatctgcgtacraacacacacacacacacacacacacacacacacacacacactgaggaatggctcccgggtcccagtagttcccactctctggtagaggagttgtgtttgtgagggctgtgatggggtgacaagcctgcagcagcctttccatgttcgtccaaactagatgtggtgcagagagcacaggcctgtggatcagcagatgtgacacttagcatgatggtactggttaggatcaagctaggcagtaacacacaacccaactgtagtgggtgcaacaagcaggtgcttatttttttgcagaagaaatcaggaggatggcaatctcactgctagtgcaggtgcttgaagctgccatcggggacccagatactttctggtgatagtgtatatggggggcrtctgctggagcttgggagatttggrcccccattctggctctgttgctaactagttgtgcagcttcagacaaagcttctgaagctttgacttcatttctttatttgtttttaaaattgcaggctgagtatagtggctcctgcctgtaatcccagcactttgggaggctaaggtgggagcattgcatgaggccaggagttcgagaccagcctgggcaaaatggcaaaccctcatctgtacaaaaaaaaaaaaaatacaaaaaattagctaggcatggtggtacatgcctgtggacccagctactttggaaactaaggcaggaggatcacttgagccccgaagtttgaggctgcagtgagctgtgattgtgccackgcactccagcctgggtgacaaagtgaggccctatctcaaaaatgaataaataaaattgtggtaacaacatataacataaaaccatcttaaccatcttaaccatttttaagtgtacagtttagtggcattgagtacattcatactgttgtgcaatctgtcctcatgtctcttttctttccaaayggaaactctcccwattaagcaagaactctctatttcctcctccccactggcaccaccattctgctttctgtctcaatacatttgactgctccaggtaactcatagaagagggatcatacagaatttgtccttttgtgtttgacttatttcactcatcataatgtcctcaagtttcatctgtgttgtagctaatgtcagaatttcccctctttttaaggttgaataatattccattgtatggacataccacattttgtttagccattcatctatggatggacacttggtttgctttcacattttagctattgtgaataatgctgccatgaacatgactgtgcagatatttccttgagactgtgttttcaattcttttgggtatctatctggatgtgggattattagatcctatggtaattctatttctaatttttttcaagaagcataatactgctttccatagaagctgcaccattttacatccccaccaacagtgcacagtttccaatttctccacgttcttgccaaaatttgttattttctgcttttttggtagcagctatcctaatggctttgagactcagtttctcgtctgtcccacagggacatagtagggctagattatctctagcttctgatgtctcatggtgccttccttcttgccatgaaagtaagtattgcttatgcacatatacatcttagtaaatttagttatatcttttcagcttggggccccaaggtagaaactattttaatatgaagacaggaaacaagaaatatgaaaagggattgaagaaggcattccaaggacaacttccaaaccctcctctctattccttccagaccatagatgcacataattctgggccacagagagtcctttggacagaacaatactttactgtttcttctcttcctctccttttcttttttgcttgtaattcacacacccaggtggctaggcgcagtggatcacacctgtaatcccagcaccttgggaggcagagatgggagggttgcttgaggccggaagttcagtctgggcaagacttggtctctaaaaataaattacctaggtatggtggtgcatacctgtastcctagctattcaggaggctgaggcaaagaatcacttgagccccggagttcaaggctgcagtgagctatgatcacaccacagtgccccagcctggacaagagagcaagaccctgtctggctcaagcaacaacaaaggaaggaaggaagaaggaaggaaggaaggaaggaaggaaggaaggaaggawggawggaagggagggagggagggagggaggaaggaaggggaaaaagagagaggaagggagggagggagggaggaaagagagaaaaaggcaggcaggcagggcaagaaagagacaaagagaaagaaagaaagagagaaagaaagaagaaaaaagaaacacacacacccatctcccactctttatagtgtcatgatgtcatttaacataagtgcaaggaaaagttcaaggcgtttaattctagcttttacaaaacccagaagcatcttgagttaagtactattatcttcatttcctaacttttggcattcgctgactcattatttcatatgtggcttgggtgagaaaagcatctgggtggcaacctcctcccccagctacttctctggccaatggggactgttctgaacttcccatacactttctcgcagcttctgcctgaggctgaaaccctttctggggtgttttcccaactgtcatcaggatgggatgcagaaccaggtgccatgctctgtccaaaccctgcctggctccggccttctcctgcagtctcacttctcaccgctcactctcctgatatttacccagacccaccgtgtggcttctcattgcggtgctcatcaggccatccttctgcttgaactgtcctttctacccatcctcccacagctaactctgctcatgcttttagactcagcataaacatcctctcccccaggaagccttccctgatccaaacccccgagttgagctaaatgtccctgcttgggtctcccacaacacttatgctcaccccgtcttatcataaccaacattgcagttgaagtgtgtgaagcacacatttaactaatggaattccactaactcctcttggccagaaggagaaagagaataactttatttatttatttacttatttatttatttctgaggcatgttcttgctctgtctcccaggcaggagtgcagtgggcatcatccttctgccttttttttttttttaagtttttgtagagacaaggtctcactctgttgcccaggctggtctccaactcctgggctcaagtgaccctcccacctcaggcccccaagtagctgggattacagatgtgcatgccgtctccctattcacattttattttactttattttgttttttgagaygcagtcttgctctgttgctcaggctggagtgcagtgggctgatcttcgctcacttcaactctgcctcccaggttcaagagattctctcacctcagcctccttagtagctgggactacaggcacacaccaccgtgcttggttaattttttgtattttagcagagatgggktttcaccatgttggccaggctggtctgaaactcctgagctcaggcaatccgcccacctcggcctcccaaagtgttaggattacaggcgtgaaccaccgcgcccggcccctattcacattttaaatagaaccactcttggccccctgaccactcctctctgagggttagatgggagccctgagtgttaccttagtcctcaggtgttttaacattgggagcctctggcctctctgggagtgaatctggcgtttaaagatacatatatttggccgagcgcagtggctcacgcctgtaatcccagcactttgggaggccgagacgggcagatcacaaggtcaggagatcgagaccatcctggctaagacggtgaaaccgcatctctactaaaaatacaaaaaaaattagccaggcatggtggtgggcacctgcagtcccagctactcgggaggctgaggcaggagaatggcgtgaacccgggaggtggagcttgcagtgagtggagatcgcgccactgcactccagcctgggcgacagagcgaaactccgtcccaaaacaacaacaacaacaacaacaacaacaaacatatatttcgtggagcaagaaatgtctcaaacatagcaagagagttgggatgccaacggaccaaagggaaagcaagcatgacatagccccccactacaagggcttacctattatccaagctttgggagctaggttagaatcccagctctgtcgctaaccaacctgtgtactttagccaagtcactgtacctgtctagacttcggatcgcatgtgtgtctgcccatctcatagggttaccctgaggctaaatgaggtaacaaatgtcatgaacccacaaggtagactcgactctcggtaacagttcgtgtcacccccatctcacactactctccctcttcggaccctgcacccatggattccatccaccgctggccaggagctgagtagaggcaccgagcacgtgaagaggtgaatgggcaaggaaggcttccaggtcasgtagcatttccagtgttccagcctgcaggcatctaccgagcctggcccgaggctggyacccagagatgcttccagtcttccagcagcaacgcactgactgtaagaaaagcctgcttataaaccccctacwggcatttggaagctggtccctggggtcctctacagattcatttcgcccccaamcccatcccctttgtgccaccctcgttattgcactcttccatccggatggcatttagctgggtccgggtctgtcacccgtctgaccaccagctccttgagggcaagaggcgcctgctgccctcagggtccgcgcccagcccgcagctgctcagatccggagacgggaaggtttgttggcgagarcctgactcccgggtcacagttaaggatgcaagagcccggcgccttcccgtagccccggccctgtcattaattaatgctggggctccattcggtgcagcgcagtcccagggatgcaaccrcaacttttgcgcacaataggctctcgatctgtaatccagccaacccaggcctgtagtgtgtaaatgccaactcagcgggagggctctggctgtcgcccagagccgtttctcggctctttcgcggttgccggcgcgctcgggacaggaggaacccgcagcccgcgggagtcagcggagacccgaccagcactatccagccctctgcaccgcccccgcggcgaggtctggaccaagtcgcccctagcaacaacagccgggccggctttctcaggccatgctgattggcgggactccgggtggcggcctgtcgtcacttccggcagccggaggcagcagaggaagccgaggggcggccatcttggctccgtgaggctytgaggtgcyggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggsagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggckggtctgcgaagtacatcgattatgccggcagtctagtcggttaataaagcccaggagttgcagcgttacggatcggtgctttgagaggccaggttgccgcgcaatggattgtgcaaaygtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgmctatatkctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtggccctgagtaagtagaacagtgatgtacctttctccacctgagatagattagaaaattatataaagagtgagtaatagaaactcttagactaggtgagtcagggaactaatttccttatagtccttttaaagaaaccttatttatttgtttatttatttatttatttacttatttattttttgagacagaccgagactgtctcccaggctggagtgcagtggtgcgatcttggctcactgcagcctccacctcccaggctgaagtgattatcatgcctcagcctcccgagtagctgggattactggcgtgcaccaccacgcccggctaatttttgtatttttagtagagacagggtttcaccatgttggccaggctggtctagaactcctggcctcatgtgatccacccgcctcggctccccaaagtgctgagattacaggcatgagccagtgtgcccaactgattagttttgatcattgatcttcactcagagaagcaaaaccttacattgaaccagagtaggagctccatgctttctaaactgaagccaaaaacagtcatagcagatttgtgataatgaaggatttcaaatgggtcttttttctttctttcttttttgagatggagtctggctctgtctcccaggctggagtgccgtggcatgatctcggctcactgcaacctccgcctcccgggttcaagtgattctcctgcctcagcctcctgagtagccaggattacaggcatgtgccaccactcccggctaattttgtatttttagtagagacggggtttctccatgttggtcgtgctggtctcaaactcccgacttcaggtgatcctcccgcgtcagcctcccaaagtgctgggattacaggcgtgagccaccacgcccagccatgtagtgtatttaaaatgaatttttgactttttttaaaaatcaagtttatcacacatcgttgcattaatttaccatgccctgttacatttttaactcttgcattggcatgttctggaaggagctgtgtagctttcacagtgtggagcccttgtgtcagtgttataactcaggtatagtccatattaattacctacattactgcactgctaagtattagacttcctgccaattgagtggtgaatgtacaagaatgaatgggagctctcattctgttgagaaccttttttcttaaagttaggtttgttgagatgtaatgttcatctgttttaagtatacagtttggtgaattttgacaagcgtatagttatgtaaccgctatcacaatcaagatgtagaacacttccattgccagaaaggtcccttatggccctgtatagtcagtgccctctccctttcttagcccctgggtaaccactgatctgctttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttamattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgagatygggccaccacattccagcctgggcgacagagccagactccatctcaaaaaaaaaaaaaaattagccaggtgcggtggtgcatgcctgtaattccagctactcaggaggctgacgtgggagaatcacttgaacacaagaggtgaaggttgcagtgagccgatatcatgccactgcactgcagcctgrgtgacagagtaagactctgtctccaaaaaaaaaaaaaaaaaaaaaaaaaaaaaagcagacaacttgcaacattatcttcatccttgtacactaatttgtttttgtttgatttccaaatattaatgtccacccttagtgaatgggtatataaaagtttactgttggccaggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggcygggcgcggtggctcacacctgtaatcccagcactctgggaggccgaggcgggcagatcacgaggtcaggagatcragaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggctgctagtaatgacagaagaccactaactatttagtagcaaagcctctactgggccccagatctctagcttaggctccacaaggagatgtagttgtacctgtacatagagtatttctaaaactttttttttaagcttgtagatcaggggtgtccaatcttttggcttccccgggccacattggaagaattgtcttgggccacagataaaatacactaacactaacaatagctgataagctttaaaaaaactgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatcsttccgactcagcctcctgagtagctgggactacaggcgtgccccaccacatgcatggctaatttttaattttttcktagagatgagatctccctgtattgcccaaggtggtctctaactcctgggctcaagcaggcctcctgtcccagcctcccaaagcactggaattacargtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacrtaggacagccttccacagcaaagaattacccggcctaaaatgtcagtagtgccagcgttgagaaaccctggtatgtacttagccccccatgtactcaacagcgcagctcagtggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgctttttttttttttttaattgagatggagtcttgctctgtcgcccaggttggagtgcagtggtgcaatctcrgctcactgccaacctctgccgcccgggttcaagcgattgtcgtgcgcagcctcccgagtagctgggattacaggctccygccaccatgcctggctatttttttttttttttttttttttttttaktagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactartctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagcttttttttttttwaaatttcctgaggcggagtctcacactgttacctgggctggagtgcagtggcacgatctcgctcgctgcaacctcygcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccctcctcggcctcccaaagtgctggaattacaggcgtgagccactgtgccccggcttaatcagcttgtcaacttctaagcacaacctgttgaatcaagctgtttgggccttatcagaaaaaagttggcctatagtttcagctactcaggaggctaaggccagaggatcacttgaggccaggagttccagtcgacctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactrtttgattgcaaagaggattgttctgcattttattactttttttttttttttgagacagagtttcactcttgttgccaggctggagtgcaatctcgtgaccttggctcactgcaacctccgcctgccagcctaagtagctgggrttacaggcacacaccaccatgcccagctaattttttgtatttttagtagggatggggtttcaccatgttagccaggctggtctcaaactcctcaccttgggtkatccgcctgccttggcctcccaaagtgctgggattacaggcttgagccactgcgctcggcctgcattttattattctaagatatagccaaattttatgcctggaattttttcctgggctggaacaaattcctagtaagagtcagggaatattccgtgacttgtggctttggttaaaaaagaaaaaggagtcagggaatgcagtaccctctgatcaccactgggaggactaaagcagaaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttagagttatagactggaatttgaaactagtcttgagatttaactgtggacaaattcactcggctgtgcctcatggtttttttttttttaaatcaaaagagaataacatcatctcaagttgtgtcttggtttttttgtttgtttacttagatttttatgacttcactttctcaatttcctctgtggccagattcatcaggcattcagtcactttcatctctgtcaggctggccttgkgttctgtctgtctgttctgctgcayagttgtcatcctgagatctcccttcacccatatcctagggattccctttgcctttcctgttcgatccattttcttccccttggttcactcccaggtttcattgcagcagttcctccagtgattttctgagaaagttgctcagaggtaaatttttaaaatcctttcatatctgcaaacatctttattctgttctcatacttgattgatattttggctgcatatagaattctagactgaatgccctttttcctcagaattttgttttctgtcttatatagcatctgacactccratttggagagagagaatgctattttgagtcttgcttatttttctgtttrtttaaggctgattggaagttttgtgcatttggatggatcttgaatacaacagtgggacacactgttatttctttgtggtgctcttgataccaatatatttagtcttatcacttggcctaggcaagcacrgaatgcccatgttccagggagctgagtcgggagagggcagaaggaaagatctgtggctttctgctttctctgcttgttttcagtgtccctgccctcagttgtgccctgtgtccccaagcccagagactttccattttgccctttctaaagaacctccagttttttgcctgagtgggagaggagacccagggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtrttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttgttgtagtagagtagcgtttccccttttcacccaagctttgttacctcttcttgggtggtgcctggcctgagatgtccttcatctctcataagaactctcctacttgccctttgaggactccatcccttcacatcttggggtaccttttttccttcatctcacccaaatgtgatcatgtcctttgggtgcctagagctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacarcattagagtattcactctgattttctcttggggcaggaattgccccttgtttcagttgctattcccccrttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcaccygccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaasatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcattcttgttttttgcgggggttggtgatttttatcaaatcaaggacagacatcccattctaatcctagtttgctataggaattttgtgggggctttttggtagagacagggtcttgctatgtttgcccaggcgggtctcaaacttccgggtttaagcaagcctcttgcctcagcctctgaaggtgctgggattacaagcatgagtcaccatgcctggccaagagtttttaaattataaattgttcaatcttatcaaatcctttttctatgttgaatgaaataattgcctagctgctttcaaaagtgaaacgtgactttgtgaatatttctaaagtacaaaatacttggaggacagccatttattgtcacaacttggctttgtagtttgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaatttttwacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcrggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaargaaaggaatttggaggtatgcagcgtctagctttgratcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattaccaacccctaccccctactacattgccacctagtagactttaactaatgagaactggccagaactaagccagatggctatctctagctgcagagaagtttgggaaaacaagtatttggccaatgtggtctccctaaacacgtgttcaacttcttgaagaaggaaatctcatgtctttggctgtattcagcatttttcagtagcagttacatattctagttttcatggtggatgaagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaaagttatcaaagaattatataacattttgtgtgtgtgtgtgtgtgtgtgtgtgtgtgtgtgtgtgtgtgtrtgtcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaacttttaaaaagttaattcttaaattttttaatttaaggacttcgtcaagaaacatcgaattaaatatattgagtttaaccctaacaagcatcagatctttcagtctgctgtatgaggaaatacaagtttctttctgctttctattatgattgttgatttgcatgagcgtgttttaggttaggctgtgttatgctgtggtaatacataccaccaacatcctcatgatttaacacaataaaaaacttctgctcacaccaagtctgcttgagggctcattggctccgtggaaactgatctccatgtccaggccagtttggtcttgtggccgtccgttttagggcagtgcttagggtcaggagagcaaaacacagggctggagagttaagcacaggcaactaaatgcttcagcatgggaatggcattcattttcactcacaggatgtgttcagcttagtcacatggctgtctatgcctaacctcaagggaagggagtgcagtcctccaggaactcagatgtaaaaaagccagtatgatggatatagtattgtctacaaaaaaaagtagcataatagagttagatacaagcaaagtactctaggatcccagtaaggagaagtaagaaattctgatgagatgcagggagagccttagaagggttcatgaagatggtgacagatgatacaaactcagtagaatgagcaggtttttcttagatttgaagagaagaaaggacattcaaactaagggaacaacactgactgagtcagagctagactcaaagctagagtctactggctgatgtcgtgggagaggaagaagagatgagcgggccttgaattcgtttaacattcagcaaaaatgtattgcatgtctaccatgtgttaggcactgtttcaggtttggggaatatctgataatgaacaaaacacaaaaagcctgtccttgtgaaggttacatgctagtggaagaagcgctaaggagttagtattttattataagcacactggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccacygcactccagctgacagagtgagactccatctcaaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggacygctttatgcgctgctttttaccacaccttaaatagtgcctggttgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtascagttttgtaccaactgctrttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcatttttgttagaggaacaatgtttacaagttgcctagatttgcagtgaggtcataaaaagcctgtttaatctaaaatagacatttgcaataaaaacagaaattgttgttgagatgccatattatgtgataactgagtaaaacagacaagagcctatcccctaacctggtatgtgaatgtgaaaatattagagaaataatgaagaagtagatggagactaatgaggaaattctgaaaaggacatcttttgagaaattcagaggtagatggcgcaagttttaaagcttactttcactttaaaacacctgagtttcatttcctttgatttgagtaaattacaaagcagtttattagttaaatcaggcttgttttgatttataggtatatagagaaagacaggacattttcctggacagaaagttggaaaagagaaacgtgtaaagggggtggaaagtggctgtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttrtttctgttatgacagttgctctgtttatttccatgtaagagaaagaaaagaatatagatataggccttatttcttttttttaagatggagtctcrctcygtcacccaggctggagtgcagtggcatgatctcagctcactgcaaactctgcctcccgggttcacaccattctcctgcctcagcctcccgagtagctggcagtacaggtgcccrccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccatgttggtcaggctggtctcgaactcctgacctcgtgatccacctgccttggcctcccaaagtgctgggattacaggcatgagccaccgtgcccaacctattttattttcaagacagggccttgccctgtcacccgagctggagtgcagtggctcaatcatggctcactatagcctcracctcctggggtcaggcagttctcccacctcagcctctcgagtagctgagactacaggcatgcactgccacacccggctaatgtttaaaaaatttttttgtagagacagggttctcaccgtgttgcccaggctggtcttgaactcctgtgttcaagcagtcctcctgcctcaacctcccagagtgttgggattacaggcatgagccaccatgcctcactaattaagctttttcttttttkgggggttaggggggtgtcgggggttgggacggagtcttgccctgtagcccaggcctggagtgaagtggcatggtctcggctctctgcaacctccgcctcccaggttcaagcgtttctcttgcctcagcctcctgagtagctgagattacaggcgcacaccaccacgcctggctaattatttttttttttttttgtatttttagtagaggtggggtttcaccatgttagtcaggctggtttcaaactcctgacctcaggtgatctgcccgcctcagcctcccaaagtgctgggattataggcatgagccaccacgcccagcctaattaagctttctcaaaagaacatgaaacatatattaggtgtctgggagttttttgttttgtttttgtttttgtttwttttctgaggcagagtctcactctgtcacccaggctggagtgcagtggtgcaatctcggctcactgcaagctccgccttctgggttcaagccattctcctgcctcagcctcctgagtagctgggattataggcatgagccaccacgcccagcctaattaagctttctcaaaagaacatgaaacatatattaggtgtttgggagttttttgttttgtttttgtttttgttttttttatgaggcagagtctcactctgtcacccaggctggagtgcagtggtgcaatctcggctcactgcaagctccgccttctgggttcacgccattctcctgcctcagcctcccgagtagctgggactacaggcatccaccacyrcacccggctaattttttgtatttttagtagagacggggtttcactgtgttagccaggatggtctcgatctyatctcgtgatccgcctgcctcagcctcccacagtgctgggattacaggcgtgagccaccacgcctggcccatctgggagttcttttgctttcccattactttaaacgttggaaatatcatagagtgtttaaatagtctttacctttaaaaataggtaatgttttgttctttttcagtagcaaatgtctgctaccacagtaaaaattgtctttaacttcaggtatacacttatgtgtatgagctcatgttacttgctaatcaatattattgtcaatatttacagatttatcttcaagaagtttcttaatctctctacttttctcatagcgtatgtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctcttttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccrgctaatttytgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcayttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctrtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaagcttttaaaacaaatgctctccctgtgcgagacccttctgatagatgtgccaagactgtgacacatatggcgtagcattcatgcctgcagcccaccaggcctggggctgcaagagcatgagccctgggtctgtcatctgtcagcatgcatcctctgtttgcagcartgtgccctgtaaatattttcatttcctgtgtgtgcggagacttggaaaaggttgggaagcactggactgtgctaactggaattttaaaagactgttgccagaaatttgccttttgacaattcattaattttagtgataaaattcttgtggatttttagttaagactccttgttgctgagctgccttatagactgcttttggaatctgtaaacagcttgtgtgggcggagctgtccttgttgtccttgattaaagctttcttgagataaggaacggtgagacctctgagtttcttagttcccaccagttccaggtggctacttgccagcttcctcatgtgggcagagatggtgggccaagagagcgttgagacagacgaacctcttccatttaccttacctgatttacattatctagagtctggcctgtggtgtttacttctagtaggttctttctctagaaatgcttgaatatgactagcagagtggtttaatttaaaaactttctcagtttctcagtttttttaaaactttgaacaagttctcactcgtaagtgggagttgaacaatgagaacacatggacacagggaggggaacatcacacaccagggcctgtcggggtgaggggcaaggggagggatagcattaggagaaacacctaatgtagctgatgggtcgatgggcgcagcaaaccaccatggcacatgtatacctgtttaacctgcacgttctgcacatgtatcccagaacttaaagtaaaaaaaaaaaaaaaaaaaaaaaaggaaaawctttgaacaaaatcattttactcttgtggggttttttttgcctattgtagatatgacatataaaatgtaaacattatagaaatatagaaattcattatgtaraaagtaagttccttgaaatttgtctcttcaaagacaatcactttcagcagtttggtgtatattcccagagttttttatatagacattaacttttaaaaaattttaacagaaagggactcatggaacatgatgacagtttttttacttagtaatgtaccttgaccatgtctgggtcttagtactcatagatctgacatattagtctaaaggcagcatagtcttcctggctatggtggtaccatagtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcartctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagaraaaaccagaagttgctttttcccttttcactacttagatttatgatctttttatatatttttgtcattcataatttctttttgaggcaagttccctggccacccgcagtagctcatgcctgtattcatagygctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacraggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccrggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatatgtgtcctgttatttctccagtctgtttatttrgtcctatacccatacygtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagakgggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaaatatgccttaatataggcgctggggcttgcccrtggtgctcttgatatataaggcccggacattctgccagttktttctcgagcagtgacaccaagaagttaacagccaggtgaatgttatgcacaagctcatcgtctgtcatcttcacgtggccaacagccacagccaaacataacatgttcatatgaaacttgattgtggacttcgcctcatccactttggccaccgtgttttcatcgtgtgtgagcagggaagggaactttactgcctttgttaggcctatgccgaggattcgtgggatttgctttatcagagactctgaagscaaaaatgcatcatacttcttggccagcttcttgaccagattcttattcttgagtttttttggcacctcagtgtccacttggggggatatccgtggccttggtctcgycacagtgctgctgttcccccaggacccacacttgggacagggagtggacttaagcctgacggtgccygagaagcgcttgtccttctgggggtcatagttcttcaagctgatctgcaactccaccatcttcaggaacttgggrcactttcrctggttcccgtgcaggacttcctgcaccgcctcatccagggtgtcgtgagagactttgctgcttatgggttctcatgccacgctaaccagaaaagagggtttagttggttttataaattattaatagtttgggaggaaattgatattttaatgaygccaagtctttctttcttttttttctttcttttttttttttgagacggaatttcgctcttgttgcccaggctagagtgcagtggcgtgatctcagctcaccacaacctccgcctcctgggttcaagcaattctcccacctcagcctcccgagtagctgggattacaggcatgcaccaccatgcccggctaatttttgtatttttagtagagacgggtttctccatgttggtcagactggtctcaaactcccaacctcaggtgatccacccgcctcggcctcccaaagtgctgggattaccagtgtaagccaccacatccggctaatgccaaatgtttctattcaggaatgtgcatgtgtctcaaatttgttttcaggttttgtaactttttycatctatgttttatataatgcttgttaaattcatttcaagctattttataatttttgttgctaatgtaaatggaacwtttttttcctcaagaaggcaataatcatataacttcttgcatttgggaaacttttgatctctcatttggaatgtcgaaaattaagtttatattgttttttaatagcatgctttttttttttttttgagacagagtctggctctgtcgcccaggctggagtgcagcgcgatctyggctcactgcaagctccaccttttggactcaagcaacctcccacttcagcctccccagtagctgggaccacaagcacacagtaccgcacctggcttattttattttattttattttatttawttattttattttattttatttttggtagagatggagtttcaccatattgcccaggctggtcttgaactcctgagcttaagcagtccgcctgcctcggcctcccaaagtgctgagattacaggcgtgagccaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctgtacaggtttttctgtgaacataagttttaatttctctaggagtgacattactggatcgtgtggtaaagaattaagtgaattgttaactagaaaactgattttatataacagtataatattcctagtagaaagaaacctaaagcctctggtctggtctgtgaattggtgtatttttattacttagtacttttcttttctttctttttttttttttttaaagatggacttttgctcttgttgcccaggctggagtgcaatggctcaatctcagctcaccgcaacctccacctcccaggttcaagcgattcccctgcctcagcctccctagtagctgggattacaggcatgtgccaccatgcccagctaattttgtatttttagtaaagacagagtttctccatgttggtcaggctggtcttgaactcccgacctcagatgatccgcccgccttggcctccccaggtgctgggattacaggcatgagccaccacacccagctacttagtacttttctcagctaagatctttatttttgtcagcgttctcttgccctgtgatgggaacgtgatgtatcttgcctattgaagaactaaaacctctgaagaaaacccagagggttgtgggaagagtggcattgatgatttggggacttaatttgttctgagtcagtataagttaaaggcttattgtgtattatgttgagagttttaactgctatccttggggtaagaacagagatgtagaattatatcgtgaaaagaattttctgaaagaagggagtagggacaatctatatcatgcatttaagtcacaaggatgtcgtgaacataaaagatactcacgaaggccgggcatggtggctcatgcctgtaattccagcactttaggaggccaaggtgggcagatcacaaggtcaagagatcgagacctgaggtcaggagtttgggaccagcctggccaacayggcaaaatcccatctctactaaaaatacaaaaaatagccggggatggtggtgtgcgcctgtagtcccagctactcgggaggctgaggcaggagaatcacttgaacccgggaggcggaggttgcagtgagccaagatcatgccagtacactccagcctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagttcagtttagatgagacttcccacaggatgaccatgaaccaatcagaaatggatatcaaaatgctcattttatatatttttaaaatacatgtaccagttgtgaaattcatctgatttagctcttaaatgaaaatgctacccattatccatattgtcctggaagcatctatcccatatttactatgaatctggggatgttagttgcatctgctgtcttgcttttgaccaacttttcatagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggmcccaacttttttaagctctttcttctgttactcyaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacacatataatataatgtattagctcaagagagaatcggtgagtataaattagagacagcaaggtagctctttctaggcacagataagtgggatggtagctacagggagacattaggccaaggtattttttagaagatggacaaaatatcaacatatttctctactaatggggataatctcataraaaggaggaaattggtgctgtcgaagagattttggaataggtgaggggatggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatygcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtwatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgraaggacaaaggagcattgttatacaacaccccagggagtgatcacaatgaaattagtgatataattaggaactaagaacttgaggaggaagactgaccctatgaagktgtggggtcagtgaattacagatcctggtaagttccaacagttattagagtwctagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcmcttgaggtcaggagtttgagaccagcctggtcaacatggtgaaaccctgcctctaytaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctctttcatatagagactttctctggatgtctggtagcctctggttgtctgtacctaatgtggagccctaagcatctgatcacaagctgtgtttgtatgaataggacatgtttgaccacagagctttcctattgggagttgtctggtgcttttattgaagaccccagatatttgtgtccttagatttctgagagtatccagtttctctagataagaatcttctcttctgcctgggaggaactgatgatcccacccctcagtcacttagtcctcccccgcctgccttttcatctgttgcttcactcctgaaaccacgtttcttcatcctggggtgtgtgaaacttcctgagactttgcataaatgcttatgtttagtcacgagtttgttggtgaagactatgttaacaactttacagaaagtttggagaatagagaagaaaaaccccacaatcctaatattctgaataccatttttgtttttgtatattttccatatacatgttttttcaacatatttttgattataattttgtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggctgggcgcggtggctcacgcctgtaatcccagcactttgggaggctgaggcgggcggatcacgaggtcaggagatcgagaccatcctggctaacatggtgaaaccccgtctctactaaaaatacgaaaacaaaattagctgggcgtggtggcgggcgcctgtagtcccagctaccaggaggctgaggtgggagaatggcgtgaacccgggaggtggagcttgcagtgagccgagattgtaccactgtactccagcctgggtgacagagcgagaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttmagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtcaaaattcctctgctgatcagtgggatggggattgggatcaagattgcttctgtgaatagccactgcctggggaacatagcgagatcctgtctcttaagaaaaagaaacagaaacttttggaaacaagcagacaagggtgaaagaaagccttggtgtaagatataatttatatattccatataagatatagaatacatatgttatataactaaaaagcataaaaacagtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagyctggagtgcagtggtgcaatcttggctcactgcagctctctacctcctgggcccaagcartccttccacctcagcctcctgagtagctgggaccagaggtgtgtactaccacatccggctgattttttgtattttctacagagacraagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttsgaaaaaatttatttgtaacacccaaatcagtacagcgctttggtaatccttttcggacatatgcagaacggtgaaaaaatatgcacatccctagttgaggttcaacaaggggacactttgctttctttttttcagtctttgtgccgtaaaccagtgtcttttttgtgatctatttaatgccttttttttcatttttgtactttttgttgatgattttgccatttaaaatgggccccaagcatagtgctgaagtgctgtctagtcttcctaacgcacccttgagtgaaacttacctaacacctgcattttctttgtaaggcacatcatagccttgccatggataaaactctggacagttgagtttttccttgcactgcacatggctatggtgctttacaaagaagatgcacgtgttagaagtttcactcaagtgtgcgttacagtgctgtggctgtgaattcagtgttaaccaatcatatatagtaaagaaggtgttcttaaacagacacacacataaaacaaacttatgtattaatctgctgttgcaaaatgttgtgrccagaggcttgcagaaacctaacccccagaagcaatgatttcgtattcactaattcagtgagcacagtaactgcatagaatgaacaatgagaattgactgtagctccttttttgaaagaagaggcttaattatggagcaaggcatcaggaaaaatcacaggctttcctcatttgtgtgatttttttattttgttcatgtcttcaagagtggagccctaagaagaaagctgagagctcccagtaaaggggtgaygagtgcctggcttagcctcatagaggccagaggaacgtcggtctttacactgggacattccacacacgcaacacagagttattttctatggacagttgagtttttccttttccaagcatattctagggttgtctttctgtgccctgctacatgttccactgtactgctgtcagatttttatctcccagaaattctttgaagtcacttgtcttctggtggcagcccttcccttctcttggccattctttgtcatttggtctttgttcttcagtgggcctatcaggtggcaggacagagaaatgcatgtgatcaatatgccatctttaaccaatgtcctcattatggttatgaaaataacttttcatgtaattatttttattcaagttacatattacacacagtttaaagagtcaagacttgttaaaaaagagtcccctagactcactggtttccttrtctcccaggatggccacttttaatcttttaaagtgattctttagtcttttaaatgattctttcatactttataacatgcttgtagtcttacttgtttttcaggtttaggcattatctattgacattttatttaaagtcatcattgactttaaaaacacaaaaactctttactgaaatgtaacacaggttgggtgcaatggctcatgcctgtgaatcccagcactttgggaagccgaggcaggcagatcacctgaagtcaggggttcaagaccagcctgaccaatatggtgaaaccctgtctctactaaaaatacaaaaattagctgggcatggtgtgtgtgcctgtagtcccagctacttgagaggctgagacaggagaattgcttgaacccaggaggtggaggttgcagtgagccaagatcgcgcgactgcactccagcctgggcgatagagcaagactccatttcaaaaacaaaacaaaaagaaacgtaacatacataaaaagtgcccaaatcataagtgtacagcttgatgaattatcacaaagtaaacacatttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccrtttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtccaagatgactaatgcatcattcttcaggccactctatccccctagaggacttgcagtcttttttttttttttttttgcctcctcttttactgactgagaatgttgttaacactttcagaaacagggtgttaggatcttttgaccgttggtgaaccaacagaaagtggaagataaggatttttctccagtgggtgtttgctgtggatttgttgggagaagcccatctcatgtatgagctgtcccatccctattttgtaatattccactttgctgctggcatcagagtgaatgtaaatggaatttcccagaaatttccacagcaagtggctttctcacttagtgagcccccttggtgtttgttgagtctccctttacccaaccccacaatcactggaataaaggggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattarctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccrgcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaacaaaagaatctttagaataggaggaggatattgagcagaaccataagaaactagtgattaagagtccaggtgtgaaaatagaaaccacgtctcagaagctcagagagaagaagaactgraarggcagcatctttgatggatttggccatgaagaggaggaggaataaagcagaatggaggccagaaaagagtgtgtatgtctaacggtttcattggaattgggagatctaggtataccatgtaaaattacttatgaaggtaaagtttgaagaaaattcattcgactttgatttatataatttttaaaacctcattatctgttaaaacaccagaagccctgttttttggttactgattatgagtgttcaaggcctcagatcaactcagcatttatttatttatttatttttatttttttgagagggagtctcgctgtcttgccaggctggagtgcagtggcatgatctyggctcactgcaacctctacctcccaaattcaagcaattctcctgccttagcctcccgagtagctgggattacaggcccatgccaccatgcccagctaattttttgtatttttagtagagatggggtttcaccatgttggccaggatggtctttgtctcctgacttcatgatctgcctgccttggcctcccaaagtgctgagactayaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccrcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctrtttcagtagtcagtattttcttttgcttattcagtttccactgaaacttatgttttccaaatacaaaattagaattccaactttgcgtttttcaggcgcacacactcgttttccctccactccttccccagttctgatttgcttcctcctgaaaatgggggttatagcccatccactccagggtcagaattgctggataccttgttgcagtgattttttctgtagctcctctggaggttatagactcatagggaataaataatgtggtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgwgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttaygtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactytccccttgtctataagtaacttaaatataaaatgttrtaacaatacrtttattagtttgaagccccaattttctttttttttttttcttttaagtgaaaacaagtttataaaagaagtaaagaaacaggccaggcgctgtggctcacacgtgtaatcctagcacwttgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggttgcaatgagccgagatcatgtcactgctctccagcctaggcaacagagggagactgtttcaaaaaaaaaaaaaaaaaaaaagaaacaaaagaatggctgctccatagacagagcagcagtatcagctgcttgactgagtctacttatagttatttcttgattatatgctaaacaaggggtgaattattcatgagctttctgggaaaagggcagagatttcctggaactgaaggtccctccccttttaggggactatttagggtaacttcccaaggttgccgtggcatttgtaaactgtcatggtggtggtgggagtgtcttttagcatgctgatgcattataattagcttataatgagcagtgaggacaaccagaggtcactttcatcgccatcttggttttggtgggttttggcctgcttctttaccacatcctgttctatcagcagggtctttgtgacctgtatcttctgccaagctcctcctatctcaccctgtgactaagaatgcctgacttcctgggaatgcagcccagtaggtctcaggcttattttacccagccccttttcaagatggagttgctctggttcaaacacttctgacatatttcccccctcccttttacagggggacccttaatccttaagaattgtagcgggacaaagatcatctgtaacttcttcaagccaaataggggtgatgatattcctgcctattagggtctcttgtatttagggtagggagaagtttagttagaaagcattgttatagaagcccttattttcagttacacaattttataaagttacaattgcttattgtaaccagctgagttttaggttttgtggtttgttgcttgcttgcttgcttgcttcttaatgccatatatcttggcatttatcagtccataattactaaattcttaaaatccataaatrtttattattctttctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttytattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcagtggtaggacatcagcaaataattaatgatcttcataataaaatccttctagttgtttttagcttcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagyagtgctctatatacatttctaatgtattcctcatggttatttatatyctggtaattttgaagccctgtccctgttttgtgtttgggaggtggggagggagatagactttctctgcrctaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacattagagtttaatacaatgtggtattcagaactaaaattaacatacaaggatgtttaatgaggactctaattgagtattctatgatgttacataccttccactattcatgtgtacctggatataattgtaatcctaacagttttcccggaaaaatttttaccatggtgttgtatcaagttggctgcagtttttccttcttgtttgcttgcttcctttagtcattttttattttattttatttttttggtaatgatttttcattgctgctcttcgtttattatttgtcacatcattatcagtttagtgcatggtagtttggttagcccattagtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcaattttgcaacaatgtagaatgtaccaggcaactttgtcagccccctttgcagtcattcttgcatccttttttcttctcagcaccattcatagttgtatcacacttgcttcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattctggtgagagatttatttttctccattgttttttaagagatgggtcttgctctgttgtccaggctggactcgaactcctgggcttaagcagtccttccactttagcctcccaagtagctgggactacaaatgcacaccacagcatctggctatataccttccaatgtctcactagtatatctggaatactattctattcttacgcatcttttaggtcaattttttgtttgttcgtttgtttttgtttttgtttttttgagatggagtctcgctctgttgcccaggctggagtgcagtagtgggatctgagttcactgcagtctccctctgcctcttgggttcaagcaattcttctccctcagcctcccaagtggctaggactacaggtgtacgccaccacacctggctaatgtttgtatttttagtacagatgggggatttgccatgttagccaggctggtctggtctcaaactcctgacctcaggtgatccacctgcctcagcctccacttgctgggattacacgtgtgagccaccatgcccaggccaaggtgtgtggatcacttgaggtcaggagttcgagaccagcctggtcaacatggtgaaaccgcgtctctactaaaaatacaaaaattagctgggcgtggtggcacatgcttataatcccagcttctcaggaggctgaggcaggagaattgcttgaacccaggaggcgacagaacaagactttgtctcaaaaaaaaacaagaaatttgtaacatgtaatgaaataattgattttttgtaatgtatttatgatagctggttagttagccaaccttgagcacattcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgttyccccccycccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctsacccagtagtaaagcattttttgagtaagatttaaccaccattcttaaatctagactgagtaggacagaaagggaaatccctgtgtttttaaattttaatgagatttacagaggaagaaraaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtwaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgsgcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttcttttyttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtactttgggaggccgaggcgggtggatcacctgaggccaggggttcgagaccagcctagccagcatggtgaaactgcatctctactaaaaatacaaaaattagttgggcgtggtgacataccccagctacccagtaggctgaggcacaagaatcgcttgaacctcggaggcggaggttgcagtgagccgagatcacaccaytgcactccagcctgggtgacggtgagactctgcctcaaaaaataaataaataataaactgtcctgtttgggaaattagctgttatctccttttcttctgatttctaggaaggtcagataacaacttaatttaggtttgggaatgtggaatcttagcagggattactccatttttaattttaacctggtttcctggggcctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactrccattatgactatcatgaggatcacaccaagcatttagagtatgctcctaagccagggtttttatgaaccaaatcaactaaaattgtatagccaaacaaggagtctgccaattttaaccaagttgtcygctctaccatacccaaatcgcaacgagaartgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcmttgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactrgaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatcttggtcatgggatgtagcagggaaacttataatttgaaarcaaggagaaccagttcatgcttttcatgtggtctgtcgtgtaatgacttttactgctgccaccactgggttattttgggcactgttgatttagttttcttaagccagtacttttcaacccttcttgtgcattagaaacatttgtggagtttgaaaaaagcatatttccttcacagtactttcctccctagaggtcctatcttggcgggtctagaaatgtggtgatctcagtacacaccccagatgagaatggctcctagtctgtcttcacttcccccaaagttcttaatttctctcttcttccaattttacttatttttatttatttatttatttttttgagacggagtctcgctctgtcacccaggctggagtgcagtggtgcgatctcagctcactgcaagctctgcctcctgggttcacgccattctcctgcctcagcctcccgagtagctgggactacaagcacccgccaccacgcccggctaattttttgtatttttagtagagatggggtttcaccgtgttagccaggatggtctcartctcctgacctcatgatctgcccgccttggcctcccaaagtgctgggattacaggcgtgagccaccacgcccggcctatttattttttattgattgagtgattgattgatggggtcttgtcctgttgcccaggatggaaggtagcagcaagaccagagctcactgcagcctggaattcctgggctcaagtatctttccacctcagcctcctgaggtagctgggactataggcgcgcaccaccacacccaactaaagtaacctattttatttatttatgagacggagyctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcacygtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcartcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaacccaggagacggaggttgcagtgagccaagatggcaccactgcactccagcctgggcaacaaatgagaaactctgccaaaaaaaaaaaaaattgagaataaaactgtatatatgtttgtttatttttagatttcaaaagagaagaaatagaaaaaccggctttcagtattgttgcttctttattccttataaacttttaaatttcttgccagacttatttttgttttggcaataaataatacgggttgatatttagaatacattataaactcgggaagctgaggcaggaaaatggtgtgaacctgggaggcggagcttgcagtgagccgagatcacgccactgcactccatcctgggcgacagagtgagactccgtctcaaaaaaaaaaaatacattataaactgagaatagtagagtgtattttagagattgattgtttgtttttagaattgaggtctcactatcttgcccaagctggtctcagactcctgggttcaagcatcctccttccgaggattccaatctgccttccaaggagctgggattacaggcacacaccaccatacccagctaaagtatatttttcattgtaccaaggactyattatgctattttagaaaagtcaccaaggaaccaagtattttaagtgggttaaacttagagcatagcctggacccatttgcagaaaatataaacttgggtgcaaatkaggcctttgtgagagaattataacagtaacatcagccagaatcacaaacacatgtcaggagtttattgtgtgccaggtgctgttccatgcactctgtatgtcaagccatcctttcattgtagaggtgacagggtcagggaggtcaagttacctagacttagtgagtggtacagctgggttgggattaggtagtatagctcctggaatcaaattctacacacactttatcttatagcattgcatgtacttttcacaacagtcctgtgaagcagttgttttctttttttttctttgagacagagttttgctcttgttgcccaggctggagtgcaatggcgtgatctcggctmaccgcaacctccacctccctggttcaagtgattcccctscctcagcctcccgagtagctgggattacaggcacccgccaccacgcccagctaatttttttgtatttttagtagagacagggtttctccatgttggtcaggctggtctggaactcccgacctcaggtgatccacctgcctcagcttcccaaagtgctgggattacaggcgtgagccaccacgccaggccgaagtagctgttttcaaaatctatcttataggtaagtaggttaaagctctcaagattttgtggtttgttcactcatccagtgaataagggactgaactagccttagaacctaaatttataacatcaaatagctttctttgcataagttcccttggagccagtcactcatagtactttccatatgggaaggataacaaaggaamatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagytaagcaattttttaaaatttagttkttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggttttttttkgtctgttttttgtttcttttgtgtttgtttgtttgtttgtgactgagtctcgcactgtctcccaggctggagtgcagtagtgcgatctcagctcactgtaacctctgcctcccaagktcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttcctyttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaaraaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacrtttatcagtctttttttaatatgctttgcactttttatgtcttttttgtttttttgtttttttgtttttgagacggagtttcgctctgtcacccaggctggggtgcagtggcacgatctcggctcactgcaagcttcgcctcccgggttcacgccattctcctgcctcagcctcccgagtagctgggactacaggtgcctgccatcacgcctggctaattttttttgtatttttagtagagacggggtttcaccgtgttatccaggatggwctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacrcacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgyggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcwatacataacatttgaataagccagactaacatctttctaggctatagttctaatgtagagcaataaaaataraaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaagragtcagtaaagctaaaggcagaaaataatgaatttgaaaacagtagaaatggtaaatccaaaactttggtgggtgtcycccccccycccaccgacaaggaagtgagaaragaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtgagtacatactctgcctctgttcagctgttccagaacttaagaagaggaacttccaaattcttttctcaaattcagaaacaatgctattgaaatatattggaaacaggaacgaaaactacagttcagtttcacttataatatccattctaaaattgggaattaaaaatactagcatataggactaaatactggtacatttatctttgtttccccaaagcattcactaaatgatggtaacggaattaaaaaggaggggaaaagagtccaggaattgagtactgaggcattctcaggaagagcaccaagagagggaggagatacccagcggtcacagtggaagtcgtctttgagacttagagcgtttgaggaaggggtcgtctttaaaataggttacctacctagcacttgggagaccagaccagcctgtggcaaccagtgacatcagttcctttgagtctttccagagatactctgtatattaagaagcaaatttttttttccttttttacacaaatgcattttcttgaaaattccttctcatgaactttgccagcctctctgtcttggtttgtctgagagggcctttgatgcactcttccatttaggtgctgtggtagttgaggcaaagggacagtttctgtagagtgatgagggagtgacttaggtggcctggtcttctgtcccttatctgtgtatctggagaaggragcctgaacaccttcattgtgatggtttagatcagttttatgtctgtaacccccgtgttctcttttacatactcattttactttcgtatcggttggtaaaattgtctttttttttttttttttttactagagactaaaattctctctctcttttttttctacttgtcaaaaggtaaaattttatttttccagtggtaatacttgacaacccccaggtcttggctattgggacatgtttctttacttctctgataccgtagatttagtgtccttgatatccccattgccaggattccaaatctttgccttcaaaggtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcrggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaacttwaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaacttarcataaagcttatttacacatttgctgcctgccagtatctacctaatacataattccaatagagaggtgaatacataaagttatttgggctaatatcctgccactacctctcttgggattctttggctgctctttttgcctrcggaattaaatttttactagtcttctatctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgwyaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtggccaggcgcggtggctcacatctgtaatcccagcactttggaggccaaggcagacaaatcacctgaggtcaggtgttcgagaccagcctggccaacgtggcaaaaccccgtctctgctaaaaatacaaaaattagccaggcatggtgggacctacaatcctagctgctctggaggctgagacagaagaatcccttgaacctgggaggcggaggttgcagtgagccgatattgtgccactgcattccagcctgggcatcagagtaagactccgtctcaaaaataaataaataaacaaacagtatgttctagtaactaaaaggagttggggtgactagaacgtacctttgaggggtatgcagaagttggcaggttgcagggatgccatggccatggtcagggtttcattctcagtgctgtgtatcctgagctatattgatatggcatccaaagtggagattgttgtctttttttttttttttttttttttttgagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctrcgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgrgcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttrtaaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaactgtcaacatcagttttaggaaatgaaaggattgatgtttagtatcaaggatagcctatcaagaatgcatcaggcacaagaatagaagagtaacacagaaccaccacaggaagaaagaagcttttacagagagctgcttttttaacaaaaggcgtatgccctatttcatcagtctaaaccaccattactttaaaggtgttcttgtttccttgtttcatatactactaagagaaatgctagcaagccttcatcctgatatcagggatattrattaaaatgtgaaaaaaaaatttagaatcaataagtatggttgaagaaaaaaccacggaacaacttcatagttggattaaaaaaaaatcacaaggaatataatagtgggaagaaaatcttgtttccttgattttcatttcaatcctttggggctagctagccarctctggatttcaaattccaacttttcacacccgtcctcccgccccccacaaaaaaactttatcactgttgcctagaacaagctaacgtaaacatgtttattttgtcttttaattacttaaattgtgacctgattagagttttgtacttaaaacttgacatatctttgataataaattgaacttttaaaaaattcctattgcattaacatagttttcccagaagacccaaagtttcgttggaagattagaagagttttattttcatgcagcttaccaacacatgtgccttaactttctgaagtggcttttcttcacagtctgaacgtatcagagtctagggaatggtatgatagctttattcatcagttcatcaaacatttactgactgctatgttaggcattttgtttggcctgatactctattaaagcctcagaaaattgcttgaaatataaaacactagcataccccccagttttgggtaaacttaaagtaaatattaacataataaagtagatatgcacaatggtgatttgatagcttcagggatttactccagtttcatttttaaagtgtgtgtgtgtgtgtgtgtgtgtgtgtattyttttttttttttttttttttttttgagacagggtctagctctgttgtccaggctggagtgcagtggcatgatctcaggtcactgcaacctccaccacactggctcaggccattctcccacctcagcctcccgagtagctgggactacaggtgcatgccgccatacccagctaatttttggcatttttttgtagagagggaattttgccatgttgccgagggtggtgtccaactcctcagcagaaacgatccacccgcctcagcctcccaaagtgctgggattacaggtgtgagccaccatactcagccaaaaatgtatatatttctaataaggttttatgaattagcagtgatagaaatatttccatctgtaacaaaagactgctgtaggaaaatcaccctgacctactgaaaatgattcttataaaaaagattccccccctcaattaattgcagtataatccctctacttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtsacactgaacattcagaaattatttttatggaattccatgctttcatagactcttttctgttgttgtggtatttgataaaattccctaaaagcattttttagagggccagctattaaaatctttaacagggaaaaggttgcttttcatagttasagtttatatgtgcatggtttgtgcatacagacatttgtctctttttcttccgtgtcctctcctctcccgcagtgaagttattcgargtcattgaaactgaaaaaacactctacctaatcatggaatatgcaagtggaggtaagaacatttttatatatattgggttttttttctttctcccttttaaaaaaatacacaaccatactgcccatatgggtcatcattaaggtctcatttaacgtccagagccataatacgctaggatgagagtcggaaaagctgactcttagcacttctaggggttgccatgaagtgtttcactattagcattgttaattggtaatatctaaatacctggatattttttgtggtaaaacatgcatcactgaaaattatcgttaaaatcatttttaggcgcacagttcagtgacattagcatgttcacgttgccctcaccaccacccatgtccagaatgttttcattttctaacacgaaactctatacccattaaacactaactctccatttctccttctcccagtccttggcaaccattctcctttctgtctctatgaatttgactactcttggaacctcatacaagtggaattttacaggatttgtcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgycttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatcsaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccrggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgyttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttrtattgaaytcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagstgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaaytagccgggtgtggtgacgcacgcctgtaatcccagctactcaggaggctgaggcacgagarttgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaagatgtttcctsaaaacacttatatctaattttctaaattagtattcttttctattgatttcagaggtggtgattctttattctacattgataagcagttgacagtgctaatartatattccttgaagtgtcacctttcttcsctaaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggaycttgtgttcactgctgcatctccccagaacctacctagaacagtgccttgcagttagtagacattcaggaaatatttgttgaatgaatgartatactcaggaaatgctttgttgtcataatcctgcagtgaggatgtcctcttctaacacaaataacttcatccattttaattttctgttttaattgcttagtttttattaaagcctattgaaaackctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcratttatrggaaaattaatactcagaagtaggatttctacttacttttatttctctcacctrtaggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtrggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactrtttmactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaaraaagmagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgcttagtctgatgtttacatttgtaagtgataggacttattaagtttcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacmtttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgacccyttcttccatggtatttgcctaaaacagctccattagacttggaaggatacgcatsatattggtgtttccacttttctgtttcaaatgctgkggkttctttgktttttygkttttgagatggagtctccctctgtcaccaaggctggagtgcagkggcccgatctcagctcactgsaacctccgcctcccaggttcaagcaattctcctgcctcagcctcccaagtagctgggattacaagtgtgcaccaccacgcccagctaattttttatttttttttttgtrattttagtagagacaaggtttcaccagtgttggccaggctggtctcagactcctgatctcaagtgatctgccctcctcagcctcccaaaatgctgggattacagatgtgagccatcgtaatgtggcctcaatttctgtgctttctaggagcttataagtcataattactttgactaagtaaaacaagtttttctatttatgacaaaaaggaaggtatgccacacacaaagtacactgtgtgtgatcccttttccatattcatcaccagatgggttttccccttctgcttccttcaccatgcccatcctagttactgcttatgacattttaattttttggttgagctcattcttttccaagaaaaagaatagatttccagctccatctttttttttttttttttttttttttttttttgagacaaatctcrctttgtcgcccaggctggagtgcagtggcgcgatctcggctcactgcaagctccgccccctgggttmacgccattcttctgcctcagcctcccaagtagctgggaatacagatgcctgccactacgcccggctaattttttgtatatttagtagagacaggatttcactgtgttagycaggatggtctcgatctcctgacytcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaaagagagagagaaatcctttgatctctttgagaaagggcaggaaatcaaatctgcttcaaaagcagaatttgaaaataacctgtaagagaaatctcaatatgaggaaaaactaatataaattctgaatgagaaaaggaaaaagattagataaaatttacctgtgtcctaggtgacaaagctatgactttgttttgggaaaacaaagctattttacttttcaagttttcatgctgactgaatagaacaatagtgataaatccaaagtaacagatgctctaaaacccgttttttggcattggaatttttgtaccttttgttaattataagtgggtctgatattctgaatgttaattttaaataatgaagctgcttagtaaagtgctgatttttgttatcatctcatcctaaccccagttcaccttgtccttgctgcttattctgaaccaaaatattatacagccctctgagattttatgtccacgggtgggtccatggggcttagagctaagagttgatgatgatttggaggaaccaacagtaattttattataacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaargtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtggctcacrcctgtaatcctagcactttgggaggctgagactggcggatcacctgaggtcaggagttcgagaccagcctggccaacgtggtgaaaccccatctctactaaaaatacgaaattggccgggcatggtggtgcacacttgkaatcccagctactcgggagactgaggcaggagaactgcttgaacctgggacggggaggttgcagtgagccaagatcatgccattgcactctagcctgggtgacagaacgagactctgttaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcawtatgtgtgaacattaacaaagttattttcatcttaattacgaatctgcaccagtgatgactgactctgcrtctctcctattcagattgtgtctgcagttcaatactgccatcagaaacggatcgtacatcgagacctcaaggtgagtagaagtgcctcactyagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacrgtgactggtggttgatctctggagaacagtcatyacacagccaaacaaatgkgggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatataccttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtrccttactctcctstgctacccactcagtcaccaggtccttttgctgctgtgttccaagtatctcttaagctcactcttttatgtccctgttacactatccaaggccagaccaccattatctcataggtgattccgacactactttcttatatgttyttctctgtttctagtgcctcttcctcccatgtatgttttctacactgcaccsaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctcttttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtgagccaccgcacccagccatgatttgactcttgaatgaggtttaggattctcccctcctcattaacagccgttttatagctatttagccgtttttatgaaatgcccctttttaaaaaaagttatttatgttttgagacagggttttactctgtcacccaggctggagtgcagtggcacagtcatagctcactgcagcctcaaactcccaggcttaagaggtcctcctacctcagccttccaagtagctgggattgcagatgtgtgccaccatacccagctaatttttaaaaatcttttgtagagaaagggtctcactatgttgcccaagctggtcttgaactcctgggctcaagtgagccactgtacctggccctgccccatattattcttgttttttggttttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatyaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgrtgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtyatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacrtggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaraaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaatrccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcragactctgtctcaaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgtttyttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcawtgctttctttctttcttcttytttttttttttttttttttttttttgagacagagtctcactctgttgcccaggctggagtggagtggcacrattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactrttctctcaccacagcsttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccayacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctcvgctcactgcaacctcagcctccgaagtagctgggactataggcacacaccaccacacctggccaatattgtatytttagtagagacgggatttcaccatgttggccaggctggtctagaactcctgacctcaggtgatccacccaccttggcctcccaaagtgctggattacacgtgtgagtctgtaattggcctggctgatttttacccttttaaaattttcctggccggacatggtggctcatgcctgtaattccagcaccttgggaggccgaggcgtgtggatcactaggtcaggagttcgagactagcctgaccaacgtggtgaaaccccatctctactaaaaataaaaaaattacctgggcatggtggtgtgtgcctgtaattccagctactcaggaggctgaggtrggagaatcgcttgaacctgggaggcagaggttgcagtgagccaagatcgtgtgactgcactccagcctagtgacagagtgasagtccatctmaaaaaaaaaaaaaaaaatttgtacttaagtgtaatatatagccagttgtggccagtaactctcataatagacaggacagccctggagaatatatggaacctcagttttgccttaattggtttaaatgttgtactgtgtcattctcatccatactcttgctgttagtgtggttaagccactctcccttttaaacttcacctagaagccagtcctttatgagacataagactcccagtgggtaggcttaccaggctctacagttgctctgccttcaaggcagcctgtgtgtcagagtcctgaggctagcgtgtgtgtttacttgcccataactataaatgttaacattgcagatatttcctttaattctactattccaggattcaggaactaaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcrctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggayttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttacatagtaaatgagaaacacctggggcagagctcaggcctgctggtccaagccctgtgttttttctccactgaagcacctcattggagtagctttttcataatcctcatctttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttctttagcttgttttttaaaaaatgaaaaaaaaaatcactgtttactaatcaatgagtggtattggggcaatttggtagttctcagaaaaaaaattaatttggatcaatttctcacatcttatacaaggatgaattctaattggagttaagatacaaatatagggctgggcgcagtggctcatgcctgtaatcccagcactttgggagtccgaggcaggtggatcacgaggtcaggagatcgagaccatcctggctaacatggtgaaaccctgtctctactaaaaaatagaaaaaattagccaggcgtggtggtgggcacctatagtcccagctactcaggaggctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtcaccccaaacaccaaacccatgaaataaaagacttacaaatttgattacataaaaatgaaatttctggccggtcgcataatcccagcactttgggaggccgaggtgggcggatcacgaggtcaggagatcgagaacatcctggctaacacggtgaaaccctgtgtctactaaaaatacaaaaacaaaatcagctgagcttggtgtcaagtgcctgtagtcctagctgctcaggaggctgaggcaggagaatggcgtgaaccygggaggtggagcttgcagtgagccaagatcatgccactgcactccagcctgggccaacagagcgaggctccatctcaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtrgaggttgcagtgagccaagattgagccactgcactccacagcctggccacagagcgagactccgtctcgaaaaaaaaaaaaaggaacaaactatgatgtgcacaactcagatggatctcaagggaattatactgcrtgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcargtaaaactggggaaatctgaacgaggtcagtggattagatcaaggtctgtttctcttcagaatctcaaatcttaaaaggttttgtattttctraacacaaataaaagctggaaagccaatcagtagtaatctgaaagttcacaatgtcagtwgacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttttaattcagttccaaataggtttgccatttagatttttgtccaagaactaactcctccccactcccggtttttgtttgtttgttttttaaatttatttattgagacaggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaaaaaatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggrcattagtctgtcatccacatgtccctaggcacatgtccctggacacactcctcctggagtggcaggaatgactagtgacctccaccgacttcctccctgtcgcttgcatgattcctctgcttctacaccttcccctgtctactcaactacaccttcccctgtctactcaaactccggtttatctagaagattatgagtgcttttaaaaagatccaagataaaacttcaaaagaagtgrcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagacmagcactgcagatrgtgacctcaaagaagatggaatttcctcccggaaatcaastggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaagactcatctccaaatactgttttctcctatgggagataaagcttaaacatgagttttggaggggacacattcagagcatagcacacccaccatagacactagatggtgataggtcctttatttcaaggcctggttccagttatttcggacacctgctgagccttaggttgtcaggtgctgagacatggaaagacctcacagtctaacaggaagtgaatgaaaacagtgacagtgcagayggaagcctacgtgcacacacggggaggtctgactgccagtgccccaaagatgtggtgttcacactgagtcttcaaagagctctartgatgaagagtgttggctgagttcttaccatgtgccaaggaccatgctcagtgctttttcatggattagctacattttaaggtgaaaaaaaarttgggtaattgcctaaaattacactgccaacctgaatccagctcttaatccctatctgtaacaaaatctccccagtaagtagataatatttactaaattarattgaatccattcagcttcagaaacttttttctgtgtattgaagtatgttctatctaacctaacatattaaagaatttgcagagaagtaaacaatcttaagattattctgtaagcacgtttttccctrcaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccgggtatagtggcgtgctcctgtaatcctagctattcgggaggctgaggcaggagaattgctttaaccgagaagatggaggttgcagtgagctgagattgtgtcattgcactccagcctgggtaacagagcgagactccatctcaaaaaataaaaaaaaaagtccatagctgtgacttgttccttgctttttagttttttgttttggaagttaaattcatgtgaatccacatgacaatgattaaccattttaaagtgggcaatgcggtggcatttggtacactcacagtattgtgcagccaacacctgtctttagtttcagaactttttcagctccccagaaggagcatctgtttaggctgggcacagtggctaacccctataatctcagcgctttgggaggctgaggtgggaggatcacttgagcccaagagtctgagatcagcctgggcaycagagtgagacctcatctctacaaaaaaaattaaaaagaaaatagctgagcgtgatgatgcacacctgtagtaccagctacttgagagcttgagaggctcaggtgggaagatcatttcagcccaagaggttgaggctgcagtgagtcatggtcacatcaccatattccagcctgggcaacagagcaagaccctgtccttaaaaaaaaaaaaaaaagtggccgggcgcagtggctcacgcctgtaatcccagcactttgggaggctgaagtgggcagatcacaaggtcaggcgttcaagaccagcctggccatcatggtgaaaccccatctctactaaaaatacaaaaattagccaggcatggtggcgggcacctgtaatcccagctactcgggaggctaaggcaggagaatcgattgaacccaggacgcagaagttgcagtgagccgagatggtgccactgcactccagcctgggcgaaaaagcgaggctccatctcaaaaaaaaaaaaaaaaagaacacctgtatcccttaagtaatcactttccattcctcctctcccctctgcccccctcccttccccctcattccctggcaaccaccagtctgtgttctgtctctggatttgcctgttctgaatattttatataaatggaaccatttcacatgtatccttttgtgtctacttctttctttgactcagcataatgttttcatggttcatccaakttgtagcatgtattttcttttccctttttttttttttgagatggcatttcrctcctgttgcccagagtgcaatggcacgatcttggctcactgcaaactccacctcccgggttcaagcgattctcctgcctcagcctcctgagtagctgggattacaggcgtgcgccaccatgcctggataattttgtatttttagtagagacggggtttctccatgttggtcagtctggtctcgaactcccgacctcaggtgatccacccgcctcggcctcccaaagcgctgggattacaggcgtgagccactgtgcccagcctgcagcatgtattagtactttgtttcttttgggggtaatattccattctgtatatatactacaatttaactgttcatctgttgatggacatttatattatttccatgtattggttaaaatgaataatgctactataaacaattgtgtacaaatttctatgtggacttaaatgttttaatttctttccttctttcttggggaggagacggtctcactctgtcacctaggctaaagtacartggtgcaaacacggctcattgcaacttcgacctcccagacccaagtgatcctcccacctcagcctcccaaatagctgataccacaggcatgcatcaccatgcctggcttattttttctgtttgtttgttgtggtagagatgaggtctccctatgtagcccagccaggctggtctcaaactcctaggctcaagcagacatcctgcctcagcctcccaaagtgctgggattataggtgttagcctctgcacctggctgtgttttcatttttcctgggtatatatttaggaataaaattgttgagtaatatggtaactccatgtttaattttttgagaaactgccaaactgttttcctcacaactgtaccattttatccagcaatagtgagagtccctgttttcttcacattctttctaacaattaataattattttattatttaaagctttcctagcaggtatgaagtagtacctcatgcttttgatttgcatttctttaatgaccaatgatattgggcatcttttcatgtgtttcttggccataygtatagctttttttttttttttttttttgaractgagttttgctcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatayctattgaaggtgccgattttaaaattaggttgwcaggccgggcacctcaggaggctgaggcaggagaatcgcttgaacccaggagggggaggttgcagtgagccgagatcgcaccgctgcattccagcatggcgacagagcaacactscatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactgrcattcctatttatgtagataagttcattttttctcattgtactgtatttaccaaataaatttaagacaaaaatgcccttttttatagagtaacacagcatctggtggaatgacacgacgaaatacttatgtttgcagtgagagaactacagmtgatagacactcagtgattcagaatggcaaagaaaacaggtaggagattctacctgtttgtaagaaaagttgtttttcccaagagaaatggaagcatgttatttactgctttgttcttataatcattttcaaattaaaactgtaagtattctctgaaggtaagttaaatttgtatactaatttttagcaagatactagaattctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaartagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggwwwgagttgayatgaggagtaacatttgktctgtaagattatggttattattcgttgaatttttagcaatatttacattctcttgttctcttttatgactcgtgtgtgtgtgtgtgtgtttcaacattgtcttttcttatgattaaaaactactaagaacttgagtatagcagctggggtagatagtttacagataatgattgatataggtatttytttttttttttttttttttttttttttgagacagagtctcactctgtcacccaggctggagtgcagtggcctgatctcggctcactgcaagctccgcctcccgggttcacgccattctcctgcctcagcctcccgagtagctgggactacaggcgccygccaccactcccaggtaattttttgtatttttagtagagacggggtttcaccatgttagccaggatggtctcgatctcctgaccttgtgatccacccacctcggcctcccaaagtgctgggattacaggcgtgagccaccgtacccagccaggtatttcttaatagtagtctactctctggtagatttgtattatagttcagttcttaactttcaaatttcttctagttcaaaagtgacttaatagaaaatatcaatagaagacttaattagaagtttskggtgttacagattgtagtctacaggactacagaaatgtttcatggtcaggcacagtggctcacacctgtaatcccagcactctgggaggccaargcaggtggatcacttgaggtcaggagttcgwgaccagcctggccaacatggtgaaaccccgtctctactaaaaatacgaaaattaaccatgtgtggtggcacgcgcctgtagtcccagctaccagggagactgaggcaggagaattacttgaacccaggaggcagagtttgcagtgagctgagatcgcgccactgcagtccagcctggacaacagagcaagactcatctaaaaaaaaaaaaagttgtttcattacctttactacttctaaattctgaaaatgcactacccagctccttctgaactttaggatatgtgactgtctgaggtgcagagtcagtctcctcaagggtgttaagactaagatctgctctctgcttccatcctgtgctacacgtatcatacaccaggcacatgcatatatgcctgtgtcttctgattctcttttcctaaaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaaytattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctakgttaacttctgaaacaaacatgttaagttccaattttagccttaaatattttcgacatttagccttaaatgttttcttctttatatgagtgttcatacggaatttcaacatgagaataatgatggctgattttttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttcygagactagttttaaactggtcgtgctgaaggccagcccactttctgctgtaattattctgccttctgatgttattctcgaaaaatggccagattccaggcgtgamtaatggttggtgtaaaytaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctrcatagcagagacactctgctcctacgatttcatatgctttagatacccggacgacactgtttagactacttcatttaaagaccccagagaagtgacgtgctggtgttacagtaatgcaaacagaatcttttcttyttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgagcagagaaggattgaggacacttagcgtatgtatctttggactacatataaaagttgctttttttaggctgggcgcggtggctcccacctgtaatcccagcattttaggaggctgaggcaggtggatcatgaggtcaggagatcaagaccatcctgaccaacatggtgaaaccctgtctaaaawttagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaaaaattagccaggcatggtggcgcatgcctataatcccagctacttgggaggccgaggcaggagaatcgcttgaacccaggaggcagaggttgcggtgagccaagattgcaccattgcactccagcctgggcaacaagagcaaaacyccatctcaaagaaaaaaaaaaaaggctgcttttttttttttttttttttttttaagatggatggagtcttgcagtgtggcccaggctgcagtacagtggctagtcacagacatgatcatagtgtactgtagccttgaactcctgggctcaaatgatcctcctgtgttggcttcttgagtagctgggactacaggcatggaccaccacacctsgctaattttttattttttgtagagatgaagtcttcccatgttacccaggctggtctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcstgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtmaaattccatctctaccaaaaatacaaaaaaattagctgggtgccaggcacagtgcctcacacctataatcccagcactttgggaggccgaggcaagtgsatcacctggggtcgggagttcaagaccagcctggccaacatggtgaaaccccatctctactaaaaatayaaaaattagctaggtgtggtggtacatgccggtastcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttwtgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgytgcttgctttgtgaaactcatgatgtgacatggattaaatttctaaaaagtttatttaattgcctttaaaattagtatgtcaaaaagtttatttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagwgatgggtttttgccatgttggccaggctggtctggaactcctggcctcaagcaatccaccckcctcagcctcccaaagtgctgggattacaggcgtgggccaccacgcccagcctcaagttaataatttataatcccagcactttgggaggccaagacgggcggattgcctaagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttamcatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctaygaaaaatacaaaaaattagccgggcgtggtggtgggtgcctgtagtcccagctacttgggagactgaggcaggagaatggcgtgaacccaggaggcrgagcttgcagtgagcagagatcacactgcactccagcctgggcgacagagtgagactccgtctcaaaaaaaaaaaaataaataacayttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctccttgatctgtgtggggcctagagttrcttccaccacagcaaaatctcattattgttgctgcaggaaaagaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctrtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgcyttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatrgagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacargatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtcyggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctrctaaaaatacaaaattagccaggcrtggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttaytaattcatttaaaatacatcagtgcgggccgggtgtggtggctcacacttataatcccarcactttggaaggccaaggcgggaggatcacttgaagccacaaatttaagaccagcctggrtaatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaagcaactataggttagcagttgctccagartctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagagkcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagctcagagtcttcataacactaaaagttaactagcatttaggaggtttttgttactgttctttaattattgttccttttgctcacgtatctgtctgcatggcatgttcgttgttgttgagcaggcagacctcgagttctggtgtggggtggggggctggcactctgtaacaatcagcaggaaagaccatgcatgtctttcataatcatctccagccccagaggaaagagacagcttctcttttctcactttattgttgttaaggagcagtaaatttcttaagagtccaaatcttgaaagtttctctctcagtcttagtaatttatattgagagcaaggtaatgtccttaaatggtatagttttggagataaaatctctggtttattatcaaaaaataatgttactattattaagttatttttattaaatgctgcatgattcttggctgatggtcctggaaattttttaaaatgttccatgtgtctagtaggctagcatctggggcctcagtaaactctcaagggtcctttgagattaacttcatttccgtaaccttgttacctgttacaaaagcccagaaatactggctgcttcaagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaacttcggtgagtcacattaaagtctgatctacttattattaggacatggaatagattagggagtattcctttttttttttttttttaatttttttttttttttttgagacggagtctcactgtcgccaaggctggagtgcagtggtgcaatcttggctaacttcaacctccgcctagattagggaggatctctgacatccattagcattaactagaagtcagacgcrtcagaaggtttctatttaccctcttactcacttcttagcccctttattaagccacctcattttaaactgggcaaaacagaatcagccaaagagctttgccaggtttgggacaccmattcatgaccagccagcaagagagacagtgagttcaatctgagaagagtctggtractcccagaataaaccattccttcctggccagccgtggtggttcatgcttgtaatcccagcactttgggaggccaaggcgggtggatctcctgaagtcaggagtttgagaccagcctgaccaatatggtgaaaccccatctctactaaaaatacaaaaattagccaggcatggtggtgggcgcctggagtcccagctacccaggaggctgagacaggagaattgcttgaacccggaaggcagaggttgcagtgagccgagatcgtaccactgcactctagtctgggtgacaaagtgagactgtgtctcaaaaaaaaaaaaaaaaaaactttgagtttatttttcttctttgtactcttttttcagtcattttaagactagtattgggctgggccggatggctcatgcctgtaatctcagcactttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcaygcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaagactagcattgattttattacatgtatataatggaaaaaaggaaacaagattatcattgataaaaatatcagctacctctttttttttccccacagagtctcactttatcgcccaggctggagtgcagtggcatgatctcagcccayggcaatcttcgccttccaggttcaagtgattcctgtgcttcagcctcccgagtggctgggactacaggcgcccaccatcgcgcctggctaatttttgtatttttagtagagacccggttttatcatgttggccaggctggtcttgaactgctgacctcaagtgatccaccgcgcccagccaaagctaccattatttgaatgcttattatgtgctaaggtagatgtctatatacatagatacagtcatattcattttatacatataaatatgtatgtacattatatatatgcatattttatgtataaaatgagtatcatatatatacacttatatgtgtgaaatgagtatatttatacacatgtacaagtgtgcacacacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaacccaggaggcgtaggttgcagagagccaagatcacaccattgcactccagcctgggcgacagattgacactccatctcaaaaaaaaaaaaaagtatcaggctgagccaggtctatctgaccagactctgcccttttagccactacactgtgctccctttagaaaaaacagttgcaggcgtgacagttgcattacatttatttcatatatttgaattaaaattggagactcaggcttgttgtttaaaaaaattctaagtggtcatcttgtttacaatttccaggctatttccacacccccagatttttgcagaaagatagtcttttatcctgtcttgttaaagtttattaactgaggtctgttgtctcccttagtgctatacttaatcagctactgacagtttgttcttaaaaacaatcaaaatccttgctagagtggttgaaagttcttatcctcctttagcaataattggtaggattaaaattgcattgcctgaaaggctgaggtgtttgcacttagatgctgcaagggagacctggtgtggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattatrggaggaaaagttaagaaaarcacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagtagctgggactacaggtgcatgtcaccacgcccagctaatttttgtatttttagtagagacagggtttcaccatgttggccaggctggtcacaaactcctgacctcaagtgatccgcccacctcagcctcccaaagtgctgggattacaggcatgagccaccacacccagccttttatttttttaataaaaagaaaaaaagttgggaaatgggccaggcactgtacatggctcatgccagtaatcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacraaaatatatcttaaagacttttaatcattttcaactaaaatattttggataatactgccttatatttaggyagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttaytacataaaagtaaaattcatactgttgtcttgacacttagtttttattcattttgagatctaagactgaaaagtctrcttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagacyagactggccaacatggcaaaaccctatctctactgaaaatatagaaattaactgggcatggtggcgcrcgcctgtgattccagctactcaggagactgaggcacaagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatcaaaaggtaggatttatatatacacatttatttttcaatcctcactcccaaatggctcctgcaattaacattaggtttggctttctggccctgttttttccttataaactaaactttctgctgataactaaatacttaattccttgaaaggaaattgaaaagaaatagattaactctgtcaggcattttaaagggactatggtacccatgcaacaaaaggctgatgcatgctctgtgtattttctttctttggtagaattatttagcatccaaataattctgtcttcatactaataacacttagcatgctcctgtttgaagaatgagatgctcagtaatgttaatgtacaattaatgattatccacaggcatgcaaaaggtaagtattagttgtgttatttttatttcactgaggatggaattagcaaaaggctttaaaatgacaggaaaattagctaatacagaaaacaagcataaaattcaaagctacagcctcatttgatttggctttttcagaaattaaaatgtgaacagctgcgtagcagaaatgttttaatattttcagagttgaaagccactttccagcaaccactgaagaaagagtatctcattatttttacttaaagcactacagaaagtggtgttctgattttattaatattttttagrccaggcatggtggcttatgcctgtaatcccagcactttgggcggatcacttgagcccaggagttcaagaccatcctggacaacatggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagcagtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcragttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgrggggaggcaatcaccaggtagccttaggactctatgtcccttgytctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctgrccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatsccacagacacatcctgtactttcctacctcccctttggctgtgatcccctctactcaaaacaaacactcttccctatcttcattgcattttgttgaaatcccatggctsttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttktaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctgscaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaaktaaagtgttttcctgaacactgatggaaatgtatagaataatatttaggcaataacgtctgcatcttctaaatcatgaaattaaagtctgaggacragagcacgcctgggagcgaaagctggccttttttctacgaatgcactacattaaagatgtgcaacctatgcgccccctgccctacttccgttaccctgagagtcggygtgtggccccatctccatgtgcctcccgtctgggtgggtgtgagagtggacggtatgtgtgtgaagtggtgtatatggaagcatctccctacactggcagccagtcattrctagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaagtatgtaaatttcctttctcctttcttgtgattcagtacatgaatcagacctgcagcttttktccaacacctacatggttgtgtaggggtaatgagctcataactcattgtgttgctttattctcacagggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggagcttgcggtgagccgagatcgcgccactgcactccagcctgggcgctagagcaagactccgtctcaaaaaaataataataataaaataaataaataataaaaacatcagccaagtgtggtggcacacctgtggtcccagctcttcgggatgctgaggtgggaggcttgagcccaggaggttgaagctgcagtgaactgtgatkgtgcacagcactccagcttgggcaacagaatgagaccctgtctcaaaaaaaaaagaaagaaaaaggaaaaagtctggacagtcaatcagaaatattgttgtctctctctagcgtgggcaaggcactgttgtgattgagatcctcagcaaaacagacacctctctccttgagyctgacattctaggcagtggataaacaagtaagttacctagtatggagcacagcagcacgtgtgagagagcgcagagcaggcacgggtttcatcagcactctgggtgtgaagagtgctgcttgggcagaggcctgggtgggcacgttcacacagatttctggggaagagcactgcttgggcctgaggcctgagtgcatggcgtgcctggagcagagygtagagatgcttctcctacatggcagcagctgaggggatgacaagggccttgtggccttgggctttcagaggatcaccaggcagctatgtttggaactcactgaaatggggcaaggagaagctgggaaagccgcctggaggctctcagcagtaatacaggcaagaggtagtgcagccttgggtgaggatgggccttggcgctgatggtggttgggttttggacatgttttgaaataagaggcaactgcattttccctggagttggatatgaggtgagtagagccaaggacagcttcatgatttttgatctgaacagcaaaaaggccggaattgctgtttgttgagatgcggaatgtggctggggagatgtttgggaacaggaggggaagaagatgaagagagcaagctggaatgtgctgagtttgaagtccctttaaacactgagtggcaacgtctagtgggcagttggataaacatgtgaggggttcggccaggcgcagtggctcactcctgtaatcccagcacgttgggaggccgaggtgggtggatcacgaggtgaggagatcgagaccatcctggctaacacggtgaaaccccgtctctactaaaaatacagaaaattagccaggcgtcgtggcaggcgcctgtagtcccagctactcgggaggctgaggcaggagaatggcrtgaagccgggagacggagcttgcagtgagccgagatcgcgccacagcactccagcctgggcaacagagcgagactctgtattaaaaaaaaaaaagtgtgagggytgggagaggtcgggtctgggagagaccataggaagccctcagcaggtggaaggctcctgctcaaagctgtgagacagaggagaaaccaggactgagccctggacacagcacggggagaggcccyggggagaagaagtgaagctggcaaggcagcagcaaggagggagggccctccaggtgtcaggcaggtggacatcatgacctaaggctcaccttgcgggaactttctaacttgacttttagcaagtaagtccccttccctctctctgtccagtgcctttcagagtggagtcctctaacggagctgattgtgcccagtcacagacagtgaggacttccccagctttttttgcctggkgcaagctggtttttatatcccattaaagcatcataaagccaacccggacaagagaattgggatgtctctctgcacacatgagcctttttgtttgtttgtttgtttccccggagacggagtcttgctctgttgcccaggctggagtgcagtggcgtgatctcggctcactgcaagctccacctcctgggttcttgccattctcctgcctcagcctcctgagtagctgggactacaggcacccgccaccatgcctggctaatttttttgtatttttagtagagacggggtttcaccatgttagccaggatggtctcgakctcctgacctcgtgatccacccgccttggcctcccaaagtgctgggattacaggcgtgagccactgcgcccggcacacatgagcctctttaaggagatctacacacagacttctctccccctttgctgtccttgtctgtcactgtcccttctgctgagcagaaaaccaaggagatgttctgccataaattacttcctcctctgggtagatgtttctgagctgttctatgaaattcatgactacgaaactgacttccttaagattcctaccccaaggccaggcgcaggggctcatgtctgtaatcccaacaatttgggaggccgaggcgggtggatcacctgagttcaggagttcgagaccagcctggccaacatggtgaaaccccgtctctacaaaaatataaaaaaaaaattagccaggcatgtggcgcacacctgtaatcccagctactcgggaggcggagacaggagaatcgcttgaacccaggaggcgaaggttgcagtgaaccgagatcttgccattatgctcaaacctgggcaacagagcaagacttcatctcaaaaaaaaaaaaaaaaaaaagattcctaccccagaaacacccatcacagcaggttcctgtgcataatttctgcagaggtggagcagagccctgccaagcagaggctgggccacagcggacttcctcttccttatctttgtagctgggactgattttgaattgttttccatttttgcattctcaaggacacattgagtactagaagttaaattcctttaagaaaaatgagtttctggaatgccctgatgcagtggccactctttatgctcgtattttcttgaggggctcacttgtcataagcagtggctgcgttttaatgtgttacttggtcaaataaggagtgcgtgtctcagagactagtattcatccacagaaagttacccaagtgcgttatgtttataagactatgttactaattgatcttggcttgattttcatggcaacatgggtagtattccctttacsaaggttaaaatgtgaaaactcattcattactaaggttccaggccctttctatagattctccattctcagaatgtgacatttttattctgcatacaatgaattttgaaaagggatattctacgaccattgaaaatcaaaagagactgcatttttccctcatcaacyacctggaaatctctcagaagtgaggtgagacacctagtggggctgtgctgctggtttgatttacctgccaagcagagcattctcctaatcctgacaatggtgttcctcttcgttgagtgccgacttccctctcttctacatcaggcacattagaggaaccaaaaccatactcctacaagtaagtgaggtgcccagctctcaggccacctttgcatttctgaaagtgagggtccatgcagaaaactgttacagaaacatgactggcttttaggagcacagccgtgatcattttcacagcatatgcttctccaaaagcctagacaataatgatttctattttattttattttatttttttatttttttaagacagagtctcacgctgtggctcakgctggagtgcagtggcgcgatctcggctcactacaagctccgtctcccggcttcacaccattctcctgcctcagcctcccgagtagttgggactacaggcacctgccaccacgcctggctaattttttctattttttagtagagacggggtttygccgtgttagccaggatggtcttgatcacctgacctcgtgatcctcccgcctcgacctcccaaagtactggaattacaggcgtgagccactgtgcccatgatgatgcttagaataatgatatttagaagaaaaacctccatacatgggcctgtgaataaattatagtcactatggaagctgygtcaggcagcccctacccagtaagcgaccttcgtgctgaccttcaggtctgcagagcagttgccccttccatggrtgtggcaccaggcagagcaggggcagaagaggggtgtttcccacgcactgtcccttccagtccgtctcagaggggcatcaaaatgagaaagagcttgtgctcaagagttgaaaccttacgactctgttgcaggttttttgtttctttcattgctggtttgccacgcagctcaggggccctttagacgggagagattgttgctcttcaagggagtgaagtgaagatggtgccttagaggtgttctgacagtgcacggggagtcccggagtgactcctccatgagtggaaggaactcagtgtcattgccagtcgaggagaaaggaaacagttcaacagytatttttgtttgttttgtttgtcttgggtttgttttgtttcgttttgtttttgagacagggtttcgttctgtcacccagactgaagtacagtggcgcaatcacagctcagtgcagccttgacctcctgggctcaagtgatcctcccacctcaacctcctgagtagctgggaccacaggcttgtgcccagctaattttatttttcgtacagacagggtcttgttctgttgcctaggctggtttgaattcctgggctcaggcaatcctcctacctcagcctcccaaagtactgggactacaggcgtgagccacctcacccagccccaacaactatttttgaatggttccttgaaaagttccattaaaggccaggcacagtggctcacaccaataatcccagcattttgggaggctgaagtggatggatcacttgaggtcaggatttcaagaccagcctggccaacatggcaaaaccccatctctactaaaaatacaaaaattagctgggcgtggtggcatgcacctggagtcccagctacttgggaggctaagacacgagaatagcttgaacccaggaggcagaggttgcagtgagccaagattgcaccactgcactccagcctggatggcagagccagaccctgtctccgaaaaaaaaaaaaaaaatcacacactaaccctcttctcttcctccctctcctggcttagccagtgcagtcaagtccttgaatggcgtgctccctggccctcaggagaggacattgcctatcgagtggagacttgg

SEQ ID NO: 13313 - DNA, 26772 bp, Homo sapiens
catagaagctttagaagcagattctgctgctgggagaataagttacactgacctcaggacaaaagatgtacatgaactaaataaaggacgacaaatgcagaccacagcaataaagtctgtggaattagtatgtgagaaattacacaatggtctaaaatattagtcttgaagggatcttaatgatgatttaktcatttcacatgtgcaaactgttaagactgctggctgtttttcacatggccaccagcccatttctttttcctgagtgtctgcagtccacagagcttcttctggctctctatgctccatctgttctcggcccaggagttcccatgggacctcccaagggtgactcaggtctcatcttccgataagataaaagaaataagacagatattcggggtagagatgtaagagcatggtgaaagacagactgctcctgtttagatccatatataaaagctttrttttttgaatcccaaattccatcccttggtcatctgtactggttcattcaataaatatttctgaggctgggcatggtgactcaagcctgtaatcccagcactttgggaggtcaaggttggtggatctcttgagcccagatgtttgagaccagctttggcaatatggtgaaaccccatctctacgaaaaatacaaaaattagctgggcatggtgatgtgtgcatgtagtcccagctattctggaggctgaggtgggaggatcacctgagcctgggaggtggagactgcartgagccatgatcacaccactgcactccatcctgggtgaaagagtgagaccttgcctcagaaataataataataatgataataagtaaacatttctgagcacctacttggtgctcttccaggcacatgagctatatcaatagacaaaactcacaaaaataatmttgccttctggaggtcatattccaatggataaaacagaaaataataaacatgatgcataagtagaatgttagaagtgatgaatgccttagaaaaagattggagcaggttaaggagatggggattgggagaggagacattgcaattcaaaattgattggtcaggaactcaaacaaatacttggacacygatagcagcattattcaaaatagtcaatagctagaagcaacccagatgyccattaagggatgaatggataaacaaagtgtggtaggcacacacagtggaatattattcagtcattagaarcaataaagtacagacccatgctacaatatgaacaaaacttggaaagattatgctaagtgaaataaggcagtcacaaagggcacttattgtgtgactccatttataggaaatattcagaatagataaacccatagaatcagaaagcagattggtggtggctatgggtttgtggtggaagaggaagaatggggacttcatgttaatgggtatggggttatactyggggatggtgaaaatgttttgaaactagatagagttagtggttgtaccacattgtgaatgtaccaaatgtcactaaattgtgcacttcgaaatagttaattttatgttatgtaaatttcagcgcaatttttaaaaatcagaagcaaaaaaaagaacagaaaattgagtagttaggctaagtctcacagagaatgtacagtttgagtgctcacttggaggaggtaagttagctcttggaggaggtgggtaacaggaagaagctgtccaggcagaaggaacaatgtctgcctagtgccttcaaggaacagcaatgaggatacggggttggaggggaggggtcagagaggtgattggtggtgttccatcgtgtggtacctcccagcttctgtaaagacgttggcttttcctctgggtgaggtggaagactttggaggcccccttgatttgacctaggttctaacagaatctccagagtgtctgttttaggaatatacttaagagggtacaagtggaagcagggatagcaatttagaagcagttattaaaatccaagtgagagaccatggtggcttggacaaggatggtggcattgagaatggagagatgcaattgcaggtaggatgtcctttgaagatgaaaccataagttgtcctgatggattgcatgttcaatatgtgaggaagagaagagtcaataataaatggagtcttggtctgagmcaacattcagcatggagttgtcatcattacaattagaagacaatgggagatgctgaattttctttggggcaagggaggcaaggaggctggaggagatcagaagttctgttctggagacatgaagcttttgtgaattccacttgttccttgaatatatgatggtttcttctgtttttgtttgtttgtttttttaaattttagattctaaggtacatgtacttgtttgttacaaaggtatattgcattactggtggggactggtcttacccaaattgtgaatattgtacccagtaggtaatttttcattcatcaccccctaccctccctacttttggagtccccagtgtctattatttccatctttatgtccatgagtacccatggtttagctcccacatatgagtaagaacatgtggtatttggttttctgtttcttaactggttcacttaagataatggtctccagctccatccatgtagcaaaggacataatctcattctttttatggctgaatagtaatccgtggtgcataggtacaacattttctttatctagtcaaccgttgatggacacttgagttggttccatgactttcctattgtgaaccgtgctgcagtgaacatactagtagaggtggagaggtgtcttttttatacactaatttcttttccttagaaaagtagtgagatttctgggttgaatggtagttttacttttggttcattgagaaatcttcatactgttttccttagagattgaactaattgacattcccagcaacaatgtataagcattcccttttctccatatccatgccaacatstgctgttttttgagtttttgataatagccattcagacgggtcttctggtttttggaggggaggattgggtgaagcaagaaggagtttggagggaaggagtggaggcttgagtgggcctmgagtttggagtatgggcaagaaggatcccagagacaagcactttgcccacagctacacagctaatggagctggggggcccagcatattctccagaggcccaggctaggccgtctaggggcatgcttgttctgccccatccactgcaggtcctgaaaacattttcatcaataaaaaaaaataaaaaaacagaataaaaatgatacccagatgtcctctagtgaaatgaggggaaaaaaaamatccatccccrgcttattgtgagagtcactgaatgagagcctgactcactgaaattcatataagattaatgtaaccaagttccctgtcttttgacactggtttacagtaagagcaggccrcacatggccagctctggagtgtgttaggacatttacattttacatttcagtgtgatatctgctaagtcaaatgaagaagtcttgaaagataccttctaagttcggaagtatttgagtgtcacattccatatgccagcagttagttgttgccctcaaaacataaggttttgtttgttcttttgttttttgtttttttaatggttatgtaagtgaagtagattataaataggcacatacaggatttcaaaactgtaacaaaattaagaaaaagctggttcaatgagsttagattctatgagattaatctgaaaagggagagtagttatgagaagtcttaaaaaagtgggtgtttgccaragaaacaagcggacactggaagatttctgattaagttggcagaaatttatgggtgcttaaaatgccttgctttattcatgtattagaagcccttgcctttttgcagtttgtcttaagttgctataaactactctctgttatgttgaatggtgcctgaatagtgagaagccaaaataatttagttcttttcaaagaagaaattatagactagcttattttaataacccagtccaaattataaaaagaaaagctttaccascctaatctctggtatagagaatgttctctttttttagttgacattggggggaraaaaagcttgactttgaagttcagcaagtctggtttcaaccccagccacaactgggtgaactttgtcaaattacttaaacagtcttatccttgggtttttatttgtaactataaaatttgastgatgttaatgataagtaccacagagtattgtactttgaatgaaaggtcttaattgtcaaatgaacaactgaattattttataggaagagttcaactttaataaatactcctgcagaatttcatcattatgatgttaaaattgatggaagctttwttttttaaactgagaaactaatgcttacgtggcctagtttaagaatgaatgctccaacttaatacatgttttaaaaagatgttttgggayaccaaatgtaaaagaattccgagtttgtgttattttattgaacaaacctattcagcacttggggaatcgcaggcagcattgcagactcgctggctcctggctgtgatctcacacccaaactgcaataatatcctgataaaacggacttccacaagtaggtcaagaataataatgtgcagacctaattcctctaatttacggcgaacatctcatggtcaatctccccgcggtcaaaggactgtgtatctcttcctctcagagccactccacaggctgaaaggctgactaaacccctgacagataagagattcaagagtagtcccagcccccatggggagcaaagacgctggctcaaaaaacgtactgataactctcccttttgcagctactcctttctgaaccttccacaagcagtggcagttggattctgtgattagtctagtcttcagagccagccttcttgagttcaaattctgacttcaccccttaatgtgaagtgacatgggcaagttgcttaatctctctgtgcctcagtgtccttgtctgtaaaatgggcatcataataatagcgcctgccacaytgggtgagtgtgagaatgaaggaattaatacatgtaaatcacttagactgtgtctggcatagaggacattctaaagaaaagttagctattatcattatattattatatgggtctggaattagttcctgaatccttctgagatgtgatgacttataaacgtaggttgagtttactcatgatagggtcatcgcaactatgcatagctaaaatcaaattttgcttttcragtttgttttacctggagccctagagttcagggttatggtttyctttgtcactccccttgagggaagcttcttagtcacactctccttctctttctctgcactctatgcactctagaaaagctcctttttttttttcttcatccaggcagagaggcctactgggacttaaatccaaggagctgaaatctgttttgggatggggtggagtcacattctggaacctagacagagaatttctaagttccagaaagtgctgcttacttcgcatttcctctcccccacctttgcttttgaaactcctggcaccaatgctgccaaggctggcggagctttcctgagtggtgtctgccaaatgaggagtcaaggaatatctggaaaggcagcctccaggtccccgatgtcaagaccatttagaactgaaagtgtcccaatatcggggtacaggcaataagcattagttattaatcagcctgagaagttgattctaaaataggaggaaatgattcaattatttcctctcaagggattactcaatgttgtttttatgtttaaatatttatttgtcaacatcaagaattcttagtacatgatkcaccagcatttttgaacaagtcatagatttggccacaaatcaaatttcaggatgggaggagtgtctcccctttaaaatagaagagagtgagtagtctatgaggagggacytacaaagactggaaactattcttagctccgtcactgactccaagttcatcccctctgtctttcagtttgggtaagcatcaattacttatctaaaatttgtaataagaaaagtcttcataattcatgattgtgtttatctttatgttagtaaatttctatgttggktctattcttccccttatattttaagaaaagaagtaagaaagtaaatgattatttttctgaaagaaaaaattaatgtatttattattattcatagaccttcaactactcttagaaagcctttggtgactcctgggaacaagctgagtcaggaacaaaagtttgagggtttggggttgagaataggacaattacttggctaatgctttagtctagttctgattttgctactccttagttgctttgtgatgactacttgcacatgtgtctgtttgtgagttatttttgtgagcatgctgctaccagcctgtgtggatgtctgtrgtttcacatgatacattttattttctaaagtctactgaattttatggtttttttttcaaaaatagaaactcatattctttccttcttaatttagtttctttcaggacattctcatgagactggtgaaatataactgcgaagtagcatgataactgtgaaatarcrtgatcattgtgaaagctatatgacccaaaacttccataggaataagtgcaatgcttgcatatctgaaacctgctgttacatctctttgcacttaataaatatgtgttgactgattcrttctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtyrtatgccagtgactcatctggagtaatctcaacaacgagttaccaatacttgctcttgattgataaacagaatggggttttggatcttagcaattctcacaattctcatgtattccacagcagcaaagtttagtaagtattgccttctaagtataatktaaatttttataaattaaataatttcaagaacatttaccttgttttaagcagtttgcttccagttgttccagttgaattgtaaactgaaaaatatattgcttttgtacaatcatttttcattacaaatctatcagaagaaattctttgtaatgaatatatcatcagtttggctttgcatattcaaatgcagcagaatttaatgtggtgcctgcacatgggaagtgttgtggatgtttattgactsacacacagtttgtttagatagataargctgcttttccattggataactgtgggggatttagctccaaattaattcattaacatttcataagagatcttaacagttacttattctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgmagttgytgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgakgtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagkgggcctctagtaggtgaaaaggggcttctaaccttcaagttaagccacagaaggctgatgagattgtgtgcctaaaaattaattacttttgttcacaaattgttaaatgttttgattttgtggctgtatttggcacacacaaaatgtcaaatgaattaaatcaaaaagcaggatgtattagttaagggcctaggtctgagactagacaagtgtcaaattcatgctctgccactagttaactgtgcgatgccagcaagttacttctctgcccttcagtttccttctctgtraaatgcatataatgtaataatatatttcatctcaaagcattattgtgaaaataaactaaggtaatgtgtgaaaagtgctcatcatcatcactggtacagagtaaactctgartaaatagtaattatctttattacactgggattacagcattacagcagatgtagtgtatgaataaatggtgaagaagtcattgttagggctactatgggggctatgtttttagctcaagtgtaacaaaaaagtatttaaactctagattttaatgtttatttttaaataataaaataaccattatgtatattgatggtttttaagaagaaaagcaatattaagtaaaggctgaatttagattaagttatttcacaatgytaagtgactcttttaattgtctgacttattttaacagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaaggtaagaagaaatttggaaggaaatagatgaaaattacacaattaaaatagacacaagtggccgggcacagtggctcatgcctgtaatcctagcacttygggaggccaaggcaggcagatcacttgaggccaggagtttgagaccagcctggccaacatgaggaaaccccatctctactaaaaatataaaaatcagctggrtgtggtggcacacacctgtaatcccagcagcttgggaggctgaggtatgaaaatcacttgaacctagaaggcagaggttacagcgagcccagattgcaccactcactccagcctaggcaacaaacattctgtcaacagataaataaataaaagtgaagaattactgagaaggaaatggaatttcttatttcagaattgtcaggctcttcaaggatcaaggtacagggcgcacaagtcatttttggtcattgataatgtgatgactgaggacrcaggtgattacacctgtaaatttatacacaatgaaaatggagccaattatagtgtgacggcgaccaggtccttcacggtcaagggtragctactgacattaatgagatagaatactacgtgaaagaagtcgaagtgggaacagyggtgcccttctggttgggtttcttgcacttctccctcctccctttacttcctcctgctccatcttatcttatacattctgaactatgacgcaaagaggttttctgaacacactatcaagatttaagaaatttcmgggggaaattacattactaattcaaagccacatctgttctttattctttytttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaartytaatgagaggctttgtgatggtatactatggtgtacataaatgttgtcgagtggtttttaatctttgtttgcaatactttcaacatcatcaatggccttgagtaagtcacttcattctaaaaatgtgttttccaagttattttaaattttataaaagcttatttaagggaaagatttcacaatcatagcttatcaatctacaaaggattggggtctccttagcacaagtcgatctacagacgtagatgtaatagcccctttacgtatgacagttttttcagggcaaagcaatattggagacaaatttttggagtttttcaatactccaccgctgtaaaataagcatcaccagaccacattcctatcagtgcctctttctgtttaatatcaacccttacagtggtccttaatcacactgtcattaaataaatgagcatgaagggatggaggattgcagcagtgctccataagcactgcccgtctttcagccttagtggtcacaggagtcagaattccgtayggggaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcgtgtgtgtgtgtgtgtgtgtgtgtgtgtgtgtttgtcattatgggttattgtcagaagaacttgaaaaacattgctatgaaatagaatagaaacatgaaaatacaagctttatattgactagcattcaatgctctcctaatatttatatttctttttgtctttaagatgagcaaggcttttctctgtttccagtaatcggagcccctgcacaaaatgaaataaaggaagtggaaattggtaagaaaatttatcagaatgctgtaaatattgcctggaaaaatccttccatatgacccctgttctgaattcccttagcaggggtcaggcaattagcataaggaaccttgaggagtaagtgaggtgacatccctgaaagcacctgccccaagcatttgctaatattgggaacagggacacagcaattgcagtgtttacatttgtttattgtactttgtaattcatgatgctttcatgtatgcatctaatttcatcttcatctctatcccagagcttgggatggagacctgcagggtgttcattctgggcaatggtagccagatccrgtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccaygcagatgagaatatagtgggagctgagcttcaaacccagctgggtgaatgaaggtaatggaagcagggaggaggcaagagaggacatagaaagaggaaggtgctagagatgagggagggaggtcctggtggggtgcatactaagtgttcagtaaggttttttttttacattaaatgggataaaatgccagtcgcagaagttaattttattggtgaatgtccttactcccctctaggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaaggtatttttrtattgaagagaaccatcctcttccccttgcacatggtttgcacctgcaaagtaggcattaaaagtaacaggttgctttcttagtttcagcaatgggctggcttgtctagacatggttttaagaatagctgaygtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcrggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgwaaactgaacgtgttcttttgtgctcttttataacttgcattacatgttgtaagcatggtccgttctatacstttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacrgytctgcaggctgtatgggaagcatggcggcatctgcttctggggacacctcaggagctttactcatggcagaaggcaaagcaaaggcaggcacttcamacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatygttaractttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaaygatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcytgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccacycacactgcccttgtgtactcctgctttgctacgttatcattgatcaatgtccctggttacctatgtgtttgaattatcttcrtgttacaggtgtttaatgattttgctccttctagcttatttgtatttcacctgtttttctttaaatcaacatggttacactctgtttcagcaactgtataaattaaacacaaattattactactgctattgagttgtcatgatgaattcttttttatttctgaaattatagcatttcttgaatttaagagaacaaaaacttgaaaggcctatgtctccattttattaactattactaaatacatatttgatgctcataataataatacacatttattcattatttcctatgtacaaggactcatctrcttattttacatttaactttctcatttattttctcaatacttcaaagtaaaagacaaagaaagttgaataacttgcgaaatactacagttatggagcaaggattcaaacacagccagcattttcctagctatatgtgtatacagaaagtaatgttttgtcatcacatacctgaattacttatacttttataaaataattcacacttacgaagacttcctctgatgtcttggatcaacttctttcctctacttggaagcgtccagccaatggcatggttacttcccagcaatccccacaggaagtacacattcctctgtgcatccagctggggwttttagagagagagtgacctggaaaggaatcctgttgaaatgatttacttackgagttttcattatttaacctgatgacagtaagctctttgtcaattttcactttttccccccaattttgtgtcacatcaccttgataattcttgattccatactgctggtcattgagagaactgataaactattagaggttgtggaggaattcgtgaatatgggccagtgatttttctaccttaaaactgggagcccatgcatggagacttaagayggaaaagaaccgtatcagcaaatctcatttgagattcttctcacattcatcagtgcatatgcatgttgcatctacattttgtgaagcaaggagtactaggaaaaatttctgggttggttgagtaatgttcaccatgagagaagtatgggctatgagtaggacctagaacttagtaatttgacttttgaattctttatcaaagacgctttagccacttaggtgactcttgcttcttctcctacctcccacactgctaagcccttagaggcaacaagtgtctcagacccrttgatgccttctccttaatgccctgacagcaccttgtccgttcctttctcattattgcatgagttacaaccctctgcatcttgcaacccaagtaccacactccattcttctctgagtgcccatagtttctttccacagaaacaaactttctgctaccatcagattaatctcttgggaaaaccactcaagtctccagtgctcctgtgaccttcagaataaggcaatctgccttagttggggtttcaagtctggacagaacctggccctgaccaaactttctaatcatatcttccaccaattccccaaactgggttattccayttcctcagaaaacacacttcctctctgcacttaggcttatggtattctctctgcccaggtgggcatttccttttttgcatctccctgaatcctactcatctttcagaggcctcctcctcctccaggaaggctccctttcccagtcctgcatggagcaagctctccttctaaactcctctgccagcaaaaatcatgcttttgcctcccatcttagttaagttgacaagtgtctctctgcctcttttgcctttgagaatgccctataatgcttagcctgatgtgttgtagaggctcaataaatgtgactgtcctggtacttaaagcagccatgaaaattcccagtgggtatatcttatgtgaaattcttgtactcccaagggaagccaacatccatgtatcagtttattatatcttgtttcagtagtaataataatctttttctttcttttgaatagttgatcatcatagcatctactgcataattgcagtatgtagtgtatttttaatgctaatcaatgtcctggttatcatcctaaaaatgttctggattgaggccactctgctctggagagacatagctaaaccttacaagactaggaatggtaagtggcaaataccaagtttttctcccaaagaaaaagtcccataataactgttggttacctgtctattaayctttmagtagctaggctgctaagcccagattccattttgcttgctaatctgttatcagtgagttgtgtttttggattttcttaaaggccattttccatcctgctatgtaaatcctcayggtcctgagatccatctcaacagctcacttttcttccccgataggattgctattcctactgagttcccaataacagaatctgccccaagcccagaaaggtgtaaatttcataatgtatcggtaagacattatgaagttaaacacagtagcaaaattgttcctgttttccagatgtgagcaggttagaaaggtccatcggaatgcatgtgtgttctacctgaaaccctgatctgtaaagtctaacccaggcacacaagcatgtgcatgaaaggagtcagttctgcctgctagatgcaaacttcatgcttacatttggaggcagatacatgttgcatttttcaaacagttgactgaagtaggagctcattgtttgatctgtggaaaattcagatcccttaaaaaattctatgcccttgctactattagctttaaattttttcacttccccaggggagtatggggaaaccaaagatgaaaccaaagtctattcagcacagaaggcccccttagtcatagattattaatcaaaattgatgagatggacaggttcttgtccacttttttgttatttagtctgtgacagtaaaaaggagaaacactttgggatgaagactgttatttcctgatagtgttttgtggcagtggtttgmcgtcaacatctcttgagtctagaatattttggaggatgacatacattcaccaacagccataaaacttggagaggaatgtcttcaaagagtccagtgagaatttttagaatcaagtaagaagttgtacttcttgttttcattttcagatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaaggtaaagctattgacatacattagggacagaaattcatgcttattaaaggctgtgaactaggtggccttatccctgcattggataatgaattgcatttactaccacaggccttaagaccagaactttaaatatttatccagaagcagacacttatccttcaatcgyccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgarttttgttctggtagccataggcactagctgaaataccttaaaagtactcagagagtcttcatgactttctttatgttggtgaaacatttgcaaatttatattctcaccagaacaaaaagaactatagcttctgttccttaatattcctacccaattttatatacttttgacagttttatcacaactcctgtgtttgcagtagttatttttcccttcccttcatacatttatgtccagtacctrtggaccctccttgtgaactcttctctaatttctcacagaccaggaagggtttggaatataactggggctcagctatcaagggcctaagcataataaagtaaatgttcagttttacattttaaactcattttactaagaagaggaattcacatgcctatagatgtaaaggtatgaacaacaggtgactttggtttaccctggaatatctgggaatgctaatagcctcaataacggctcargagacttgtgaaagatacaatttaggagaatctaatgcatttcttctctcaaggctctcttcttcccccattttcccactggccacccatgcaggtagaagtaatgagtaatgctctcaaacactcttttcatattacaaatgtactcaagaacctgcagggactcctgttgtttgtgagctcaacaatgtgccacatctggccacaagctcttcacctcttctttytcagtcyatccacmtaagttctagttacacttctcctcagccaaacccagatgctagctctctcacactcaagcttgtgctgccttcaatgtgtgacaacatactaatctggaatggttttctacttccytctgtcaatgcatgtcctctgacctttcctcaaccaaaataaatgaaacccaacaacaccaaacttcactcttcacttaggaaagttcatgactgactaaggtactgtctatagtctcatgcaacttaycttgcatttgccccatcaaaatcctctctkcaccaccaytccatccagtggccctgggtggctgatcatcatggaatccattgcacccttgtcctctgctccaggctgggtttggccaatgggaggcactggcaggaggtcagagggtggtcatgtacctgcctctccacgtggggcttctggagcagctgtgcttctccytctgggagcacctcttctcagctggcctgcctcatgcatctgcaatccctcagacacccgtctgtgagaatatcttggattgttttattcacggttgtgctttctcctgttgcagtgaggactgggtatttcatgttctttctgagtccacccagagctaattggaatcaccatggygtctacgctgtataaayrccaaatgggaaaggggatctattgtcccttgagatttttctagtttggatcaaatcagtttctacaacagagattaatgggggtgaagtaaagtcaggacttactttcctagagactttggacaattttgaggggcaaagcttcctgagtttgtgmtttttaatatgtgagttaaaattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctmtatccacacatayytccacttctctgagtaagtgacttgatgtcagagaatctcacaccagattataacaataagacttttaartgttcaggatgtttatgtttaaagcattagactgataagaaatctgatctatttcttgtatgactagatgtagtcactrcagtggaaaccaacatacgaaagagcaggcggcacattttcatcctgacccctcagatcactcacaayaaggagtttgcctacgarcaggaggttgccctgcactgtgccctcatccagaacgacgccaaggtgatacttattgagatggaggctctgagcgagctggacatgctgcaggctgaggcgcttcaggactccctcmrgcatcttatgaaagtacaggggaccatcaagtggagggaggaccacattgccawtaaaaggtccctgaattcyaaattctggaagcacgtgaggtaccaaatgcctgtgccaagcaaaattcccagaaaggcctctagtttgaytccctyggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactcttttttcctctctctctgtcttgctttgtttctcctcattcttgtcaataatctgaatagcaaactaatcattcgagagtagattttcacgtcacttgaagaacattctgattccctcaggcagaatgtcagttgtaaatcttgttcccaacatgccagattttctttattttctatatatatataatattwtatatataatattatatataatattwtatatataattttatatawaaaatattatatataatattatatataatattttctatataaaatgtgtatataattatatataattatataaaatataatatagaatatctaataatgtataatatataacatataaaataatattatttaatatataatattttatatataatatttttatatataatataatatatattttatatataattattaattatataattaatatataatatatattttatacataattattaattatatataattaatatataatatatcttatacataattatcaattatatataattaatatataatatatattttatacataattattaattatatataattaatatataatatatcttatacataatatatataaatatattatatataatatatattatatataatattatatataatatatattatatatataaaatttatatataatattatatataatattatatattttatatacaatatgatatataatataatttatatattatatatatttatatataattattatataaattatataaatataaattatatatttatatataattattatataaatcattatataattattataattataatatataatataatataatattatatatamtatatagtattctatataaataatataacatatattttatatagaatattatatataatataatatatattttatatagaatattatatataatataatatayattttatatagaatattttatatatataatattatatatatgtatttgagacagagtctcctatgaacatacttgtggacttatgattttattttgacacttaagagtggtcatagggtaggtgcatatttaactttcagagaaacttatacattgtttcgcaaactaattgtactactttacattcccaccagttgtgtatgagagctctgctgcttcattgcctcaccaataattggtgttgtcaagtttctttatattttaayaattttcacaggtgttagatgaagatcaccatggtyttaacttgaagttccccgactmatgatgatgagcmcttttcatgttttcattggccattcgtatatattttttagtgaaggcaaaatattttgccttatttaaattgtatttctttttatattgttgatgtgtaggaattatttatgtattgtggrtgcaagttctttgccagatagatgtaaagtgagaatatttccagggttatctattcatttttaagtgatgtctttgtttagtagacatttttaattttggtgatgtccaattaatcaatgtgtcccaaatggctattkttttttgtgtcctagctaagaatttttttttttgcctgtccaagrgcatgatttatttatttattttttgcctgttcaagggtcttctctgtatttttatgaaatatttacggttctagcttttatgtttaggtccatggtctattgtgaattgatacttgtatatagaacaaggcaaggacaaagttcttttttctgctgctgcttcttctgtagaggtacccagctgttccagcaatgtttgtgaaagactgttttttccccactgaattgacatggtgctttgttaaaaaaatcaattgactagatatgtgtggatctattagtctactttctattttgtatgtttgtatgtttctgtgaatatcacattgccataattactattgccttattataaatcctcaagtcagtataagtctctcaactttgttcatctttgtcaagattgcccagacaggccgggcaggtggctcacccctgtaatttcaacamtttkggaggcygaaatgggyggatcacctgaggtcgagagttcaaaaccagcctgaccaacacggagaaacccygtstctactaaaaatacaaaagtagccaggcgtgatagtgcatgcctgtaatcccagctactcgggcggctgaggcaggagaatcgcttgaacccgggaggcggaggttgcagtgagccgagatcgcgtcattgcactcactccagcctgggcaagaagagsaaaactccgtctctgtccggacaatcctagattatttgcattttcatatgaattttagaaacagcttcttaatttctttgaaaaattttcctgggatttggattgaattgtattaaatatatagattctgtaatatatagagtctaaaaatatacagtgtggagaatagatgtcttaagtcttccaatccgtaaacgtggtatatccctttattacttagatgtytcatctctgttagcaatattttgtagttttcacaggagatatctcatatattatccaatgaatttatactttggtattttgatttttaaatgctatggtaaatggmatttttaacaaacttcacttttcaagtttccatctctaatatatagaattgctattkatttttatattccatgatcttgataaacttaatatttccagtagtttttttttttgtagatttcaaaagttggtctacatataattatgctctctgttaaaaccagtagttttaattmtttcttctcaatctttatgctttctaattttatttttatttcttcacttgttgcaaagcagttgtcccaggtgggagccaaaatccttatctcattactaatcttaggaaaaagtaaaatgtttcactattatgaggtcacctgtaggtttcttatagatgttctttatcagattaagaaagrtcatttctactctcggttttctgatcgttattaattcagaaagggtgttgaattttgccagatgcttttatttgcatttattgagataattacatatttttatttattatgtggtgaattatctaaattgggtaaaaagaattaaaatcattgtccaattgaacattttgcctgtcggctatgggtttcccttttcctttkgttaaataacagttctgccacaaaataaaaatctagaaacacacattcccctttggcctccttaaaaaaaattaaaacttcaacaattgcacccctctctattacttccctatagtgaactcccatccttctgggaaagcaaaaagcctggggcgcatttgtgtacttgagacgcggagcccctctcaccttcggcatcccccggggacccctcttccaccctcagccctcccctcytcttcctctgaagagccgggcggccgctgcggccagcggtcctccctcctggcatcctctgctgtgaaccgcggcctgcagggtgcttgcgagcggcccgggcgcgcccccttccggccccgcaggtcacccggctacagcccgggttttcccgggacccgcgccgcgcggctgggcaggaagcgccagacgcctggggcccacgccgtccgcgggaaaagggcaaggcgctgggttttccagcagcaacctttggaccccgcgatccagtagctccggtaactccacgcggggcgtctgggtggaggagccggtcctggagcacggctgcgaggagcacccggaccggagggtccccagaccgggacctccgagtcagggaggattctacgccagggagcgccccagactgagagcgccccagaccgctayactcccggacccggagcttcgcccgaccgcgggcagtgcccacctgcagcctccaccggccggggttagcagccaggagctgccagacgcctgacattcttctttctgttcctactttttttccttcttcttctttttttttttttttgtagccctctctgggtgccttatctctttaatcacacctctctttcactttccacggtagtcaggaggcggagatcgctgcttctcacctactttctgaacttggcctccgcagtcscgacctgrcgtgaaggaggagctgccgcccccgccccagcctcggggacgcctctctgaaggtaagggtgggctccgctgccacccgcatcccctccccaccccccagaggaagggaagaccaccatccggggagggattctcaaaacaagatcaattaagagagagagagagatagtgtgtgtgtgaatacgtgtgaataattgatgagacagcatcctgtctttctctgaaagtatagttttagaaattaagacatccccaattattttctggagaggtgagaacgactgaaataaatgataacaatagttgtcattttttaagtgcttactgtgtgcctgacactgtagaaaatttttagatatcttattttcacttaatcctcctaagggccacatgaaataggaactattattatgctttaataaaagggaggaggaattccgtcatttacccaagagtatccagctactaagtagtagatcccagatccacacctacagtttttctgattccagagcctttgtcttttttctgcccagccttgggaagttaaaatgcccagcaccttgcatcgcagttatcagacaaattaatgaggtgtcaattgcagccagatacagagatccaagattattgtattcatttcactgacttcccttgcttcattctcaagaccctttgcaaatactgattttgtgtcatacacagtgctgctattgggagcacacctctcaacctcagggccttggatgggctaggaggggtaaatttggggaattgggtttgtgcaggttctggggacagtgttttccctctccctgcacaaatatacatccaaaggctgagaactaaggctaaggcctaggaatgtggattgaaaaggcagggtctaaatcccagcacttgggaggctgaggtgggcggatcatgaggtcaggagatcgagaccatcctggctaacatggtgaaaccccgtctctactaaaaatacagaaaattagccaggcatggtggcatgcatctgtaatcccagctactcgggaggctgaggcaggagaatcccttgaacctgggaggcagaggttgcagtgagcrgagattgtgccactgcactccagcctgggcgacagagtgagactctatctcaaaaaaaaaaaagaaaaaaaagaaaaggcagggtccctgccttcagggacctcaccagagagtgggagctagtccaggagtgatggaaacacctgcagagtgatggagacgggcttggacataggcatgtgccatttggggctgttgcagttggagagcttccttgagaaggcaaataytgagccaagttgaaaggactctagggacctggcatctgggataagtggggagggtggcccaggtagcacaggcataggcagatttggggggawgcataaggctaacaacagacacttgtgtgacaaggactatgaggtggcattgattttcttggccttacagatgagaagccagattccacacaaattattttgtttgttagagtttaagcgtgtgtgtgtgtgtgtatgttatgccccamgatcattttctcctctttgcatttggttgttttatcatctcacaggctgagtaaaacgactatgcatggaacactgtagaagaaaaattatattaaaaaaaaactggtgttatgattttcatccagg

SEQ ID NO: 13314 - DNA, 119036 bp, Homo sapiens
  misc_feature (1)...(119036): n = A,T,C or G, or insertion/deletion polymorphism (see Tables 1-2)
tgggacacagctagggcagggttaagaggaaaatttacagtactaaatgccgacatcagaaagctagaaagatgtcaagttaacaatctaacctcacaactaaaagaactagagaaccaagagcaaacaaaacccacagctttcagaagacaacaaataaccaaaatcagagctgaattgaaggagatggagacatgaaaaactattccaaggatcaacaaattcaggagctgattttttttaaagaaaatgataacaaaatacattgctagctagcctaataaaaagggggaagattcaaataaacccaatcagaaatgataaaggggatattaccacttacccacagaaatacaaaccgacagtcagaaaatactataaacacttctatgcacataaactagaaaacctagaagaaatggataaattcctggatacatataccctcccaaggcagaaccaggaagaaatggaaatcctgaacagccaaaaaaaggcccatagccagatggattccacgctgaattctaccataggtacaaagaagagctggtaccattcctactgaaactattccaaaaagttgaaaaggagggattccttcctaactcattctatgaggccagcatcatcttaaacaaaacctgggtagagatacaacaaaaaagacaacttcagagatccaggaaaaacagacaacttcaggccaatatccttactgaacattaatgcaaaaatcctcaactaagtactggcaacccaatccaaaagcacactaaaaatcttatccaccatgaacgagtaggcttcatccctgggatgcaagtttggttcaacatacagaaattattaaaagtgatccatcacataacagaagtaatgacaaaaaccacttgatcatctcaatggatgcaaaaaaaggcttttgataaaattcaacatcccttcatgttaaaaaytttcaataaactaggtatcgaaggaacatacctcaaaatgaaaagagccatatgtgaaaaaccaacagccaatatcatactgaataggcaaaagctggaagcattccccttgaaaacaggcatgagacaaagatgccatttctcaccactcctttcaamacagtatcggaaattctggccggggcaatcaagcaagagaaagaaataaaggtattcaaacaggaagagagaggaagtcaaactatccttgtttgcagatgacataatcctatatctagaaaaccccawcaactcagccccaaagcttcttaagctgataagcaacttcagcaaagtctcagaatacaaaatcaatgtaagaaactcactagcattcctattcagcaacaacagtcaagctcagatccaaatgatgaattaactcccattcacaattgccacaaaaagaacaaaatacctaggaacatagctaagaagggacataaaggacttctacaaggagaactacaaaccactgctcaaataaatgatagatgacacaaacaaatagaaaaacattccatgctcatgtataggaaaaatcaatattgtgaaaatggccatattgcccaaagcaatttatagattcaagttattccctttaaactaccattgacattcttcacagaagtagaaaaaatcattttaaaatttatatagaaccaaaaaagagctcaaatagtcaaggcaattctaagcaaaaagaacaaagatgtagacatcacaataccttacctaaactattctacagggctacagtaactaaaacagcatggtactggtataagagcagacacatagaccaatggaacagaataaagaacacagaaatacgaccagacacctacaactatctggtcttcaagaaacccggcaaaaattagcaatggggaaataaatggtgctgtgataactggcaagccrtatgcagaaaattgaaactggacccctttcttacattatgtacaaaaattaactcaagatggattaaagacttaaatgtaaaactcaaaactataaaaaacctagaaacaaacctaggcaataccttttaggacatagatatggtcaaagatttcatgaggaagattccaaaaccaattgcaaaaaaagcaaaaattgacaaatgggatctaattaagctaagaagcttctgcacagcaaaataaactatcatcagagtgaacagacaacctacagaatgggaaaaaatttggcaaactatgcatctgasaaaggtctaatatccagcatctatgaagaatttaaacaggaaaaaaaaaggcaagaaaaaaacaaataaccccattaaggagtrcacaaaggacatgaacagacacttctcaaaagaagacatatgtgtagccaacgtcatacaaaaaaaaagatcaacatcactgattttttgaaatacaaaatcagaaactgatctttggaaatacaatatcaaaaactgatcttttgaaatacaaaatcaaaaactgaycttttgaaatacaaatcaaaaccataatgagataccatctagcaccagtcagaatggctattactaaaaagtaaaaaaataacagatgctggcaaggttttggagaaaaattaacgcttttacactgttggtgggagtataaattagttaaaccattgtagaagacactgtggcaattcctgaaagacctaaagacagaaataccattcaacccaaagattcygttactgagtatatactgaaaggaatataaattgttcagttataaagacatacagacacgcatgttcattgcaacactattcccagtagcaaagacatggaatcaacctaaatgcccattaatgatagactggataaaggaaatgtgttacatatacatcatggaatactatgcagccttaacaaaagaacaagatcatgtcgtttgcaagcacatggatggagctggaggacattatccttagcaaactaatgcaggaacagaaaaccaaataccgcatattctcacttgtaagtgggagctaaacaatgagagcacatggacacatagagggaaacaacacacactggggaccattggagggtggaggataagaggagagagaggatcaggaaaaataactagggggtattaggcttgatacatggatgatgaaatgatctgtacaacagacccccaggacacaagtttacctgtgtaacaaacttgcacatgtatccctgaacttaaaagttaaaaaaaatacccagaaaggacaaatttatagagacagaaaattgattattggttgctgggaatgagtaggaatgagaattaactgtaaaccagcagttagagttacagagaggtaacagaaatgttctraaattagattgtggtgatagttatgcaatacagtaaatttattaaaaatcagataaatatttaaaacgggaattttctagtatgtaatttatatctaataagtctgggttttttwaaagtatatgataagagaaactagagtgtgactataaagactgcttttaaagaagtattatggttgtacgccgggcgcagtggctcacgcctgtaatcccagcactttgggaggccgaggwgggcagatcacgaggtcaggagatcgagaccatcctggctaacacggtgaaaccccgtctctactaaaaatacaaaaaatgagccgggtgtggtggcgggtgcctgtagtcccagctagttgggaggctgaagcaggagaatggcgtgaacccaggaggcggagcttgcagcgagccaagatcccaccactgcacttcagcctgggtgacagagcgagactccatctcaaaaaaaaaattaaaaaaaagtaaaaagaattatcatggccgtaaaggcaaatagagaaataagtgatttgtagaatttatgttgtcagtgatatagttttttttatttgttttatttactgataagaaattttacaacttttaccttatgtccccttcatttagggcattttgtgggggcgcaggtattttckaattatacatatatctcagggttcttgaatttctgcgtttgtgaaaatatctatctcctttacaaccagtaacaactgggaagagtataaaaatctgtttatatactctttatatacttttagggtacatgcacatgtaccctaaaacttaaagtataataataataaaattaaatttaaaaaaatcattgagtcacagtaatttcactgaggactctgaagacattgctttactgttatttcagcattaaaggggaagtggaaaatttgctttttccytctttaatacgtgacttgatttttcaactgggtatcctatagaattgctacttttatagttaattaccatgaccagtaattaactatattgatcttcattgacattcattgtttattcaatacttcctctgcaaaatgaccattataaattatagatttctatttttagtttcaaaagactgaatgttttgamcatttgatttgttctattgttttacttcttagggatactaattatctctatgttgtatgtagttttaactccctgctcttcactcatttattttggccarattcttctccctgtgattaactgtgctatctgtggaatgtcttcatatttctcctcttttctagaataggcttgatttttaaatcattttctcactgatttatggcagattactatttgttgtttaaaataactctcttctttgaggttttgtgtctcttatttgagcttttgtttcagataacaggttttctttaatttatttgatttgttggagtaatgcttattcataatattcacccattttctcatgaatttttttcatattcatctgccatttgtttccatggttctgtcagtgctttttcttgtagtacttacatgcatccacgttgaaccccttccagatataacttatcattgaatgggggattttcttttttttttttttaaatttttttttttaattatactttaagttttagggtacatgtgcacattgtgcaggttagttacatatgtatacatgtgccatgctggtgygctgcacccactaactcgtcatgtagcattaggtatatctcccaatgctatccctgttaaatattttttaaaagatggcattaagaaggggtcaggagagtgaagtgccctttatatctcatatgcttcattctgtgttctctaaatttaacaacaatcagccttaggtatcactttgcaatagtctagtttttctaaacctccttggctttaactaaagctctgtctttccatgtgtcttagtgcttttttttttttttttttttttggctgtaagaraatatcacaaactgggtaatttataaacaatagaagtttatttgggtcacagttctggagctgggaagtccaagaccatggtgctgacatctggcgagggtcattccaaagcagaagtatcacatggcaagagaacatgtgagagacaaagagaaaaggggcgctaaacttccatgctaacagcattaattcattcatggggatagagccttcgtgatctaatatcacctcttaaaggctccacctgttaaccatggtgcaatggcaattaaactccaacgtgagttctggaggagacattcaaatcacagcactataattatttttattttgccgggtctgtcccacagaccctggccaatggatgaaatgagtactcagacataggtatgcagtgtaagagctactaggtgactgcctggctccagtgaccagagagcagcagtccggagaacttgcttttattcagtgcaggcacaatgctgaaaacctggagcccacacaacctgtaggtaattaacatttcttgttcccctttcagggagtctcatgcgcacgcgggatgttcaaaggtcagttcctggtcaacataagtaaacaagcctgtttaagataaatccccccatactgccttgttcctaatccttgccctctgcctcagggttatagaacagccgccttcagctattctcccccagggctctgcagaaccttcccacctttcagcaggtttgcatcctttccctgtagtttttcccaccactctaacagatccctcacattattttttatttattttatttttttaattgagaaagtctctctctgtcacctaggctggagtgcagtggcatgatcgtgactcactgcagccttccactcctgggctcaagcaatcctactgcctcaggctcccaggtaggtggaactgtaggtgtacatcaccacacctggcaattttttttatattcagtagaaatcaggactcgctatgttgctcagattattgtttattatttttattccttgcaagatcgaggagactgtgttgttcatattgtagttttggtcccatagtctccactatactattccagcagcctgctttacataaaaattattcctctttgtttctctcatttcaagttagtaatacaaaataaagatctaatgtgtggcaagcagcacaactactgagccggattcttttttccaagtgagggaattctgatggagctcatgatacgatgtctattttggggtaactttctgagttaatatttgtgtgtaccttctctccaaggaaaaattttactaaaattgacaattctatctttagagattgtaattaggaattacaattgctctcttgtcaaaggtggagtcatctttttatgaaattgttttccattgattttagaaagattactttttccaccattttatatttgaactacttaaactaaattttgtgaatgttaaatttaaaatactttcaggaaattgaaaggtgaaaatatccagaaaaaatgtgtatgtgaatttcgacttatactgtcgaagtagcgtgtggactctggatctagagacatgaattggggcctcttttatagaagtgcttctaagaatcatgaaatccctgaacttgcatgggcagacagcattttgtgaaaagtaaagcaaaacataaaccaaaaaatagatagtgaaattggctgagaaagaaagttcaatggtatgggagcagaaacagaagttaaargaggagaaatttttaatgagtgattttaggctcagtggtgactttagaacattttctctgatgatgagggtgaaggcacattgcagttgattgagaaatcatgtggtggcaagaatgaaaacaaaaaaagagtgaaatagaatgaggagaatgtcaactaaagaaattttaattttaaaatatttatttgcttacttttattaagacgttttcataaaccaaggagaaggtgctggaagaagtagaaaattgaaaaaaaaaatcaagaaagagcacagttgattggaaagacttacgaggctacagaaagcggtagaattcaggacagaagggaatatgttatttatctctgaacagcaggagttgtagrgataaagtcaccctctggcattagtggcaaggcttacgaaagcatatctagggaagtgtgtaatctttgagtccgtatctggaggaaggycaagtttcttaatctcatttttctcaggaaggcatgaaatttgatattttgctaagtgtaaaggaaaagtgaagtttgattggagcttgaagagattaccaaaaagcttagattagatactgaagggataaataacaagtaaagagattggcctcttaaggggcctcaattaaattggaaataataaatttgtagtgcagaccctgtagcatgtcactgtctttcactggccccagcagcccaggagtagaaaccaaaagtttacatcacaggtttgatgaaaattggcgatttgaaagacagcccccgcagaagataatggaaagtttggtgaacctgtgagtgatcatagtagttctrattgttaaaactttgtctcctggatagtcaggaagaataggaaccaaaacttggagaaaatttaaagaccaagtgcaggactgcctacaaaggtaaaataatttttaattggtcttaggtaaacttctgacaaattctttcattctcaattccaactactgactattaatctatgtcccatattgtctgtcagacatttttaaatgaagatatatcctctgaaatattacaggaccacgttttaaaactttatgcatttatgtctagaatgtgtacacttgagtggtggtttcttaaaatcacagcatgacaattatttatgaatagtgttcctcccaaatcagaggaattcacatgcaaatatagktaagttgcccatagttgtcccaaatttttgaaaggcatcagtgaaatgtaaaagaagcagcttagaagtttccaaccctttaagtcttaaatgagtacttgaaatgtgatattgaaacaagaggacagctggattacttacgtttaagagtagttgagccaggtgcagtggctcacacttctaatcccagcactttgggaggccaaggtgggtagatcgtttgagcccagggatttgaggccatgctaggaaacatacggagaccctctctctacaaaaaatacaaaaattagctggactgggtggaacatgcctgtggtcccagctgtttagaaggctgaggcgggagaatcacttgagccctgggggttgagactgcagcgagcagagatagcaatactgcgctctggcctgaaacatggcaagatcatgtaaaaaaaaaaaaaaaaaaaaagaagagttgagggtaaagataactaatcatgagaaggaccatttattttatgtcgaataatgaaaagttttcacttttttcattattccaaatttgaagtttgtatgtcttaaacaatgctgataatcatgccactgtatttagaatcattgttaaacagttcttatcccatctggaaagattgtaaaatgtgtatgttataatgtcagtattatatatatyttttatttatggatgctacaattgtgttcttcccctatctatgactctgcttagattggtgtgcaggccaaatctggttacttctcaygctctgatttaagaaactttatatttatttctgatagtgatgcacaccattatgtcaaatttagaatacacagctattaactttattgctccccagatcaaagtcagcagtttttcagtttgttggatttacaacccatccttgtaagacttgacattactacgttcatcagacaacaaacagaaggaatcaatattattaaaaaatggatggcagggaaaaaattcaactctagaacagaggttgggttaaacgttaaaatacttaccttaaacatcttatttctctattttaaaatctaagaatccaaagtatattctcatacttccaagctacattcatgtcttttgttaggagttaaaattggatacagtttgattctgtgttcaactcagaaaagttttcaaaaaatatgtgtctgatagctcaacagaaacataaaatactgagaatattctattttagaataagagtttactagcttcaaccctgacacagatgttacctcataataattataaccattttttcttactttctgatttattaacatgacattttctaatttgaagactcagtagttccagctgagcttattctcagcatctaaaattttagtgtcaaaagattaccaaatgattatttagtcagaatctatttcaaaattgtgtaattttaaacaagatatctaattcactttttttgtttmgaatatattttttcacatgtactatagatcctatggtgacgaaatattaaataatttagtgacttttttatatatccagaaaacattggcttttttttgaagaaaaggtttttagtgaatatcagagacccacatttacctggcttactccagaactacaatatgtgactttttcacagcaaacacygcatctctgaaaacttattttcctcctaatattttaatgattcctttcctgaatcctcatagtagccatctcaaatttaattattgcattcttttcaatgtcttatttctaaatcaaatgttctccaactcgctgtcttcatatccttacttccctgcttttattctgtccttctcagctatagcaattctacatatgatgtaagagtcaataactagccatgttttgctctgaccaaattatcaatgacctcttcatagcatttcctgtgtcaactaaccgggcattaaccatataggtattaattatgtagaaataggtataataataacatacatatttgtatactattttagtttgctaagagcctttatatgttttctaatttgattgtcacaaatgaatacagtcatgactgcatgcatgaacaaattaatggatgtcattaatatgtggaaagcaataaatatatggtaattgtttagaaaacttcttttaacttaagctctgataatgtttagttcaacctaatgcattttgaatctattactgttgaaaagtgaaacagtgttaggaaaattacaaggtccagtgtctaccctcaatttctaaatgagagtaaaagtcatagagttagacttggatttaaacctaccaaggtcacctaggagctctcataattaggggaatggattgtttttcttctctgaaataaaatttcccttctagcagtaacgaacacatggattttaccaaaaattaataagattgaaaaatctatatcaaaaacaggctatactatktttttttttttttttttttaagatggagtttcactcttgtcgcccaggctagagtgcaatggctcaatctcagctcactgcaacctccacgattctcctgcctcagyctcccaagtaagtgggattactaggtaatttttgtattttaagtagagatggggtttcaccatgttggccaggctggtctggaactcctgacctcaagtgatctacccaccttggcctcccaawgtgtgtacaatcttttatctttaattaacatttataatttaacatttgttaacataatttttgggctgttatctaagtttttaattgtatgtgtcctgagtccattttccttatcagcacctgaagatgacgttcttttcagaggtcctgttcaataaaatggagaaaatatttagaagtttctctgtatatagctgaataatagagtctcattgatgttggtgcaatgatgatggtgtgtgatccattaggttctctctagctaagtaatgctcctgtacaccaacctcacagcatctgtcrtccaaatttctttctcagctaaattgcaaattagtacatattctgaaccttccggtcattttttcaagtagtcaagcctcaaataccaacagtctatattaccttttattgagctgatatgccttctcatgatcttaggattctgtcactagagaagggcttaaaagtaagcttctttctcagacatgcaaattacagtgcagatggttaagtgcacctcgttatgctatctttggaaaagacaaggagaatggtgacccatagaattaataataggtgaaacaaattaagcaataacttgccaggccaaaaaaaaccaaaaaaacaaaaaacaaataaagtgagcatcataagtagaagaaattttattccacacacagtgagggttgcacatgaatgtagaaaagagaagagttataaaaaatgtaaaaattctcttctcatktggcttttcaaatctctagggaaaaaataaaccatttcataagcaatgagggagaatctgactatcatttgtggaagaaaaactagacccttcctctacactaaccaagattagaaaagaaatacaaacacactagaataaatgttaattcatcaattttattacctaattttgacatgtgatatcaatacagaaaggtaaatgaaatgatacgtacagtttaagaaattrttataaaataaacaactatggaaccactcagatccagaaatagatcagcggaaatagatgggctcccagaagcccatcatctgctcctccccaattacaacgccatcccttcgcaggaggtaactactggtacaccttttgtgatgagcatgtacttcagtgtttctttggctttatcacatctatgcatccctaaacagttctattttcaactttatgtgttttgtaagcattgcttcattgttttcaaaattatagccaggagattgagttacactgttttctacatctttattttgcacattttcattgctgagtaatatcccattaaaacaatatactaaaacagtaatcctcaaagtgtggtcggctgatctcttgtgttctcaaatctttttcagggggtccacaaggtcagaactatttttattatratactataatgctatttgactttttttattgtttcatttgcatgaatgtcgcaaagtaacaaagcaggtaacacagcttctgacttaacatgaatcaatgcagtggcaacaaaccgtcacagtagccaccatgcaatagtttaaactgtgaactaaactcatgactttttcatgaaacactatttttactaaaatcatcactgacagttgcgtgtaatcccaacactttgggaggtcaaggctgttggatcacttaagcccaggagttcaagaccagtttaggcaacatggcaaaaccctgtctctacaaacaaacaaaacgaaaattaccccsgcacggtggtgcatacccatagttctagctacttgagaggccacggcagaaggatcacctgagtccagggaggtcgaggctgcagtgagccatggtcgtgccactgcactccrgtctgggggayagagtaagaccgcaactcgaacaaaacaaaaacagatagatagatagatagatagatagatagatagatagatasatacatacatacatacatacatacatacatacaaacatacatagatagacacacacatattctcaagtctaaactatatatatmatgtatataatatatgtaatttctaatgagataaataattatatgaatcagtgcactacaatatattttaatttcattcttaagtggtacttgggttttttccaatagggttgtaacgaacatttctttgaagattatggtacatgtttcttggtacacatgtgcaaaaatttctctgagatacttacctagaagcaaaattactgaattaccttatctcctattgctaggtaattatttttagaaatactttatatagtctgaatactaggccttttcacattaggtatattatgagtattttctctcattctgtttttttctgtcaatttttcttactaaaacattgtttatatgatactgagttaggaaagatcctttccaaaaaaaaaataagggcaggaaataaaaccatagaagattgataaatctgagtacaaggattttttaaaaaatcatattattaaaataccaatatacatagtcttcggagggtgtatgtgtcaaggaatttatccatttcctctagaatttctagtttatttgcgtagaggtgtttatagtattctctgatggtagtttgtatttctgtgggattggtggtgatatcccytttatcatttttcattgcatctatttcattcttctcttttcttctttattagtcttgctagtggtctattaatttgttgatcttttcaaaaaaccagctcctggattcattgattttttgaagggttttttgtgtctctatgtccttcagttctgctctgatyttagttatttcttgccttctgctagcttttgaatgtgtttgctcttgcttctctggttcttttaattgtgatgttagggtgtccactttagatctttcctgctttctcttgtgggcattagtgctataaatttccctctacacactgctttaaatgtgtcccagagattctggtatgttgtgtctttgttctcgttggtttcaaagatcatctttatttctgctttcatttcattatgtacccagtagtcattcaggagcaggttgttcagtttccatgtagttgagtggttttgagtgagtttcttaatcctgagttctagtttgattgcactgtggtctgagagacagtgtgttataatttctgttcttttacatttgctgaggagtgctttacttctaaataagtggtcaattttggaataagtggggtgtggtgctgagaagcatgtatattctgttgatttggggtggagagttctgtagatgtctattaggtccacttggtgcagacctgagttcaattcctggatatccttgttaattttctgtctcgttgatstgtctaatgttgacagtggggtgttaaagtctcccattattattgtgtgggagtctaagtctctttgtaggtctctaaggagttgctttatgaatctgggtactcctgtattgggtgcatatatatttaggatagttagctcttcttgttgaattgatccctttaccattatgtaatagccttctttgtctgttttgatctttgttggtttaaagtctgttttatccaagactaggattgcaacccctgcctttttttgttttccatttgcttggtagatcttcctccgtccttttattttgagcctatgtgtgtctctgcacgtgagatgggtttcctgaatacagcacactgataggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacagtttggcatgtttttgcagtggcgggtaccagtttttcctttccatgtttagtgcttccttcaggagctcttgtagggtaggcctggtggtgacaaaatctctcarcatttgcttgtctgtaaagtattttatttctccttcacttatgaagtttagtttggctggatatgaaattctgagttgaaaattctttcctttaagaatgttgaatattggcccccactctcttctggcttgtagagtttctgccgagagagagccactgttagtctgatgggcttccctttgtgggtaacccgacctttctctctggctgcccttaacattttttccttcgtttgaactttagtgaatctgacaattatgtgtcttggagttgctcttctcaaggagtatctttgtgtcgttctctgtatttcctgaatttgaatgttggcctgccttgctaggttggggaagttctcctggataatatcatgaagagtgttttccaasttggttgcattctccctgtcactttcaggtacaccaatcagacgtagatttgatcttttcacattgtcccatatttcttggaggctttgttcatttctttttattcttttttctctaaacttctcttctcacttcatttcattcatttgatcttcaawcactgaaaccttttcttccagttgatcgaattggctactgaagcttgtgcattcgtcacgtagttctcgtggtgtggttttcagctccatcgggtcctttaaggactcctctgcattggttattctagttagccattcatctgatcttttttcatggtttttaagttctttgcgatgggttcgaacttcctcctttagctcacagaagtttgattgtctgaagccttcttctctcaactcgtcaaagtcattctctgtccagctttgttccattgctggtgaggagctgcgttcctttggaggaggagaggtgctctgatttttagaatttccagtttttctgttctgttttttcttcatctttgtggttttatctacctttggtctttgatgatggtgacgtacagatggggttttggtgtggatgtcctttctgtttgttaattttccttttaacaggcaggaccctcagctgcagttctgttggagtttgctggaggtccactccagtccctgtttgcctgggtatcagcagcggaggctgccgaacagcgaatattgctgagcagcaaatattgctgtctgatygttcctctggaggtttcgtctcagaggggtacccagccatgtgaagtgtcagtctgctcctactggggggtgcctcccagataggctactcaggggtcagggacccacttgaggaggcagtctgtccgttctcagatctcaaactccgtgctgggagaactactgctctcttcaaaactgtcagacagggacatttaagtctgcagaggtttctgctgccttttgttcagctatgccctgccccgagaagtggagtctacagaggtaggcaggcctccttgagctgcagttggctgcacacagttcgagcttcccggctgctttgtttacctactcaagcctcagcaatggcaggcgcccctcccccagcctcactgccaccttgcagtttgatctcagactattgtgctagcaacgagcaaggctccatgggtgtgggaccmtctgagccakgcgcgggatataatctcctggtgtgctgtttgctaagaccattggaaaaacacagtattagtgtgggagtgacctgattttccaggtgccgtctgtcacagctttgcttggctaggaaagggaattcctgaccccttgcgcttcccaggtgaggcgatgcctcaccctgattcggctcacgctgggtgtgctgcacccactgtcctgcacccactgtctgacaagctccagtgagatgaacccggtacctcagttagaaatacagagatctcctgtcttctgtgtcgctcatgctgggagctgtagactggagctsttcctgtttggccatcttggacttatcaccatttsattcaagtgttttgagaagcttaaatgtatttttagaaggaaattattttattcaatccagtgatagatacaacaataacatttccacaattttgttttagtaaataacaaaaacaatgacttgagtgcctgtgatttataacaaaagggtattctttttcacagaatctatgaatttcataaagtttatttcattttaaagatatttcaaaacatttctgagagttccttaaaactcattttgtttatttcttttaatattactgaagaggagttaatgttggctttataatttcaaattttaatatcttagtttactgtttacaattttacaatacatttatagatggaatactaaagggtcaggcatgattatatatatatttttaacgaacttaattctgagaggttcttttctaatcctgattttagttttcagatgtcacacaattagtgaattccagaggcaggattcttcattgttattcataaaaaattttggtataaaaatgaatgaattataaaatataaaaatgtttgkttcctggaaaacattgagattctacaatgcatttcttatgtaaataacactgtttctttattgaaatagttttctactagctgattttagaggccctaccttgctgatttttcatgttgtatgaatatagcaagggatttggatgcaaggagtttatttcaagatgtaaatataatcatgtcagtaaccagttttctaacaattctccttaatctgccttagctagtagttattctacaaatttaagaaatgcagtgtttttgttatagattttaaagttagcctggaacatttgatacactagtctccactactgtaaaacaaaataaaatgaacaaataaacaaaaatctcttccatatgatgtaaaaacagccagagaagactctttggttaagatagtttcatgtgaagtaatgtgtaaattcgctgtaagcattatgacagacaggaaagaactaatttacattttgagaaagcttctgccttgcaaaggaattttcttaagataatttgtattcatatctaaataataaaaggctcaagattaagcactggaattgccatttatagtgtaaagaaaaatgcaatcttgagccatttatgttagttccattttttttttttatttttctgaatcatcatcttctttgaacaattattcaaaagatagtgttttctttttgtcctttgtggggtatcctgcgctttggctgatgattaaaaacctgccatttcctttcatcctcattagcatactcattgttctccttagttgggtgctttttggatgccatccttgtcctgcagagagctgcaggattccatcagatctgttcaggcacctgagcctaattaaggaagttctcacttctctttttatcatagatttgataaatgaggatgtttacagctaagtgtcttaggattgagtgaatactttaaaatagatcaatgctaaagatcataaagcatatcacatawycacattacwtatctaataaagagaaatagaacatgacacattttcatgtaagaatctgtttattcatagtgcccatgatgtggtagagactgcatgccatttatagcgttatagttggagtagtgtaaactgctacattgtgaactataacaactgaactgaaaaagaaaagaacaaagacagaaacagtyctggacaatggaaattaaagaagagtgatttgtattcttttgatcctccggtttctctatgtcggcttctctttggttacctcaagtatcattagtattacagttgtaagaactctggctaatgtaagcagcaaagaaatgtgctggaagaatatctgatcccttagaaaatcattggggaggctgaagagcccagctagagaaaagggcatgcaggaagcaaagaatgctaagcacacaagcccggagcctcctcaagttaaggaggttgctaatagcacgaccagcacaggatgtgagataatcagtcttccactggactctcattctggacattgctatgagttctttattacctattttaacatcttcgtattattttttcaagactcaaaatccaggcaggattaaatagttggcttgacccaggtcacagcctacactgcagttatcaaggaacagacagagagccctcggtgctgtcagccttgtgatggggaaatggaccctgcttccccaaaaggcatttgcaaggagsgatttgaaactggaaggatctcaagtgtttagtcgaaagaccatggcccatgtcagtcatcactgtcatatccacagataatagagtgttggaaagaagctgagaaacaacctgggttctattcaaattcagttcttagtgttgtgtgaccttctctaagcctgggtgtcctcagttttaaactgggataatattgttttgcccaaaatatctcatttcattgtaaagagtgaaatgagataatttatgcaaggtttctttccatttcttttcattccaaaaaatttataggtagtaatggtctacctgtgtgagcaaaatacaaaaaaaaaaaggaagaagttaataagttaataataaccatttatttgctaagaaatatataaatgtgagrtatgaggtattatcagcaacktttttwtttaaaaatatatagaaaagatatatatttatttttcattgtttgaaagttaagacaaatggmtgaaaaaaacagtgctatgataaatatgaaacaattaggagagcagaaaattaatgttgaggtattcccctgcattggggatctttctcccaatccaactatccatttttgtgtgtgagggagttgacattcttataaaaccccaactgtagaacgaagtgactggyctaacaatggmtctttcaccgaacgtgacccatcagaactaattcctaaagcttttaaacttagaaccatctgtaaaatgtgctgctggtcagaagcagtactgtgtggtatgcatcattgttgaagatatattcagtgtgtctgctcattgtggtgctagggtaatccctgaagcaggaaaggaaagtccacatctttagcaagtactttttccatagaggattaaacattccttcctggaagagatcaggtgtaatcactgtgctgccagattactggctgggccatctcaggagttttcagtatttgtctctgctatttgcatattagaaactcaggagtaccagtatccagaccagcttgctgagttttcagcctctgctatttgcattttggaaactcaggagcaccagtatccagattgtcttrttgagaaaagcctatgttgttcagcccatgaaccacttcagtctcctctgcatggccatttcccatatgctatggctagggcaaaagctgactgactttgaccagataggtcatcttgtcagccagattatcgactctacatagtggatgctgtctagtggacatttgcacagaaagtggatgttttcacattgttgcccattttgagagtttcagccacatatcattaccccagaatcgcaatcttgcaacattaacatttgatggtgacccttatgtcaccagttctcccagagatgcagtattgttttcggattaccatcctggtggggaggggtcgtttcagtggcttccatttagtccttctaccataagagttttcactccatatatcaggaaacgaatatggattctgccaataattaaatatatatcttcttagttcgcattttgtatctgtagaaataacagccagttgggtctacagttccgtaggatttactatgagatgcagttgggtcaagactttccatagtgctcaggatggtcatagttctgagcctcaattaatgagccccagtacatagctttgttttctcactgagatgccctctagacatggcttcaaggaaggttttataatataacccttgttgtgagctgaaatgtggcccccaaatcctagccctgaacatctcaggatgtgactgactgtatttcgagatgagacctttatagaggtaattaagctaaaatgaggccattagggtgagtcacactccaatctgactagtgtccttataagatgaggaaatttgaacacattaaaaacacacaccaggggcactcatgcacggagtgacaaccacatgaagaaacagaaagaatgcaggaatctgcaggccaaggagaggggtctcaggggaagccagagctgctgacaccttgctgtcggtctttgagactccagaattgtaagatataaatttctgatttttaagccactcagcctgaggtattttgttgtggcacccaagcaaattaatacaattctgctgctataacaaagcagcactaacttaagtgctgcatatatatatatatatatatatatatatatatatatatatatgataacacaaatgagttatcttatatttctacaggttagatgtccaaatgtgtcaccctgggctaaaatcaagttgtcaacgtggctgcattcctttctggatactctaggagaaaatctatttctctgccctttccagcttctagaggccacccacatcctttgttctgtggtcttctttcttgcatcatcaaagtcagcaaccttgcatcgttctggccattcttcccctcattacattattttctctgaatctcttctgcctccctctgctgcttttaaagatccttgtgactgaattggactcactcatataatccagagtaacttccctcttttaatgtcatctgaacgagcccattgtaaccataattccatgtgtaatcttagttttcctttgccctgtaatgtaatattgttctgggaattcagatgtggacacctttgtgaggagggcattagtctgcctaccccagtcctaatagctaagatgctgggttgcttctctaggggccgatcattgaagaagtagtggatttttgaactggtacagtttttgaactaagatgttatgaatctccacaataatgagaattaggtttctcctcagcagacttgaacatttttggattgtataagccaagtagctcattaagaggccacccaacattcctagaccataaatatttatttcatttttaggtaattaatatggaggattcactctcctctgtctcacaamtctcctgctagcctaccagtctgccaaacctaatcaggaaccagaggtcaggggagtcatttgattctgtccaaaaagatcatccttttggagaaaacaaaagggtgaagagtggatctggagtgataaatgagaaaagttctatcccccaacagagaccaggagacagaagtcttatccttcctaatgactacttttcaaaggaatggctttcaggtccttgaaaaaaaatactcccaggtcattgaagaagacactcctaggtgataggaaacatatatacatctcaaaaggatagagaaataattcaatgttgtaagcccttttttagtaaatgttctattaaaggagtccggggacttattgtcaggtattggctagaacaaacagtaaattcaatgacagtcctgagctatcctaggcaggaacccaaaagggggttgggtggtctcagagatatggccttgagctgctagaagccttgttaaggtttggtgattgcttcttgaagagtagataatagaaaacaaaacragtttggtgaagtctctcagtgcaggtgtttaagtggagtgtccctatcaatcatttttacagttctcattaccacattagaatttgccaatgagtggtgctcccaagtgatttgggaagcaaaagagaaaaagacatgtattctctgatagcaggaagatcaaacagcaaatgacaggtttgagctttggaagtgcaaaccaaaaagtatctgagacaggtctcaattaatttagatgtttattttgccaaggttaaggacattcctggaaaaaatgaacacagtcacagaaaccatctctggtctgtgactttctccatagatgatattgagggcttccatatttaaaggggaaaagctgactggaggagggtatggcaatgcacatcttgcaagagaaatggagcaggtagagggataatcaatcatatattcctctcttgctcactaaatctacactttgcataagataaagtgaacatgaaatagctacctgtggagatatttaaccttttatctgtagctatctgcttaggaacaaaatgaaaggtaatttcagctttcaacttaaattcttttttcttttggcaaagttaattgggttcctgagttcctatttccctttcacaaaggccatcttggagctttaagcagtagtttatggagatatttggaggggaactgaagatgtatagaataagcaattatgtatgtttatgaaggcgacgtgagccatgtggcttagaacatcacagaacatacattctagttcatgctctctcactagccaggtggccctagataatttattcaagagtctttaagttttctcattgcaaaataaagagggtttgctatgagaataaaaggcaatcgggcatatgaaattgctataaagtcaatggtatccaccttgcaacaatccttttggctatagcataaattcttttctctcatttgggcccctaggctgayattccatcatgatttcacagacttctggttaagaatttgcttaatgcattttgctctggcttaaattaattgacacttttacaastttgaaactcatttaaactacatgggtctttcctacaattctgaagccatagttccctaaacacagtgcaatgtgcatttatgtttttaaaatagcacataaaagtgatctcatattcactttcatttccttgcatttttgtatcttcttagttaagacatcatcacgaggaaagggtgaattgtcaaatgttgcttgcaggagacagctgatcttgcaaggaaattagtcattcgtattttgggcatatgttatccattctacttccctaactgtctaaggacagtgtgacttttagggtcttaggtatgcttacttgccttttagtgtgagkttgtatattaatctagctaggagctgggttacgtctaacatttcctgtagatacagctgtcagaagctaaaattacctgtagtgtctctttgttgcctctactgtatttaggttcccctacaaacttccctttcaaaaaaaaccttgcatctctttcacctgtcatccactgttatcatacgggagctctgttgacggaggggtgagatgtgggggcggggtgaggtgttctatagtcttctgattaaatctcagtcttttagtgggcccttgtccccggactgtgacctgtgaccttcrtgagcgtttctaaacttttttttttttttcctttttctctgccaagttgaactgcagctggaagactagagggagcgagcattgaatagttacccttcagctgcctagctaagataacgctctgataaactcttttcactggggagtaagcctttgttacaggaaatgctctaygtatattttaaaatcattagatttcccttctctctgccagggacatcaggtgatattttttggtatatactgtgagaaccaagttgtattcctggaagtaaagcctgtaagtgtttagggggcgccttgaagactgcagcccccaggaggctccagtgctcacactggtccatactcagcctcttgccaaattcctgcttaggtgttcctgccagtttgtggttccactggcatcagctgcaggtgatctggtgtctgctgtgatgctctgtaatctcctctctctcccggtttcaggctggtagtttccttgagacctcagttctctgatgggtccaagacgtcattgatttttagtttctccagcttttttcgtggtgtcgagatatgagtgatgacttccaagctctttagatgttgaagctgcaacyagaagtcttccatgaactttcttttaaaaatagacagtatggcatagtgcagtgtttctcaaaagaaaataaatatattgatctctataccttattaagtgttgatatattattttattataattttatgttaaaatagagaaacacgaatttagacctaaacactgtaagcctacasttcttaaccaagtttttgaaatataatgcatatgttaattaaattttaaaatctcgcaaaaaaattaaaattttaactaacaccaccaatttaagattgtgtgggcaagccaaaatattattataggtttaatagaaggaagatactattcaattctgatactgtccttggtctgtttctgtatttgacttcaataattctcatataggaaagttctgtttaataaggctatataaaatgttactggtaccttcacagttttctgcttatgattatcaaagaaaaagctctgccaatatgcaatttttcaatgtcaattttattaaagaatgttttgataattctgtaaatgctttataatcccacagcaatatgtgtccgttgcagcattattaaaatctgtatttatatcactatttacttattgctttgaattaagaacatgaaaaattttatctcgaaactttatcatatatatatcatacaataaataagtcataatgtattaactatatattatgactaacaacctgctgtaactttagacatacaaaaatacctcttaatgagtgtaaaatgttaamtcttcttttgagttcagtatacctgtaccacagtgagtcctaggacatttgaatcaattctctcaagccatttgyctatttgattatgaatctctgtttggtcactgggcataatcttacatggacctcattctagacacatatatccataagcaacaaaaataaagtaattgggatccatcacaataactatgaacaaagtaactatccacatgatctggaatttgcccatatttgtggyttgttttctgtatactgtttttgatggagatattatagtcccctaataatacatatacctacttcagcttaagaaaaaactatattttgccaaattttgtaatcagactgggtttaaataccagctctgatgactcataactctgatctcgagaaatttacttaccatctctaaacattaatttctcaattagggaagtgatatgacaaagttgctgtgaagtcaaatgaaggaatgaatgcaaaatcccaaccctttacatattacctctgttctcaattaatcattggcttgaactgaacatttttaacatggttccctgctaaaggtgtttttacatatagtaagacctaatagataatattatgttacataatctataattattatatataaaactatataaaattatatagtacctatttagacatataaaaagggaagttttttaatgaaaaattagattggctgaagagtgtggaaatcatcacatagggaagtggtcagcactgtkgatatacaccaaacagtattacagagacatactgaaaataaagcacactgacagaaagaaacctcattaggatagaattttgggagattggtgtcttgttattcccagagtctgacttttctaatcacgtagyattgtcagggatatctaaattttaaacttcagattttgtacaaaaaaacctaaaaggactatattttaaaataagaagcatgtacaaataattgtaaaggaaaragtgtgagttttgtagtctccagttctgtgtcagtaagaatttgatgaggaatagccaatagcatttatgctggtccaggctggatcaaattgtgatcgtacttytagtcttcaagctgcctggttagaaattatgcagcttactttgatgcctgtcctactactactattagccttttagtggttaccttaagaatractgaataatactgttactttgcatctctcaaagaccgtgcgctgttcccgcatactttcttgcagacgtattgtcttctgaaggatggtgcccatgggcacagcaatttggggcatcttttggtaggaagcatgatttctcctgtttgggcacaaaagagtgactacggaatataagctaaacaccttctcccagaaatatcagttgtaaaacttagctcattaatgtaatgttgaacgttttcatgtgagtcatacttgaacttcttgaatgtgagtaaataacggagttgaattgtataaaaccctgatggatggcagaagggaaagaacatccctttcatctgatccatgcctgagattccttccctctactatactactggaaataaacaacttgtctggtgctctaaaaattaatgctattatcattatagagagaacaggagtgagtgcttttaggttattacttgttcttactaaggcatcatattctttcttcacgtgttttgtgtttgaggctagggataaaggtacaggaaaaaggatctaagaaaaaaactcgaatctctaaacatggagtctttttttttttttttttttttgaggtggagtctcactctgttgcccaggctggagtgcagtggtgcgatctctgctcactgcaacctcygcctcctgggttcaagcaattcttcagcctcagcctcccgagtagctgggattacaggcgcatgcctggccaatttttgtatttttagtagagactggtttcaccctcttggccaggctgttctagagctcctgacctcaagtgatccagccacctcggccacccaaagtgctgggattacaggcatgagccaccacacctagccaaacatggagtctttactcaacattatagtaacgtgaaagaggagatcatgagaattaatgtatgttttagaaggcatagattacttataaaaaaggaaagatcaggctgggcacggtggctcgcgcctgtaatcccagcactttgggaggccaaggcgagcggaccatgaggtcaggggatcaagaccatcctgaccaacatggcgaaaccctgtctctactaaaatacaaaaaattagccgggtgtgrtggcacacgcctgtagaacctgggaggcagaggttgcagtgagckgagatcacaccactgcactccaccctggtgagacagcgagactccatctccaaaaaaaaaggaaagctcaatctgctgtaaattatgtgcttgtttcaacaacccttgtttcttttccttttcacttctcttttttttttaaagcggcctaaatggggtgaagagtgagttatctgacaaatttagattttgcaaacctgtgcattgatgagagtgctattgraacacattaagaaagrttttcaacgcaggaatgtgtcatttcctttcttcatgtaccagatgctgaaatactatgagataaagattttaggtttcaattgtaaagagagagaagtggataratcagtgctgctttctttaggacgaaaggtaaagaaaaaaaaaggcttattttaatgttttttccagaattgtttctattgattgttatgtgtgtactctgtgtgtgtgtgtgcatgcatgtgtgtgatatatatttgtgtgtctgtgtgtgtatgatgagatgaatgctttattgtatcagcaataatttggtttggtttttttcgataatcaaaaaatagggatttctgctaaattttccrtgagtgaaaaacatatatgttcacaagtacatatgaaatacactaaatgctttgtagtttgaaccagcaatggggttttttcatataattaagcatattttgtttaaaatactggttttattcaaagtataatttgacatatttcacctattctcctttcataacttttcatggaacatttttggctttaatctaatgccttttattatcttcccttgattatatagcaaatattggctgggtatctactatatgcacttcattgaactagatgtggggaaaggatacaaaaaataaratatagttctttttgtgctcmggaatcttatgatttaaaacatatccccaaataggcataatgtaatttgagcaccttaagtagtatgaaagtactatagataattactagcaccttaagtagtatgaaaatgctatagataattactatgaaaatataggcgaggccaaaattacttctatgtgaaaaaagtctatcaaaaataaatcttcatggagatgctagaaatctgattaatcttgaagactaagtaagattcacacagcatataatgggaggttggcatttgcactgaccaggtaaaaatacttatagaaaaaccatagaactgagattacrrrtgttttatgcagtgattagccgttttatgcagtgggtaagagctaatcttctgggagtagactgcctgtgttcaaattccagctcccctgctccctagttgagtaacttgactrgttacttacacatttcagttccctaacctgtaaaatggagaaaatactacttgtacctcatgaagattccgtgagaacaaaataagaaaagctcatatttaaaaaaaaagtgatattttaaaataacagggattcatatattgatggttttctgtgtaccaggcaatttacaaaaattatttttaattctcgcaataattctttaaatttatattgtgatcatattttacatatctaaagaaagttcaattcaaataagttaaaatatttgcctragatcacacagctaaatgatgtcacagtcaatactcaaatctagatttcagattcaaaagttgatgctctttcttctttgctaccaaggatgaatatcagtgacatcaggcacaatataaatatttccatttcttactaaaatctgtcttacagacgggttccttaagcataaagctgttagtttcacaaataatcttaatttaattttsattttatatacacattcaactgctgttacaaaaatcaaagttattattttatataataaggaggatcacaagcttattatttattccaaatgttgaagataargttggccttaagaatatgatgggccgggcacggtggctcacgcctgtaatcccagcactttgggaggccaaggcrggtggattacctgaggtcgggagttcaagaccagcctgaccaacatggagaaaccctgtctctactgaaaatacaaaattagccgggcgtggtggtgcatgcttgtaatcccagttactccggagkctgaggcaggagaatcacatgaacccaggaggcggaggttgtggtgagccaagatcacgccattgcactccagcctgggcaacaagagygaaactccatctcaaaaacaaaaagaaagaaagaaaaaagaaagaatatgataaaaaaactaaatagggaaaaatcttaggaaaacgaatgcatgtcaagtatgaaaagacagayggtaaatatgtattaaacataaagagctgattcacatgcttaggtaaaagaaacctgtggggatgtataagcagtgaatatgaatagataataacccaagaagaacaatgtatgacagacaattacagtgaaatctctctcttacattaataataaaaaataaaaatgaaaaccacttttaggtattatttaactcttatcaaaatctaaatgattctaaaataagctttattattcaatggtagtgaattttgcttgaaactgccatattcayatataagtctggaatatttataaatttatgttatctttttaaagatcactaagacagtagagcccaagaagttcaaaatagttttcctttcactttttagtttcacatatgrtgaattatsctaaagaaacattttaaaagaagaaagctaaattatgaaaataatggccggggcagtggctcacatctgtaatcccagcactttgggaggccaaggagggtggatcacctgaggtcaggagtttgagaccagctggatgaacgcggtgaaaaatacaaaaatgagctgggcatggtggcaaacgcctataatcccgctactcgggaagctgaggcaggagaatcacgtgaacccaggaggcagaggtttcagtcagctgagatcacaccattacactccagcctgggtgacaaagcaagactcaatctcaaaaaaaaaaaaaaaaaggaaatatttataacatcattatttatatcagtgaagcattgccccctgggaaaaggaaaaaaagtttaaaagaaaaaattatattttagaaaaatggctgtattttttatttagaaaaatggctgtataaataagattttatatatatataaaatatatataaaataagattttatatatatataaaatatatataaaataagattttatatatatataaaatatatataaaataagattttatatatatataaaatatatataaaataagattttatatatatataaaatatatataaaataagattttatatatatataaaatatatataaaataatatataaaataagatttcatatatataaaatatataaaatatatataaaatatgattttttatatataaaaatatatataaaataagattttatatataaaatatataaaatatatataaaataagattttatatatataaaatatgattttatatatataaaatatatataaaatatatataaaataagattttatatatataaaatatatataaaaatatataaaataagattttatatatatatgaaatrtaaataagattttatatatatatgaaatgtaaataagattttatatatttgaaatataaataaaataagattatatctaaatatatataaaataagattttacatatatgaaatatatataaaataaggttttacgtatatatgaaatatatgtaaaataaggttttacgtatatatgaaatatatgtaaaataaggttttgcgtatatatgaaatatatgtaaaataaggttttgcgtatatatgaaatatatgtaaaataaggttttatatatataagcaartctttgctacataataattcaacacatatatatatgttgttttatatatatatatatatatatatatatatgtrtgtgtgttgaattattakgtagcaaacacttggaaccaacccaaatgtccctcagtgatagactgggtaaagaaaatgtggcatatatacaccatggactactatgcagccataaaaaagatgagttgatgtcctttgcagggacatggatgaagctggaaaccatcattctcagcaaactaacagaggaacagaaaaagaaacactgcatgttctcactcataagtgacagttgaacagtgagagcacgtggacacagggaggggagcatcacacaccggggcctgtcagtaggtgggaggcaaggggaggcatagcattaggacaaactcctaatgcatgtgggacttaaaacctagatgatgggctgatgggtgcagcaaaccaccatggcatatgtataccaatgtagcaaacctgcacgttctgcacgtgtatcccagaacctaaagaataataaaaaaaatttcaagtttgaaaaattcgtttgaaatattaaaataatgaggtgattttaaggaaaaygcgtaataccaaatgatacktgcatgatgatatgaactatgttacaggtatacatacatccaaagactcgagtttcatttaaaaaattaagggtttttttcctttattagggtgatgagatgacagaratttcatcctaacatatctataatattattaaaatgttttataataaaaacaaaaaagtaaggtatatggttcccaacaaattaaccttgaaattctttcattatgaatttcctgtaaacttttcatccacttgataaaatgctgatattacagaaacgtgtttcacttctcatgagcacgtgcttttaatagattacacaaactccaaggatttyacaatcgtttatcagcacaytgacatttaataggaagagtaactttatgtgaagctactttttgtcctaactkwggaactgatattaaaaggcacacttgaacagtgtgagttgttcactgcctgctaatgaaggctcatgcaagtatgtatgttcacgttactaaaaaattvcaatgattataaccagagtaagcagctgaaataatctggtaattttaataataaatgcttttgaagcaaagtgggttcactgagggtaatattttttgtttcagtttgctagttacgtgcagtgcagagagaaatattttattttccaatatgtaacagaagaatttttaaaatccctactttagtgaaccacaaagttttcttgaggcataacctaagatataaaatccagtcatcttgaaaaatatcttgcctttcatttatttatgtaattttaaatacggcattatgtatgtaatgagcaccttcaggaactctctgatccctgaaccaaagagatcaaaagtccacatcatggatctggcttggatgagagaagacagatgatagacaagacaaataaggaatatatgtttttgggggaaagaaaatgaagccagggtggggaagacaaagccccaaggggttgtaggttgaaaatggatgttcaggaacagtcagcttgcttgcttgcttgctttttctttctttccyttttttttttttttttttttttttggagacagagttttattcttgttgcccaggctagagtgcagtggcctgatcttggctcactgctacctctgtttcccaggttcaagcaattctcctgtctcagccttctgagtagctgggattagaggtacccgccaccacactcagctaattttttgtatttttagtagagacagggtttcatcattgggccaggatggtctcgaactcctgacctcaggtgatccacccgcctcagcctcccaaagtgcaggaattacaggtggtctgcttttttgagtcagactttaatgacggcctgagtgagacgagaaggcattcaggggctttgagcatgggagtgactcaatctgccttactttttaagaggattcttctgggaagtgtgtggagaattaattcaagaatgtaagcgtgaaagtcagggagctattaaaatcaacaaggtgaggccatgctcaatagctcatgtgtgtaatgccaaaaatttgggaggctgaggtgggtagattgcttgaggctaaagagtttgagatcagcctgggcaacatagtaagactgcatctctagatgggcatggtggcatgcacccgtagacccagctactcaggaggctgaggtggaagaatcacttgaacccrggaggtcaaggttgcagtgatgtgatcacacggctgcactccagcctgagcaagagagcaagaccttgtctcaaaaaaaaaaaaaagaaatgtcacggtgaaagggatgatggggcttggacaggatgctagcaaggaagtgacaagaagccctcagtttctacatagygtttgaaaacaaagcaacaggrttggatgagagattggatgtagtggatgagaaaaggcgaggaaaagaagacctctaggtttgcaccatattagaattctaagcaggggtgttgttasgcagtgcatataygggtytgtagttgagagaygagctatgggcaagagataaagacttaagagtcatcagccttctagattatatttaaagcaatgaggctagtgagatcaccaagggagtgaaaataggagagaaaacagaacagaaactggaccctggctcactctgctgttgagacgttggggagatgaggaggaatacccagaaataaataaaactcccctggatgtgctatctcagtgcaatcatcagtatctctcttctcaacaaaaaaccrtgagcatgaacaactttcatttatgcactcagggactttcatttttatacatttattactgccaatcttgcaaggttttatttctgcttctaccacacaggaaaaacaacttaaattctatgtggcaggttatggatttcttgcaggccacgaacttctttgttcttttccatgaccctgactgcttcttgtttttctcttgcagcgtcaaaaagttcttccttgtcttttgtgctgagtcttcttcctctactcacccactgaatatcatgtttttcaagtttatgtgtgtggtgtttttttttttttttcctgaaaaaaggtatcttctactgtttgactttttccctacgattctttgttaaaatgctgtgttttagatgctattaatttgtcctctctcttaatgcccttggattttcctcttaattgtctgcaccattgctgttacccaaratgcctggctggagtagataaaaataagccgaagtccaaaaattggaatagaatggaaggaatggatcaaaggaaatcaggagtttttgtgcagtcagatatgggtcttatagatgagagcggtctaraaaagcagttctgggctcarattgcgtgactgtgctttgccggcatattcctaactatatcacatattctccactatacagtaagtagatgataataataagtgggtatgataataaatagatgatgtaaatggatgatataaccacagtgaaaatcctggaaaaagaaaagttaggttgctrtagaaaatccacgtttgtagctagttgtgttatgtaaaacaaaagctgatgctgagattgagatctggtttggctatattggcttgatcaggacacaggcagtagttcaagccatggaagtagatgagattctcagagagactgtgcagactaagaaaaaagaaagtaacatcagaaaatgccacaaatcctatggcttcattatctctgatgaatgtgakctttttttttttctggaaaatatacataccaacatttcgtgcagttcatgataaaccaatcccttttgaacattgcccagaaagcaaacagacttcccatggtgcacaaatgtagccatagggaatattgttcattcctcattgcactgagtatgcttcagtgttcacctsccttctggcccactacacctgtcaggggtattttatagactaaatagtgtcagttagtctaaatcactcatagacatgtactaggtggttttcctttttcagagattaaataaatcttcccaaggtaaccacggtttaaaatatagtaatccacaaaatatttattatcacttctatatgctaaaaaaaaataaatcaaaggttagaaacttaaagaaaaaacaaaatcaagcttcatctctagttcaaagtgaaagggagaaaagcaaaatgtttcataaacaatatatattgtctcactaataatattaatccaggtcactactgccaaagcaaacaataaatttttacttcatttgtatagatagtaattcaatgttatattttgggtaggttgtgaaagccagatcaatttatgcgatcagaaaaataaaggaagaaattgatgagtcggatgctaccggctacatgcctctccagcctcttctttttgaacctcctttgtacctgtttagagaaaaagcataaatagtgtactaccaacctaactaaggttrttatagtctgtttgtttaaaataccatttttttctccttttgtctttttcccactctcgaaggtactcaagaaaattgaacagatgtaatagatsaaattaaaacattttatttcctgaaagccttttttgcctgttgtaatgtgcaggacccctctcctttaatgggagagacaggaagttacstgaatctaggctgaaaaggttatgtgaaaagaaagtataataataaaagggacacttggctttwtaaatctttgttttctcttaacctaagtaaggcatattaaaaataaatgttaaggtgaaaaataaatgttgtctttatgaaaaattaaaactgctctcagttccatattgttcataccttcatgctttttaacatgatattwtccatcctggaatgaccttaccccagattctgctcattttcaaaaccctgattcattgtcatcwtttctgtattcctaccttgattacccacttccccaaaagagttaatcactcacttttgtactatgcctgtgccatatatatatatataattatatwttatataataatataaatatatttaatattatatattgccaattctatgatatataaaatatataatatataatatatttgccaactaatataatatataatatattaacataatataaattacatataattatacatatatttatattatatattatataattgscaaatatatatggtattacatataatataattgggaaatatatatttataatatatgttatattaatatrataatatatttattatattatatattatatatattatatatttgcctattatataatatattatgtaatatattaacataatataaattatatattatataatgtatatataaatatgtattacatgttatagatgtaattatataatgaatatttatatctatatagttattcatctattcatrtatgaatattcagcatattctatttattcagtatattcaatatttatttaatatattcaatgttccaggttgctttaggctstagtgacataatgtggacaaaagcagacatggtccctastcgttcagagttcagagtgtaaagatgtttatcagattcaaaagtcttcagcttttttcacaaacggtcttacctggtagatagaataatctgagctgtttattttgcatttcagtaaaaatggaggcagaatatctcaaatgtgaggatcaaagccataatcaaacatgtggagaaggggccagtaggtagcctgaaaggaaagcttttctggttatagacatrcactacataataatgtttcagtcaacacaggaccatatgtatgatggtggtcccataagattataatggagctgaaaaattctatcacctattgacctcatagctgttctaagggaataggaaattgcattactcacatatttgtggtgatgctggtgtaaacaagcctactgctctgccagtcatttaaaagtatagcacatacagttacgtaagtatttaatacttgataataaatgttaatggtttatgtatttaccatattatacttcttaatcattattttggtgtgtactcctcctatttataaaaaaagattcaaccataaagcagcctcaggtatgtcctttaggaggtattctggaagaaggcaatgttatcataggagatgacagytccatgcctgttattgtttctgaagatctttcagtgggagaagatatggaggggaagacagtggcattgatgagcctgaccctgtgtaggcctaggctaatgtgtgtgtttgtgccttagttatcaacaaaaaagttaaagaagtagaaacattaaaaaaaaaagttaaaatagcttataggataaagctgtttagaaagaaattatttttgtacagctacacaatttatggtttaagccaggtgttattataaaagagtaaaaatgttgtttaaaaaggtttctaaagtattaaaggtactgtaaactarggctaatttattattgaacaaataaaattttttatacattcagtgtagcttaagtgtgcaatgtttataaagtctacagtgtttcacattcactcacygctcactcactgactcacccagagcaacttccagtcctgcaagtttcatttatccaattgccctgtayaggtgcagaacttcgtatcttttataccatatttttactgcatttctctatgtgtagatatgttagaaacacacatacttgccattgtgttccaactgcctacaggattcagcacagtataacatgctatataggtgtgaatcctaggagcaataggctagaccacacagcctggggtgggtttgttgcctagcagcagtaggctagaccatctaggtttgtgtaaatgcactctatgatgttcacacagccrtgaaattgactagcaatgcatttctcagaacgtatctttgtccttaattgacacatgtctatacataccaggtatacttgaacacaatttttgcgaatccatcttttacaaactgagttcaaagttaaaaagcattagtacatagttccaattgccttaaactatagggttttcgtttttcttttttttttttaaattatactttaagttctgggatacatgtgcaraatgtgcaggtttgttacataggtatacacatgccatggtggtttggtgcacccatcaacccatcatttacattaggtatttctcttaatgctatccctccccttgcctcccaccccctgacaggccctagtgtgtgatgttcccctccctgggtccatgtgttctcattgttcagctcccacttatacgtgagatcatgtgatgttttgttttccgttcctgtgttagtttgcggagaattatggtttccagcttcatccatgtccctgcaaaggacatgaactcactcttttttatggctgcatagtattccatggtgtatatgtgccacattttctttatccaatctatcattgatgggcatttggattggttccaagaatggcgatcattaaaattcaagaaacaacagatgctggagaggatatggagaaataggaatgcttttacactgttggtggggtgtaaattagttcaacsattgtggaagacagtgtggcagttcctcaaggatttagaaccagaaatgccatttgacccagcaatcacattactgcgtatattcccaaaggattatgaattattcaactatattttaaagtgaattttgctaagttttattgtcatgtcagttttttttaattatttggtttttttgttcatttgttttgcttggtgagtaaaactgctctttaaatctaataaagggaggaaatagagaagagtgtggatctaaataatccagtttggcttcttacaatagttcattttcccagataattgtttatttattttgctttgcctctacctgagaaaggagaagatttgggttctatgcctaccycccttcattcccttyctccacagtggtcagatccattaaagaacagagtccttggtcagatcaacatagsattcatgamaaccaactctcagaaaggaggaatatgcaacgactgtcactgcaaacttccaaataaagaatcttcttagtgatattttcaaaatatattgacaggagttgagtcatatccttgcatgtcactgcctctccccacagtgggatgaacatttgcatctgaatgatcgcccttcatttcctgagctggatttgactttgctgtcctaaagatgccagtgcactcagttagaactgtgctgtgctaagtccattacacagcattcaagaaaataagaaatgatcagaagatgttggctttatgctaaatttgtcaatcacatgaacggaactgtgtccaacaaaagaagtcataatcaccttttatggaaaaggttcttaaaatgtggtcctcagaccaattgcatcacctcttgagaatttgttggaattgcaaattcttgagcccccaccccaaatatcagaaactctggtggtgaggcccatcagtttctttttatcaaacctttccaatgtttytgatacatgttaaagagacacaggaacatttttaaaagctgcttagtatgcacataaaatagagattatgctggaaaaggtacaaggacatatttatatggctgccaatgtaaaatgagaaaagctctggaaagtgaaagagtgaatgagagaagagagaagggagagagagagaaagaagggagagagaggagagagggagaaggggagagagagagagacagacagagagaaagagagagaccgggtacaatggctcacacctgcaatcacagcactttgggaggcagacttgaggtcaggagttcaagatcagcctggacaacatggtagcagtgagctgagattgcaccactgcactccagcctgggaaacagagtcagtgagactcygtctcaaaataagtaaataaataaataaatacttttttttttttttttttttttttgagacacagggtttcactcttcttgcccgggctagagttcagcggtgcaatgtcggctcactgcaagttctgtcttccgggtacaagcgattttactgcctcagcctcccgaatagctgggattacaggtgctgccaccatacctggctaattgttttgtatttttagtagagctgtgtttcaccatgttggccaggctggtctcgaaatcctgacctcaggtgattcacccatctcagcctcccaaagtgctgggattacaggcgtgagccactgtgcccggccaataaataattttcttaaaagatccaggaaatatttatttagtccaaatatgcaaaactatttgtcctaagggaaattattgttttttcagcaaatagagtaattaaaataatactaaggaaattccttatttggcagttcgcaatgacaatttgtatgtgcatcatttctgagaactgttttttctgaatcctatgttgatatggacaaggactatgttctctaayggatttaaacattgtggaggaagaggatggaggaaggcaggcatagttcccaaatcctctcttttgtcagatagaggcaaattaaaacaattatctgggaaaattgacttttgtaagaagtcaaatcagatcattcagatccagacatttctttatttccttccttttactctattaaattactgattaaatcattttacaagttattttctgtcacctgtaaaaaacttttcagctaagaaagaagagatacctctttttccacactcaaaaaacacacctctaaaaatagacatacatgtttgtaaatagaaagatacatgagagggttccacatacatctgtctttttacgtgaaagttaaaacttatgggtaagtttaatacattgctgtatatgagagatatacamatttaactaattatggtttttttgctaaaattaaatgttatttattacagattgtgtcatagaatatagattccgtttcatttttttttaaatgctcatcatcactggccatcagagaaatgctaatccaaaccacaatgagataccatctcacaccagttagaatggtgatcattaaaaagtcaggaaacaacagctgctggagaggrtgtggagaaataggaacacttttacactgttggtgggactgtaaactagttcaacccttgtggaagtcagtgtgkcaattcctcagggatttagaactagaaataccgtttgacccagccatcccattactgggtatatacccaaaggattataaatyatgctggtataaagacacatgcacacatatgtttattgcggcggcactattcacaatagcaaagacttggaaccaacccaaatgtccaacgatagcctggattaagaaaatgtggcacatgtacaccrtggagtactatgcagccacaaaaaaggatgagtttatgtcctttgtagggacatggatgaagctggraaccatcattctcagcaaactatcgcaaggacaaaaacccaaacaccgcatgttctcactcataggtggaaattgaacaatgagaacacatggtcacaggaaggggaacgtcacacactggggcctgttgtggggtagggggaggggggagggatagctattaggagatatacctagtgttagatgacgagtttgtgggtgcagcacaccaacatggtacatgtataatatatgacagacctgcacgttgtgcacatgtaccctagagcttaaagtataattaaaaaaaaaaaagaaaaactgaatagattccatttcaaactgaaatttcagtttaaaacattatgcaaaagagccctagccatttcatgtggaattaatatatttttccattttgtttcatagaagtatggagcagtgggatcactttcacaatcaacaggaggacactgatagctgctccgaatctgtgaaatttgatgctcgctcaatgacagctttgcttcctccgagtaagtagagggggatgggctgcccatggaggttgttcttagagttattgacaaaatataaaattatagtcttgagacttaccttaaatgtawgtggatgttaaaataatacttatttgaccaacaggggtattcttgagacagaataaaaataagcttaaataaaagtaaggcagtattatatgaaattaaattaatctacaacattgattgagccttctggcttcccagctacaatattaggttctggagataaatatgatcctagcaccgtgagctaatattcgaaaatcatgggtggtaggtgcctgtattagttttctagagttgttgtaacaaatgggaggcttaaaacagaaatgtattcgctcacagttctgagatgcagaagtctraaatgcaggtgtcagaaagaccatgtgccctttmgaaggctctagagaagaatcttcctgtgcctcctcccagcttctacgggctmctggcagtccttagtgttccttgcctctgtagctgcaccactcatctttcccgccttcttygtatggtcttctctstgtagctatttgttcttttcttacaaagacatcagtcattagattagggttcaccctaatccaatatcacttcattttaacttgattacatctccaaagaccctatttccaaataaacttactttcactggtacctatggttaaaactttaacatatctgttggtggcacagaattcaacccatatagcagtggtgaaacatgtttgcacaggttacgacaacagctaaaaagtagcaatactcagctgtatctcaacaggatcatttaagatgtcaggagaaagttacttataattctgctaaacctcaaaatataaatacatatcgctaaggggatgggtggaggcagaaaagaaagagaagatatttcagtgtgaagaagcagcatatacaaagttaaagcctcatatatgagttcttacatagcaaacctgaaatacagacctcaactccagggcacagtggatcttgtgctctgtgtaaaggatggatgggaggatatggcacaagtgagacacatgtaagaaaagataacagtgagggctgttacagacagaaatgatgagagtttgaagaaggaggagagagacatcgggagcagagaaaaagcaatcaaaatgtttgagagctattyaaaaggtagaatttacatttgtgatgataaattagagatgagaagatgactcctacttttcaggcttaatcaacctggcaggtggactatatctccacttgcttctattatgggttctttttcttttttccttccatcttttctttcctttccttttctctcttttcctttttttttttttctttttgagacagggtctcactttttcacctaggctggagtgcagtggtgcgatcatagcccattgcagcctcaacctcttgggctcaagcaattctcctacctcagyctcgtaagtatcttgggttacagggacatgctaccatgactggctaatttttgtagtttttgtagagccakggtttctccatgttgcccaggctggtctcaaactcctaggctcaagccatcctcccgccttggcctcccaaagtgctgggattacaggcgtgagccactgcatccagctcttctcttttctttactttttaaaaactgtctcttattttcttttcaataccttaaaataaaaaagtttgtttttaatttaacaatttgcaacctgaaagcaacatttactttttttaattgatcaatgaaagcaatgaccatagaaaataaatttttaatgaccattgtattcaactaatcagagaaatgacttcctcatctactgtttcccctttatattgatttgtctctactacaattaatatcccattatataaatcacagtgccatataaatgcatatgaataaaaggttactgttattaatatgttctgaaatatagagagagtgggcttcattgatccattctaaagattagtaaaaatgtgaatcactttatttcatttttcttaaatattgtttacactgtattcaaatcataagaggtatgcagatacaaaactattgagaaggaattgaacaagaaaattattttaacatcatagtcattgaaaataagtatttgccctatctgattttaaaatattaaaaaattgcatagttactttagaaaattttattgtcacccagaatattttcccatatgaacattgaataaaatttatgtttgtatatgtaagtgtygatattaaaatttaccagctgattccaaaagatcaaacaagcacaacttgtagagcacagtaactttcttgtagatgtttagtgagtggataagtcagtcaagtgcctataatgatacctggattggcttttcctgtgactgtccttttgctttctactgcaaagatgtggaacatkttttcttcttttttattccaataggcttggtagtaagaatataattggagattaaaacaattttaattatggaagaagacaacactttctaacagtaggctgggcttttttgttttattagatsctaaaaacagcccttmccttcaagagaarctgaagtccttcaaagctgcactgrttgccctttacctcctcgtgtttgcagttctcatccctctcattggaatagtggcaggtaacgtaacccagagttttgaaatttagtaactcgtcccgtgaattattcattgccaaagcaaaaaagaagcattcagtcttttgtatatggtacattcataaagaaaatactgcattacaaagtgtccttcaaatttgttaagttaaaaaacagattccgcaaagttaagtagaaaaaaatagtttttaaattagaaaaaacaaaatagaatggaaaaaaagaagtgcaagataaaaatacagatttgtaatagtaaaatgaaaaggacrctctttcaaaaatatattatcctctagagtcctctccttctaatgtgggtgacaaattttaaaagtattcattttgccaatgtgaagaagtaagatgatcatttacattaacaatagctataatataaaaaaaaagcctgttgtccaggagaagctcttctattcttagtactgagagcagaaaaaatatttctgtcagtttttaaagagaggagactttgtagaataatggcctacaacttagtaaaatccagcttatatgaccacatttttcatagggatattatttaaaatatctctaaaaataacctgatagtatcttctcaaagaaaaaatatacaacgtgatacttgggctcaaaatgatgttcctgaggtatatatttctttggagggtctgacttgaaccggagatagatttgactgtttctacaagggtagatagcttgtatacaccgtaagcacttatgtaaatattattccccgcgtagcattttggatggatttgatgtatttcgattggcatttgaatttatatgccttatagctctcctcttctctatatgactgataaaatgtctgcccatgtgctctaataagagataggctgggaataagatacatttttatgtgcatactaagcagtttaacaacaacaacaaaaaagttmmtaaagaccaggccaaagttcctctgctacagggcagtctaaggaagtattccaagacagagcaaaaattccactaagaaagaaataatgaaaacaataatacacccttacaattaacctctctacagagactgtaattattctcattatccacataagaaaattcagacagctcagtattggagctggagttcccatccaagacttccgaaccckagttactctggtctcttgtctcccagtttaatcaagtctttataaaacaacatggttggccaataaaaaaacaaaaaagtcagctgggcacggtggctcatgcctgtaatcccagcactttgggaggccgaggcgggcagatcacgaggtcaggagatcgagaccatcctggctaacatggtgaaaacccgtctctactaaaaatacaaaaaaattagccaggagtggtggcgggtgcctgtagtcccagctactcgggaggctgagccaggagaatggcgtgaacccaggaggtggaacttgcagtgagccgagatcgcgccactgtgctccagcctgaggggacagagcgagactccgtctcaaaaaaaaaagaaaaaacaaaaaagtcaccacaggaaaatattttcyagaggtaacaattaacttctttttggccattaaaaatacactaaaacaaaaatccaaccataacaaccaaccaaccaaactattgttgtytgagtaaaaggacctgacacgtttggcattaaacaatttcctggtaaatcaaggttatctgtatgtttgtttatgtctatgcttatctgtaatttgaaatgtataactaaatgatgcttcattgttgggattattacatataaaccaattagaatttgagtagatttcatcacctttatrcaaatcactgcctgcagtaccagcaccagggaccgcagcttctgataggctcgtgcagagtgcagacaggagtcggaaaataattcaaggttctaaccaagttcaaagtccccgagctattagaaaatactaccaagtcaacacatttattctggagtttacaatgattgatttgaagtagtttgtttactgaaactacagtaggtaccgactaaaattgactagacactaagaatgttcaaattttataagtacacatcagtatcagattcaccagaatttggaaaaggcctcactatgtttattatgtattaacaataaacaattcacaatccacttacaactttaattaagttgtagatcagtatatttttcaaaaagaaactaaaaagcaatatatatctctacttggcataaaaaattacaaatgtagacagaatatatccctaaaatggtagaagtttggcaaatatgaattcatgggtgaaatagaatattatatataaaactctgtgaagtgaattatatattgaggggtattttcttaattataaggtttattccatttacaatcttttcttaaagaagctgctgaaatactgtcagagtgtaacaacataatactgtgtcagaacaataagataaaaatcaagaatttatgtatatatatataaattgttactgaaatactaaaaattctttagctgaaaacaatatccatttggggtatgaaaagataattccaatatgaaagagtagatatgatctgtagaatcaaatataaccctgtccgtaggttgttgcacagaccataaaattctgtctcctttcatatgtgaaacagaaaagtcacaaaatgccatctctccaataaaaataagtgaacttttgaaaatataaatcctggcattctttacctagatatatgataaaaagttaacattttatagaaaaattagttttcactcagggttcgatgaaacaggcaatttgtgtttttagatctattaacaaaatgtagcatttactgtcacctcatgtttaacttgttgtcaaattaaaaatagttggtcatatgaccttagtcacattggggcttctctttccatattgtgaaaaatattagctttactgatacaaaataaatcttatttccagtgaaagtaaaagtatatggttgagcaatcagagcaatgtgcatagtaaaataaagcagagagatgactgtgttcatatgaacatccaactccagaaaaagatttttatcacacaatgctacttccccatagttaatcaatattgggcatataggtacctgaatcacacatcttgaatccaaatattaatcatagcaaaaacctgaaamttttcaagtgcttattacatgccaggaagtggtctaagtattttacatatagttcatttaattatttggacactgactattagtaccccatttatacaggtggtgaaatagaggcaataacagattaagtaacttgtccaacgccatagtttataaagggcagagccagaattgctaacccaggcagttctattctagaatctaaattcttaactgctacttcaaaagaaataataatcaaaaaaggacaacgttagaggaaaattttgaagtaattttgataaaattgtttatttgggctcctcattgttacagtcaaattccattcccaattgttcttttattcccagagtaactcaagcaatactttccacatagtatataagaattaaatcatrgaattaatgaatgcatggatgaggctgtcaacccaaaacttggtccccacaatgaatttaataaatgtgatgagatacagttaagaaatatacttttatttccaaggtattgatacgttaagacatgtagagtaacatactcaatacaaactctattgtagatcacatcaaaatattgtcatattttgttatttcacataagctaatattaaattaataaaacaaggaaaaatatggtatcatgtattttttgaaattagaatttaactgcatatttaggatgacactcttaatgtaataatagctacagtagtaatgcttatcaaacagcttctttttttttttttttttttttgagacwgagtcttgctctgtcagccaggctggagtgcagtgcagtggcacaatctcggcacactgcaacctccgcctcccsggctcaagcaattctcctgcctcagcctcccgagcagctgggactgcaggcacccaccaccacrcctggctaatttttgtattcttagtagagacggggtttcaccatgtttgccaggctggtctcgaactcctgacctcaggtgatccacacacagcctctttaagtaaaggtagtaaatacggtggactctgtaactgagataatgtctctcatgtacaaggcactttagaggaatagatatgcctatttaattagtgttcagcaccactgttgaggtaattgttacttttacaaattgagaaaaccaaagcaaggagagcgataagtaacttgttcagagtagcctagttggtaatggaggagtgtaggaagattctagaatcagggaactagatcctatgtaaacaccaagctgttagttattgaacaaaatccttgagttaggggtagaactaaatgtttttcatgtgttgtttaattctcaaaaatctataaaaatggtactatcaccatatcacttttattagaaaattgatagactcaggtggagctgcatatatttttgagcaatatgaaattattctttttattgttccataattgtcaaatgcggaaaatcttatacaaccaatctaatatgaatatgactaacatacatgtagataaaaggtataaatagatacatatagagagatataggaaaacagaaaacctcagccatgactgaatagtgataagattgtgtttaacattttcctcattstctataattattcatgttttgtttttttttttytgagatggaatctcactctgttgcccaggctggagtgcagtggcgtgatctcggctcactgcaacctctgcctcccaggttcaagtgattctcctgcctcagcctcctgagtagatgggcctgcaggcgcccgccaccacgcctggctaatttttgtatttttagcagagacggggtttcatcatgttggccaggatggtcttgatctcctgacctggggatccacctccctgcgcctcccaaagtgctgggattacaggcatgagccaacgcacccggcctatttttgcataaaaagttaatgtttaagccttttatttttttgaaactagaaaacatattgctttagattatttcagaatgataattagattgtttagagaacatatgcccatttggggatatctatcagcagctcagtatgttcctaaaatactattttagaatataatttttttttaatttgggaaataattaatcacaagattgttcatcaaaacattggctatattactgaaaacagaggcaaactaaatgcagctattttttaaataaatctggcagatccatacatatactacaatggagtttttaaaattatttttgtagaataatattaaataatataaaaaagtacttatgatagagcattacattaaaaakttgtttccagattgtttaaaaatgtcatattttaagataataatatgataagggttgagacacrtacaccaaaatcctagagtttaagctaggatggtgagattcatggtaaattgtttttccatattatgtatattttctaaattttctgctgtgaatatatattttataatagttaaaaaggagtcttatgagaatcgtacctttataaagtgaaaaaatgtatttgcccaatttcctgctccaccaactgtgaattaggtctgtattaactgaaaatgacgcttttctggcagctcaagtgaaagaatgaagaagataaaccaacaatttatccatattatgcatgacaccactatttcaccacttattgcttttgtcatcatcatgattatcactgccattgttaacatattcaacatgcttacttcagaaactgtattaagcattagtccactttattctaacagcagttctgtagacacatagcctttcataatctatagaatttttttttaattggcaaggccaaaatcaatggccaagaagattcatataagcagcaattcagaaagcatgatataatcctggaatcatcttaacgtaaaataggaaagggagaatgtatgcttctcagcaatatacgtagcgtagttcacacgttgtagattaaaaaaaaatactcgatttagcctagcattcaaaatgttggaatggaatggaataaaatgaacggaatggaatgatatgggatgggatcctgtatgcattcaaggatcasgccatgactggtttatttttacttaaatatacagctcaactcctgaagtgggaaacgaagaattgctcagttagttcaactaatgcaaatgatataactcaaagtctcacgggaaaaggaaatgacagcraagaggaaatgagatttcaagaagyctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatakatgaaatctccaagtccttaataagtttgaataccacattgcttgatttgcagctcaacatagaaaatctgaatggcaaaatccaagagaataccttcaaacaacaagaggtragagtttgtggactgcaaggtcacttgctggaactgaatccatccaagtctcgtctccttaggcagtacaggaaagcaaaagttgcaaaccctgtttcatcatcctgtttaccctgatttctatggctaacttatccagattttaaacgaatgttaagggatttaaaatggattcgccttctctaaactcttagaaaaaggggaaatttttcccattgaatatagactccctttacatattttataaatactgttaaaatgtctttttagactgcctaaaccaatcataatttttaggttatcttagcagatcttgagaagtgaacactctgtatgtgtgaattttgcaacagacatatttgatatgcttagatttttttttttatttgtaagtttcactcagaacttttgaacttatacatggtcctcaccttaaggtgtcagaagacaatggtattacagtttttgtatggggagtctgttggtgaacctcatcccaacatgttgatattccgtttctattccatgtcacgtctaaaatctatcagtgtttcctacattgttaataagtaagcatatcaaagggtattgggatatcaaagccttgggctatagaaagattagagaaagtgtacaaagaagaaactgtccatagttttgaataatataagaaagacagaaagcgaaaatgttagttatcaggatagacattgattaagttgaggggaaagaagaatggagaagaaatactatttatgtagaaatagggtcagaagagcactgagatgaggtaaggacagagggaaggtggatgagatggaagaagaaggatacatttgattctggcagtgcattaaatcctgcagagaccatggaatgtttttgtttgtttgtttgtttgtttgtttttgagatggagtctcactctgttgcccaggctggagtgcaatggtgagatcatggctcactgcaacctctgcctcccaggttcaagtgattctcgtgccttagcctcccatgtagctgggatcaaaggtacgtgctacctcacccggctaatttctgtatttttagtggagacagagtttgcaccatgttggccaggctgatctcgaactcctggcctcaggtgatctgcccgtcttggcctcccaaggtgctgggattacaggcatgaaccactgcgcctggctgaccatsgaatgcttttgaacccaaacatgaggaattgaaagcaaattggaaactatctggaaggtggtagaaattttgaacctgtttgaagtgataattaatggaaacgatcaaaatctggtgatcagtgagctgtttgagtttcgatagattacacttaaattttggagggaattccagcattagaaaaggaaatgcaagggaatggtgaaagtttgaaagctatatacatctttaaaaacagtagtcactcacagagacttagaaactaggtcagtgccagtgcgtgcatgtgtgtgtgtgtgtgtgtgtgtgtgtgtgtactcctgtgtacactgaaaaacaacattgggacgctcatccccattgcttgaataattttawtgacctttgaatctttagctcaatgtaggaataaataaattaaatgaatgcctgaatttgtaaatggcgtttgaggaaataggttataagtgacaccagcataacacttatcaaggacacaccaaaaattaatttgaaagaaagaggaagaacattggcascaaatgaaagacaggggtggcatttatcatcatccatagaggtgaaaaggactgtacgactacaaaattaaatgcctgtttctaggagggtcactggtggtagcatgtggagggagtgtgtggatgctatataggrttttttgaaattaaatacacttttcctcctcccagtgaaaataatttccactgaaatttgacaaatgtaaacaccatgtgcagttttcaaagaagggaataataaggcagcctcagctgccaggcgcagtgcctcacacctgtaatcccagcactttgggaggccgaggtgggtggaccacgaggtcaggagttcgagaccagtctggccaacatagtgaaaccccatctctacaaaattaaaaaaaaaaaaattagtcaggtgtggtagtgtgcacctgtaatcccagctactcgggagaaccacttgaacccaggaggtggaggttgcagggagccgagatcatgccattgcactccagcctgggtgacagtgcgagactccgtctcaaaaaaaaaaaaaaaaaaaaargrargaaaargtagcctcagcttttaggtatgatgaaaaacctggatgattcctcrtttctaggaagcaaaatcactgtctagtcacttaacactttatgctgaatgtctggaactacccgacatacttgcagcaatttttagccccctaaattaagtcaagtgtatttatcatggcggtgtgccctacaaacatccatgctcactatttcacctttattgtaatgatggtattgtacagaaaatattaaatggtcaggggaggaggaggtgcaagatagagaaattctaatctagaataaggttttgtttgggagaaggcacagttagagcaataaaagctggtaagtctctctgcttcagtatagtgtcattgaagaggcaaatctasacgcacattcatttattttcgaaggtcctacactctgaccatcttgatcctctcacctaagcttgtctagtctagtccagctcaagagagtgtaatattctttttacttctggattaaagaaaaacataccactggcttatttccccatgtgcaaatcggaaatgagtatctatcaactttagaacataggagtacttaatacaataataaagcatacaatgaagacagaaaatgggataaaagtagaacagagagacaaaaattattaccagaatagatgagaacatttggttcatcaaaaataaaaagcccaatgctgaaagagaaaaccaagcaaatgatctaaaagaaaaattaataaayattaatcgtcagaaatttaatgactggatactttaacctcactataatttgaaaaacaagttaagtaataatgatttgctatgtacctactcttactatgcaaacttaaatatattaatggtacccagtattcagctgcaaaaagtggacgctgatacgcagtaagaggaagaaaaatggtagcatatatttggagagtagtacggcaatggttgaacaaaaatgctgtttaatgtttagtccctttggtcaaatccacttcaggaagatgttctatagaagtacttatatcaatatacaaatatatttaaaatgatgttcatggcagcattgtttagttgtagaaaagtgcacagctcaaaacactatgaataggaatcctaaataaattttgagaaatagattcaattccactaaattactgaaaatatcagtctctaaagtattttaatagataaatatccttaatatattattgagtaaaatataaaagcatattccaggatataggtagatcctctgtctttttcacactcttaagtatatgaatgtgtatgtataaatatacacaaaatatacgtgtatttgaaaacacaaaatactaatgcctcaaatacagaggcaatgcaaactgaaagtaaagcactgttaatatgcgagttcgaggttttattgagtatgaaaatctattgtcaatgatcatcaccactgaggattatgacattaaacttcacttattactataaaacaatttccaatataaatctatcaaattcacgaaatttgactatgttgccactgtaagtacagtacgaagacattttacttcagataaattaagaccttatggtgtttatttaattttattgttagmattttgacatctatatatataggaatagaaacatatcatagatacattaaattgatttttgaagggggttgtgattgtaaacattcagccattcagtcaaaagaggaaatgtttcacaattaaagaattactactttcaaaacagttttctaatttctatattcttattccataaaactcccataatatgtttttaaaaacctgaactccgagggtttcttgaactttcatatttgataattatgtatgtaacaaaggctgtgaatgctcacttatgttttacaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactgaaagattgggaacattctcagaccttgagaaatatcaytttaattcaaggtaaaatgtcttgtcatttctccagaaaatgatatatatattaaaatatactgatacatgcagagatttgatatttgaaatcctatggtttgaaataaatagtttytgagcttacatttactgcaaatacccaaaggaaagaatatgaaaatcagataaagacagggtacgataaccagtagcctggtatcacttaaatagaaagggaaaagcaaaatatatcttaaggtctaatgattttctcattgttaaaaactacctcataagtactgaatacaagttttttgtaattacaagtttcttcacatgttcacaaaccaagcttgttaatattgcttttccaaaacttccagtcttttttatttcttacttgactgtattattaattaaaaggatcttttgaactctccaaaataatgatggatttgtccatttcttctgcagtgcctgttagtgaaataaggtgaattggatcttacttatatayataaataaaatatatgtatatatgctttctttatatatataggctttcagttttagctttacattttagatattttagttttagctttacattatagattttttctatattttgattttttgatttctatattttgattttgattttctatattttgatttcaaccatttgcatgtatttttctatattttgattgcaaccttttgcctgttggtattctttgttttaggttagtctcttgtaatgaatacttaccttttcttttaaaaaaatatacaatctgaccatctctttgcactgtatttatttccactatcttatcatgtgctctggttttttccagtttattttatgtttcttttgctttgctgtattgccacttttggattgattaagatttttctcttgctgaatttttctctctaccaaaattaccaaacaggtttcagaaactttgtagtatatttctatttcttattgattgttgaccttaacatttatcttgaagtctaaagttgatcagtatcttaacattcatcctaaaatacacaaggaactgaaagtgctttgatgatcctcttccctagtttcctgctaatattttagtacagtttattctactttatttttttttaatcgagaacttagtcaatattatttttctttttttatacagacaatcttgtggagccttaattagggaaaagtagtcaggctggtaggaccagggaaagcaaagagaaagaagataagctataaatctgcctttcttcttggtccagaacatgtaggtccctcctgcaagaaacttgtcaccagatacctgcaagttaacccactctaaccttggtttatcagtactgcacaagctctcttcagcatacgttataaacactattctataaaatcttcagcaaacctttgtttcctggcaatcagtttctcttctgctggcctgctcattgcctccttgcaacgtattttcctgcttttgttaataaatctgcctttctttatctacaaccatcttggtaaattatttaaccctgcaccactggctcagatagtcatcgctcacccacaacaaatatktatttaaatttgcgcatgaatttaccaattgttctccrttctaaaagcacctcgggcatttcttctgggattattttccttctgcctgaagtatatcttttggaagttcatttagtgaaagtaaattgatcaagaaaccttctgatttcattttctctattttgacttgatctttgaaattgttttactatatacacacttattaggttgacagttattttgattccttctatcagtgtgctgaaaaaattggtcccctggcttcaagcttttcttgtggctcttaaaatgactgccaccaatctgtttgtcattctctttgtctttcatatctgcagttttacttatctgtggttttgtattgataatttatccatctaacatttgctgtacttcttatattagtggatttatgtctatcagtttgggaatataaccagcttcattcactttgactattgcttcttcacgattctttctctcctttcctctgtaacttacatgaaattcatattggatgttctcattccagcttccatgtctgttaagctctatttcatgattttaatattttgtctcattttatatcattagcaactagaaaaatagaactaagaacttcatgtgacttcatttcaaatacactagtttgagaaaattaagaagcctaataatcaagtgatgacaatgaaaaaaagaataaaaacragtcccagaaaactatatatagacaatttttacttctaatgctcatagttagtaaaattatgtaaatttacagacacataaatatgtaatataatcattgttttaaaatttaagaaaatgataaacacaaaattcagggtaatatttatctatgaaaaggaaatagatgaatgagataggggaacatctaggtagataccgatttcttggattgtgatgttgcaagggtattctcattattgttgtactttatagcttgcttatacagaacacatatcatatatagtatttatcacaataaaacagatgataaagaaaaatttgaattaatcagatttttctctaacagttagatacctccactttggatttcaaataaatgtccgaagctttacaaattcaaaaccaaatccttgcttcytaactagccacccgcatctgcctccccaaatctgttgcgttttcagtctttttgttggttttgtcattttccaactacctgctcactgcctgatcttggaagctgtctttgacttccttgctctcattctctatgtaatccatttgtaagtcctactaattcttatttcatacaatatctcaaaccaaacttcttcttactctctactactactctaattcaagcaaccatatcccagtctggtgtattacatccgcttctcagttggtgtccctggctctgctcttagtccattctaaatagcaaaaaaaaaaaaaaaaaaatgctatttaagaaaacccacacaaattactggatgtgtgtggtttctctctttacactagatgtgtcttttctctctcttgcttaaatcctccaatgtcttctcattagtcttgggataaaatctaaacttctacttggtctgtcacctgtctacttctctgccctaattttctcaatcttccctctgtcatccttctgcctagcttggaaatgtggaagaatgaagtgccacgaacaagtaaaagttaatatagaaaaagtgcttgtttcatttcatgctgtccataatgaacactagacattttctctttctcttgaaaggttcttctctacgtctctactccttcttggctccacttgaagttacctcctccactttccaccattcttattctaaactcccccatctctctctaccatgatttgctttaatttcctcatagtttttaccactatatgaaatcatgtcatctctacatttgcttacttgtttagcttgtatcttctccagcagaatgtgagctctgtgaggttaagtcttctcctccttgtctacctctgcaatcccaatgcctgttagagtgcctggaaaatagtgggtgagcaattacatatgtgttgagtgaataagtgaaactaagacttttgtcttagcaagttacactctataatagcagtgtcattcttcctggtttccaagctatcaattttaattattttatatctcccaagaccaccattagttctcaacattctgtattctctgttcctttgtcatttctttatatcctcrtrtaaattattcttatgactctttgccagagttgcaattgtttcctgcccagactgtaatcctttttgcacccttgtagaatacagccttcctaaaggaagtcttagattgcataaagactctctgttgccccgtcattagacatacagttttgcctgtagcactcaaggtctttttcagtgtgtctcttaactagtcttgaatgcttcattccctcgcttgtcttttttgtatatcaaatatttcaactaatttgactgtgattctaatgtacccagtactttgtgcatcctgcctcatgtcttttcctttatttgaaatattttctctttgatttgtattcgaagatatcttgtttatcattcaaagtccatctaagatgccacctcttgcatgaagcctttgctggttctaccaatagtaaggcccagctgatacttatttctgtcttaatatggaacattaagtattctctcacaagagaatacttaatgtgatagttatgtataaaagtatctcatattctcttcgagaacagtgttcactcttcctggacacaagctacttccattagaaactgttctttatatctcttatagcacctagccataaaatatctattaattaarttataacttaagaaccatattttagaaattaatgagtgctttatcctttatcatgtgttgattgcagagttagtgtaattactttgtgttctcttttcccttatattaataatcactaaataattatacagttaaaagagacaaagattttttaatacatttctcaaatagttataataattagagccttaaagaactacataaaatttcattgtggaaatggtgaagtagagtttggtggagagttggggataacgtgatttaaagaagcaaagatgaactctagagaaaggtatttaagagaaataaaatataatatgactctgtggtgagaatagctaacattttgtttatttggaaacattttagatatattggcttcctaggatatgaaagcaccaaaaaagaaatattgatttttatagtagagaaaatgaaaaagcaactgagggcatttgaatttggagttttgtataattaattactgagattgtaacagctggactgtaggctagaagtggtggctcatgcctgtaatcccagcgctttgggaggctgagacaatataattccagcacttcaggagagtgagacatgagggccttttgagcccagaagttcaagaccagcctaggcaaagtagcaagaccctatctytgaaaaaaaaaaaaaaaaaaaaattaaccaaaggaaaaaaactgaattgtgagtttgtctaaccactatgtaaaggaaaaattcagctgaggaatawtggaagaacagatgtggaaaatgaagtcaattaaatttagaacatggtagcataggatcaggaaagaaatgaaattcttctagttctgatttaacccaactagctttaagaccttgagcaactcactctctgaccctctataaatatgtttagttaaacaatgtttaaagtgtcttccagattaaacatatctaaatcaatgagcatgaaaactagagaaaaaaaaaagaagcaggtttaggcagcaatagactagaagatgtggcagatttttatgatgatctgaatatgagacaagattgaaaacggagtagaagattaatgctcataatgaataaaaactagagaagcatmgctctggaaacttagtcagatattattagtgctatgttatcgtctgaggattttaaatgatatgatacacctgggtttgtttttctagtaaattgtgtaattttgttctatgatatwgatgattatcaaatattatatatcagtacttttttgtggttatatagaaatattacttttcctttttaagaagtaatcatggaggaagctacatagtagattttgtgcatgtgttgtataaaggtaattcttcatggcagattattgtgatagtatttatgaattattcctgtaactgtaattggaaatattaaagatgaaaaataatgtaaattctatggcttcttgaactagaataaatcatatattttggccaatattaacccattttttttgacatgtatcagcaagggagctgacaggtagcattttgtccatttattgatgcaacgaggcagttattatgtcagtatggaacaaaattttgaaaagactaaatggaaactacgaacaaaaggtgactacaagagactctaagtctttattcttttttccataatatgacagaataggttactgcatttccttaatttgatagagacattgcaaaacggattcttatcaaaaagaagaagaaagccaacactgagggaactaggaggtgaaacagataaaacacattcagactagattaaaaatctctagcaatagtccagctgtgtgatggtgaagacgtgagctacaatgggaatggagaggaggctagttttggaaggtggcaaggtagtggatagtgttcttaaaagttctgcatcagaaactaagagtaaagtggtatataatttgttattttattcccccaatgaatctaaaagacacttaaaacatttattgagatccttccaacattttgttagaaacagtaaaagatctataacaatgtacaaaaatgaaacataatgtgagattaatgttacatgaagaatagaatgacaataaaaaggtacattcaacatgcctagttagaactctaacaaaaatctttacctgtttttcttattgtaggattcgaataccaggtatcagtatttttatataaaaatacagagagggatctttaactccaaattttgtaaaataatactgatctattcgctgtgattgaactaatactccaaaattaagtatacagttcccataattacatgtaatataattgaaaggatagttagtaattaggagagttccttccatctcttacttaccaaagaaatggtgagaagtccatctcagaggctaagagtctagatctattctctgtgtcccttgtttcttcttgtttcatgttctagtttttcctggaatgtctgcgtcttgctttggatcctgagttactaaactgaaatctttgcttgcgcacttttttcaaaataccatccttgattactatccctgtgcttcccttcaattagctcaacaaaattcaggcataaattgagtgtctgtcctgcttgcccccctcccctgggattcattgctatgtagtgttgaatggatgcagctgcgttcatggttatgraagttaccataactccattttcttgggaagtactacattcttctgcagggaatagggggcacatagagattccctttgatacagaaatcttacatttcttgtgcagcatttaaatatatgtctcgcagcaattaagctataccttagaatataatacaccagttaatttctaaaagccctgtaacatgttgtttgcatgacgattatgtggaaaaaaaaaatacacgtacacacttaggaaagaaatggtaaagatctttagttaaaataacacaactacgaattatattcttcctcacgctttttctaggcttttatgtttcctataagtagagttgcttttataataaaaatacaattaaatgtgtgtccaatgttgcatatgargagaaagggacattctattgagaagagtaataatgatatcttgggcctctaaaacccaaattgtaccttgaaaatgggacataccagaggaatagacagaagtagagtcaaggatgtcaaaataagcaacaacaaaatgtacaaaatatacttattcatgagatawtctttatttatttatgtggttccccctcttagatttcttcgggtattatgtctcccacctgattaaaatttgtaaacaagtgcattctaaccagggatgctgtatatatttgttttccttggactatgtatgtgtccaaactagcaattgaaaatgcttcctttaaaatatcactatttccttattctgtggtgaatctatggaataatgtttctttctgtttctttcttctggtgttgaaaaggaaactaagtgctcttctttagataaagaagagattatttgtcctctgtactccatatggaacatggtgtttaggtaggattacctttgagttctaaagacatgctaggtataatcattttaaaggcatgatgagcaggtatctgttttgctggacacagaaaatacaaatggctaaatcagggttgtttagttacagctctcaggagagccacctgaaaaaaaatgatgagaccaaagttttccttgcaatgtctccattttgtttacagtatttatagcaacctagaaattctacttaatattttacttgaaaaaagaattcctctactcattttcaccttcctgcctttcctcatgcctttctcaatccctaggaattgtcttccttccccttcccttcattcttgaaagtacccctcatatcctactttctcaatgaagacttcaaccatcaccattcacgccgatctacagttcactgacaaatatctgagtttatggtcagttccaacaaagtgctttctggttgtctaccatgtgtgaattttcctttcccttgagggtatcacaaatgtcttttaagttcttacttatagattttccgtatagtagctaattctgtattatatctaactctatgtctaactgcctaggatgcgtacaacactaatgtgactttgtgccagcctgctgtcttttctctgcccccaggttctcagaacatagaaaagtgttaggcacactcacatttaatatactgttaggttgtttactttgaggcaatgtcatcctcattagtatagggcattatattcctgaatagcagaatactcctccattcatgaagttcagtattatacattctatattattgcacaacaaatagaagactttggatttccttatataagtaccttgacagatgactaacccatttttcctatgctttacaactatgatcagtaactgtaatttttttaaaggtcctsctggacccccgggtgaaaaaggagatcgaggtcccactggagaaagtggtccaygaggatttccaggtccaataggtatggtaattttagctatttaatcatatactgtgaagatagatgatatacatccaggtacatgtgtagrggaggattgctattttatttatatcctgcagaggatgtgtatgtgtgtgtgtgtgtgtatgyacgcacatgtgtgtatatgtgtgtgtgttttgggggattagtaaatgttctagtagcctaatcacataatacactgaatgataagcattactcatgactgttgaagaaaataaatgctttaaccagagtaaccaaayggaattgttygtaagtctagatagtgacatgtatataatagacagcaaacagtataaggcagacctaaccgtagatcatatgtgaaggggagtacaacaattatctttgcrttgaataaatcatcttcacatttgcaagctatctcatttttaagacataaaaactcacactagtagtgagttatgaatcacaagcaaattggactatatttcttatatagtatttggaatatatctgtttaaactaatgaaatctgaatgtaaatattggctaaaatatggatgacacttaccttgctgacagtcactctctgtgctttactaagagcaaaactgtttcaaattattttcctctaagttgtaatcttgaaagaaatattttgaaagaagacacagaagagagaacatgaactttctttgcttgaaaaaataaaaaagataataacatgattgtcatgttagccttggcttgaaatcaaatatcctgcatgccgtttgatggtaggaagtatactgcaaggtctaattataagtagaatggtttgtgttaccaaaacatgtctaaataccatgtacttcatcttatttttctgtcttttgattatataaaaggttcttctttctgatcagtgtattgactagccctggtcacatcagaaaaatttttgaaaatgagaagcatgaacttgatacctgcctaagcacatatatgtatatatatgtatataaatatatatggcatattatatgtgaagatagatgatatacatccaggtacacatgttttatatatataaaatagcaatcctacccatatatataatatgccaagtcaggtggtattagtattgatgtgcttttgaatgccttgccaggaaagaatttttattcaggaaagtctttctacttgactaatgctaatcagatattaacaatgctgcattaatgtcataagcagaggaaataaccagtattaaatctgctgccagaactaccattgtcaagggtctatcaccccctccatacaggctgcaattgtcagagctttataactcaaccataaaaattcagtctgggctacatcttgccatacagtgcttcatcttgggagaatcttctgcagctgtttctgaactgtgaatgtatgaaatagaaggatttataaatttcagcttgtgttaatgttataaatagacaccattgcaaagaatctttgattttgttttttttttattgtaaattaacgatttgtcatggtttaaatttacagggtaaaaagtgatgtcataatttgttgcttttggtactgctcatttacacaaataggcattacccagttcctcataaaagacagrtcgagttcctggggtaatcaatgactcttctaggttatcaggttaccattttgtttggtgcactacaagaaaagtattcaaaataccaggcatctttcctaatgaattatttctggatgtcttgctgcattctgttcgtttctccaccagattgtctaattgccttatatttgatgccgaaatcaggaagcaaagagtatatgatggacaatcatactaattctgctttctaatctgagcaggtttattgcttccccatctctacatccatttgagcctactaaactcagcttgaccaagtcaaactcacctagactcacaatcatgatgcgaatatctgcaaaacctaagtggttgtcctagtagcctcaaataactaatacattaaatatagtagaattattaytcatatactagggtggatattatgtttaaatatgctttattccccaaataataacaaatttattttagagggctatttccttgaaagcatgctagggagaatgacctatcacttttcactcaaaaactatgtgctgagcactttctccaggcctggtgttctacaataccctatagagtatgtgtaaacagatacagaatctctgaattcacagcgcttccaggatgataagtagtaatataagggaggcaaatgtcatgatcaaggattttttatctcatgtragtttcttttaaggggctgattttacccatgacaacaatgttttgaaggagaagcaactttcttttctaaaggaaactttgtgtgggccatctaagaagctgtttatgcccaatgtgatcaataacaaggtagtttgacctgtaggcatgggtggggctacctacatgagatgccctcgagagaactgaaggcttctctggctgcaaacttttcatcatcaaccagtactatttacttccttacgtagtctgaattttccaccataggaatcgtgcttccagaagagaaaataaagctcatcttacccatagatattggaagagaggaaccatattttattaatgtttatatccacgtatatctttaccctggcccgccccttcccataggctatggccccaagaaggcccctccctaaagcttcagcaaggacaggatccttaaatatacacctgagtaaggaatgttgcctggctgcaggctgtcgctctacacctgagtattgaaagtgggttttttctggaagtaacaaattgtgccagtgaatcaaaaaatgtcactgctaactgtgtacgtatcatttaataaaactaaatttagaagcctttacaacaggctggtaaaaataatgattgtattactgaggaggaggatgaggaagagggggaggagaacaagaaaagctaacatttacaaagtagtcattacatgccaggcacttttctaagtgttttacgtgtatgagctcttttaactatcacatcagcctgatgatgcagaaacaaataatacacccattttacaggtgcaatgcacagtaaagttaaatgacttgcttgaggtcaatcagcaactggtaagtggcaaagctggtatttgaaccccaatgggcatgagtgcagagtccatgcccttaaccagtctgctactttgcaggaaggagcctgaatggagcaggacacctaggacatgtgaataattatcagaccagctttatgtaagtgatttgatcactctggtctcatggaactgtctctaaaatgatggattctgacttgaygatgtctaacgtctctttgaacatcccatggctgagattccatgtaactgtacttatattgtccatgagttagaagcaggtgccagaccctttcccattgccacagattattgtagaaaattagttaattgcctcctgaaagcctcagggtatctgatcttatggaataaagttcaacagctgtgcttacattttggggactacattttgaaccatcattaaacaaacaagtcacataactccataggccatatagagtctgcttaaccatctccaagaacagaggtctatgactgcctgatttctatgaaagtatctcatatgcttcatttacagagttatttgttcattcattgaaaatgtacttgatttgtagttgaacatccttgatttttagttgaacagctgtgttctgagcatcactgtgaggtacttgagaagtcagcattggagksgcttctctgakgstcttatggccccaagatgctcctgtctaaagcaggcaacatggcattywctgccatgggatcaagtgagactgggtgaacgagttytstctgaattgataatgacaaaataagatgcctaaactgttacaatagtttatcaagaactactgaactctaggataaaatattttatttcactggaatataacattttcttttatatacagttgttatgatcaccatagtaatattgggtaaaaaaaayagccattttcagttttcatttaagcatatgaaaccctggatttgtgtaagtatatagtacatactcataagtaaatctgtgtatcgcatgtktgtgtgtgtgtgtgtgtgtgtgtgtgtgtgtttatgtttatgtttatttaccctgggattacaatgaaatatgtaagaacaggtccatgatagataaagtaatatatttcagagccaagacaccaatttattttataaaacactcgttgatactttacattgcttgagttgcatttttttctaaggcaaatcttaagaattcaattttcagcttatgcattttaaagttattatttcagctacagcaagatcctgccatttgatgattactggttgactacataagtcttttggttaaaactccaagatctatttttcctaatgtgcttttatttctaccaacaatatgttatttattgaatagctacaatgtgctgaatgtactaaggtttatatttatcgcttctattgtttttcaatgtcaaacattaaattttaggaaagatattattccttcatttgaagattctctaatttcatattcacttataaaactagatgttttcattatactctcaagtctgtatgaaaatgaattattaccttctttttttcttcgttaataatgtaggtcctccgggtcttaaaggtgatcggggagcaattggctttcctggaagtcgaggactcccaggatatgccggaaggccaggtattacaataatgtgtattttctttatagaatatgtagaagaaacaccagataattttatatatatatatatatatatatatatatatayacacacacacatacacacacacataatgttatatatgtagtatacatatttttaaattcttggatgataaaaagtggtcattgtgtgaatactagtattcacatgcagttattttgtggtctagaaatgatttctgaaatcagatttttgaaactgacttctgttcacccgaggaaagtctctatatcccaaaggaaaatcgtttaaaaaaacacacaggagttataaactcctcacaatcataaatcatcackaacaatgatatccgtctttgaacaaagagagttgaaagactggcaaagaaaaaaaaagaagcaaagtgtaaatacccgtttaaccacaactggccagactttgtgaagttactgttagcaaaatacagagaagtctgaaatcctatcctctgcaaaataaattgtctgccattatctactagtgcttaagaatcaaggttgctcagcattttgaaatstacacacatgatgatattatttccatcagctctgccagtagcctaagcttaaattgcaaactttgaacagcaatcttagaaagagctaggcttactgtctcctcatttcaaagtgaattatcatcaagagaatagagtcgggccaagtgcagaggtgagtacctgtagtcccagctatttgagacgctgaggtgggaggattgcttagctcaggagtttgagacgagcctgagcaacatagtgaggccctgtctctaaaaaaataagaaaaagaaaaaaaaggaatagggtccctatcattgaggtatttttaaactacattttatttttagaacagttttacatttrtagaaaaactgcacagaaagcatagagagttcccataaaccacccatgcacacatggtctcctctactattaacatcttgcattagtgtggtatatatgtaaccattaataaaccaacactgacatattattacccaaaatctataatgtacattagtggccactctttctgttgtacattttatgtgtttcagcagatgtataatgtcatgtatccatcattacagtattagacagaatagtttcactgccctaaaggtcccctgtgctccaccaactctattcctccccaccacaatctcttggcagctgctgatctttttactgactccatagttttgccttttccagaatgtcatatagttggagtcagacagtatgtggccttgtcagactggcttctttcacttagcaatatgaatgtaaggtttctctatatctttccatggtctgattgctcatttctttttattactcaatagtattccattttatggatttaccacaatttgtttatccattcaactactgaaggacgctttggttgcttcaaagttttaggctgggcgtggtggctcacacctgtaatcgtagcacttttggaggccaaggcaggcagatcactgaggtgggcggatcacttgaggtcatcagttcaagaccagcctggccaacctggtgaaaccstgtctctaccaaaagatacaaaaattagccaggcatggtggcatcctattcaggaggctgaggtgggaggatcacttgaacccaggaggcagaggttgcaatgaaccaagatcatgccactgcactccagcctgggtaacagagtgagaccctgactcaaaaaaaaaagttttagaaattctacgtaaagcagctataaacattaatgtgctggcttttctgtggacaggagtttacctaagagtgtgattgttggatcaaatggtaaacctatgtttagctttggagagtattatttcattcattcacccagttcacacaacttgatgaggggtcactgtgtgctggagataaatacagcacagctgcttttcttaaggagctggatacagaaaaaaaatgcataagcaattagctataatgccatgtggtaagtaaacaaccttggtgaggttggacaaattgctgtatggaagtagagagtaaggagtgattaattccatactgtaagaaaatgtgttagatagaaagtagtgtttgttagcgctggactaaaagaggcctagaatttctttaggtttgtatttctaaaactattgtaggtgttggaatcaccaggaggatgtgttaaaacagcttacaggactccaccccagagtttctgatgcagtaggtctgggattgggcttgcatcctcaccaatgtccaggtgacggtgatgctattggtccagggaccacattttgaaaaccattatgtttaggtggaaaaaaacagtgcagaaagagtaatcacgcacaaagaaaaacaacggcagaggtaataagtcccttgacaaaacatatccttaggacatcacttcttattaaaagacaccaatctggtagagatgtcagcagcagtgccaggtgctgttctagttgtactgcagastaaaagaaggaacagtacagtctctcctctacaagagtctgaagaaggtgctaaaattagaaataagtccgataattgtcaaatatgaaataagtaaaaacaggtccgtgatagataaagtaatatatttcagagctaagaccccaatttgtgatataaacactctttgatactttacattgcttgagttgtaattttttcacagcctggactatgtgaatgatatcaaaaacattatcagattctgaagcaaaaagttcaaaaagaacatcctccatctattytcttctattctccctcccacactccttttcttctcaccttgccctttccttctacatggattaagtacacactgctcgtaagggtacagtgctagaaacagggaaatgaagggtgaataagacagtstacaactgaaaagatacacaaacatgagaagagaaagagaagacttcacactttctccatgcatagcagatctatagagtagtccatttataagacctgatatatttacttcagaaagtttggaggatttaattgatgtgaaaccttgcccgtcttcaaaatccgtagwaggttctgttctaccttgttcaacatagtagaactttcagcatgcaaataacgtacttctgtctgttttgcctcttgaagtccattcaaagmcttattgtttccctcagggtaagttatggtcattttcaggattatctaaaatattacaccatatgtagttcatttattaattcaacacgtttactgaacattttctctctgtgattcatggagctatctacagacggttgaacacatgagtctgaagtttcgagtagaggccagagattaaaagacaaagtttatctatgattatataaatattattcagaaccactgattttaataatattttatgggtagagagtggaaaggtacaaagagaaggggcatagcataaagctttaagtagtkccagaagtacaggctgagatgaacaaagtagcaaatggaagagaagtagcccaactgaagaagaaaacccagagaacagagcatgaaaaaaggcaaacacagagtttcaaaggtggtcaagtaaggtgaagtctacaaaaagccctttgcacctgstgctgtggggatgttgccattgttcagagcagattctgtggggtggggtgataaccagattagggtatgmggagaagggaatggttgataagggttggagatgtggtagactcaactctcaagctgcctcactatgcagaggaggaggaagagatgcattttttgktagttttgtttgtttcatatggttttttttttctttgaaggaaggatctgagtaccacttaaatgcttatggaaagataaaatagaggaggagtggctgaagacagaggaaagcaaagcaaaaaagatagtgtaaggttaatgagtggttataaggtgaggaattcagggaccaggaagaagcacaaggcttaggagagaggatgatcacatttgaaagtagcttgaaagaaacgggggatggaaaggcggcctacagctgcagaaatttggttagtgtaattaaggcatgtaagcagaaatgtctaacctagtatccggctcatataagaggctcacaaaaaatgcttgaaatcatgatgatgttattgaagacaccccctcttacatcctttcaagttagaatatcctcctacatatgacctggttcktacttttgaatggcttttagaaatataagttactttttattaaagagtaatacataggataggagatagttaactctaggtttggaccaagcccttgcattcatttttaaccaaaggtatcattctgaaggaccactacattcctctccattagaaaggatatttttgctgttttcaagtgtgagaaaagattttcaagtatcatcggtaagcaaatctctgaatcatgttaaaatgatacaaaacatttgtttgtttttttataaggagataaggcattttattttaccatctttaaaaggaaaagtcacagtggtataagaacaaaggcaaaataaaaacatgaaactaattttttatttatcatagaatctgagagctacaaggacctttcgtgggtcaagcatgtctctggcttaagcatgtctattctgaaatatctaagacaagttgctgtgtgaaaagacttctaagaacaatgcatagtttctttctcttttctcattgtgaagttaatgttgaaataatgaaattaagcttgcttattatgttctcttttatgaaaagagttagaactttgttttaactcctcccttccctaatttttaacaatttcttagagctttttcctcttggacaatctgaaaatttggcactatattttattaaagcatgctctcaaaatataggaaaggttttgggtgctttgtggtagcaacaatttttgccaatttagcagtacctgaaacaactcaattacaattaagaaatgaatttaatgatataaagtataatcacattatgcaaagcaattagagaattagaaatttgatattatgacctgatataaaatggttggcatttcattaaatcttcaaaatacaatttcaattgggaataatgtttactctttaagtgcctcaagtctcatgctactgattgtatatgttacattatatatatgtatttttttagctggtaaattaggatccaaaatcttctctaagaaatacataatgacacatgttcaaaataaagcacagatgaagacaatgtaaactagagaaatcaaaaataaatataaacactaaaattatatataattgtaccatataaaatgaactgcgatgaaaaagtttttctctcattctctgagaataaaatcacaaagagaagattccagctaagctttaggaggtgaagaataggaataagaagaactagatcttttatgtgtatcttttatgggcaaagtgcttaatgaacaggcaactctacaatgaaaagcgttatttttttattttatagaagaataaacttyagctcagaaagatttaaagacttgtcccaagtcacatacccagtaagtagcagagcaaaataactcaacacaggggtttctaaattattactattattattttgaagtctatggttgttaaactacatcctctgagctctaggatgaaaaggttgaaggttctcagttttgctggagggaatcaaaaacattaacaaaggttttgactttgagacagagagcactaggatcagttctagatttatgtcaaggtagtaattacttgaagatctgattgtatctcatggctgttggaaaaaaaactcaataagcaggaacagcaccaatcttaagagatttcttggtactaaagaaagatctcctgcacacccctttaaaaatgggacagtgggtgaagtagcaatccgttggcaaaaaaaaagatctagcaatgtttctgcatccatttgaagccctgaccctcatatgaaatatttgtaccacacccctgtataaatgggtgaggtttctcaaaaccaaaggtgatcatcctggagatgtgaacgctccaaggatcttcctaccttccccatgagtaagaatctcaacactcccagaaagtcattggcagcccagtttttggggatggtacactctaaagaaatgaaaaccataaatgtaatgtgaatataagaacgggatgtgggagctcatggaaggcactggacttcctgggggtgtgagtaagacccagtcaaaggaagaggagaaaaggaggataaataagtacaaaacaaactccttattcttcagctttgcttgatttaggaaaatggggcatttagggccttgtaaataatttgaaatatcacaatattgagttcagaatggagcttcctaagtaataactattattattgttaacattatacaatgttattawacatttcaatatctgtccattctattatattttaattaccttgtgatgatctgtctccagttaaagcaaacattgtgaattgccctgattaaaaacaaatatttttcttcttttctcaaggaaattctggaccaaaaggccagaaaggggaaaargggagtggaaacacattaagtaagtatatagtattttgttttctgtgtgaattcttgtaataagtaagtctgtgatactagagatctgggcttgaggcaaatgttcgcaacttcagcacagatccatacagactctatggaagccaaacataattttctacaaataagcatgctaattggggtaaaacaaatagattatattatacaactctttcaatctcattatccatttgtcttttgtttttgtgatgaatactattttctaaaawttccacaaagaaaattgttcaattttcaagtcaatttctatccactaagggaaaatcaagcttatgmatagaaacaattacaacctccttccttactaaatgaaaccttaaatataagaatttggacagtttaagaaccctgaaaaattaactatctgatgtctggggctcttcgtttatttttctaaaaacttgaaatgtggtattccatgttctaaacctttaaacctacaacagaatagatttcacaacaagaatatttgtcaatctactgccgacctcatgttgcaatatacacaacctgttaattggaccttaaatactaaatattagatgagatgtcttctatttgccatgctgtaagtcaattgttgtgtctaggctgaatgtatactgatataatgaaaggattatgaagasgagtgtggaatccccacttaacttctcagaatcagaaggctcctccctccctctgtattcccagtagaaactacatgtgatgtgtgtgtgtgtctgtgtgtccatgggataggtaacacaaacagggtgatcatatttaatcatcaggggtctgttttaggcagataatggcaaatccttttatgtaccaaaatctrgcagtttttatttgtaatcattatctagaaatatacagtagcaatttatctgccctacaaaacctaattattttaacctaatattgtgtaggtatgacatatttagacaaagtagggcatggttgtgaataccagccattagagtagtcattagtgtaatcatgatgctttcaaagtacaacagagtattgtgtgtcttcggagtactttagtgttacttaatgagtattactgttatattaaaacaatagaaacattaatctgtctgtcttttctccattctatccattcgttctttaatgtggtcacttttgaatgctgtatacttttttgtttttttgtttgtttgtttgtttgttttgagatggagtctcgctctgtcgccaggatggagtgcagtggcaccatctcggctcactgcaacctccacctccygggttgaaatgattcttctcccacctcagcctcctgagtagctgggattacaggcacatgccaccacacccagctaatttttgttatttagtagakacggggtttcaccattttgaccaggctggtctcgatcccctgacctcatgatctgcccacctcagcctcccaaagtgctgggattacaggcatgagccaccaagcctggcccacctgctgtgtactttttactcgacttacttctttctttctccttttcactccatttactttcagctgagytcctcttaaaaagttctccttcttatccttatgttatctttatctctgcctttattttatcttttgtttttatctccttttcctgaggctttctctgagcttcttaacattgactttagtcaagttttgcaaataagaaactattttttttttatttttacactgcaaacagcaccccactgtcttccattacctaaggttatcaaatgctttgaacattttcttcagatatgttcagaaatgttttcagttacagtattttcatggctattttggagtttatgcacatgctttctttgaggaaggagtaagagagatgtttgtatacagcctctgcattctccaccatgccctccctcctcatgcagagtatataacaactgcataatgctttaaaaacaaagaatgatatacataaacatctaatgtggtatattctgcttttcrcttatgttaatatgtcagtcatctgtccatatcattatatatgtcactacctcttttctctcaatggctacacattattctattattcagctacaccataatcaccataatatagccattcactcctctagtcctgaacactaaatgatttttgtttgctttggtcagactttaataaacaatgctacattcaacactctcacatgtaatcttgtgggaatactttttaatagggaatttgctagaagtagaatcaatggttcaaaggttacatacattttaccatttgatgaattattgtaaatggctgctaaaagcttgtaccaatttattctgtatgaaagtgcctgattccccacatctgtagttaatggtggtatgtgaaaatttatattgaatgttttcatatgcatctttaaaattttgtaaggctttctgaaaatatgttaaaaataattaatttcctcctttatatatgtgtcaggaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaatttaatttattgggttctaggrgaactgctgtgttctcaccctaacttggaagagtgatgtttcagtcaagcaaagcgattcctaccatacaatataacacttgtgtgaggctctgtcctaaatatctcaattaccaatatgtggtttggtagtatttctcgccatgctttgctcatgcgcaatgagactacmactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgytctattgcacaggctggactacacgcattcamctagagtctagaacacaatttaatttattgggttctaggagaactgtcatgagtattgataatatgaragttctttatattcaaacattattctcaaccagagatagggatgtcatagaagaaaatccattcattcaatcattaattcacatgtccattatgtacctccatgagctggacataacagctaataagagataattgtctctggttttacagagctaattgtccctaagagatgtagacaaatgaacaagcaattacaatacatytaagctatactgggggaggaacagggctggataggtatgcagaggagataaaaaaattttaattccttagaatattttttaaaaattgattcttattttaccttctcatcttcttattttccaaattacagcatatatatatatatatatatatatatatatatattttttttwtttttttttttttttttttttaagttttgaagtgtagtcgagcttgggcaatttatccaacccatttaaaccaaaaataaaacttttcatgtattaccyggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttrttcccactcttgtataatgaacatgttaacacctacctcacagggttgttgtgaggatcaagtaagatattgtgtgtgtgaagatgctctgtgaaatcataaagtcctttaaagatgtaaggtatgcttcgcagtgatctctctgaacyggaatagcttttccccgctggtataatgcagacatttttaatctgtaatcagaataggagtgaaagcaaaatgaaaatgcaagaagctgaataaatgtcatggcaaaaagagagatgctcgagaaaaagaaaagattttatattagatagagcaatgcaagtgtrrccagattgcaaatcaatgagtttgtctgagtcgagcagaagagcattagttataaataaaagaagctactaaacagagtgcacgccggagggcagaaggtgtcaacagaggtcaaaacaaaatgtcaggctaataaaacaagagtccagtctctgaagaacaaagcatgggcccaagacaatgctgatgagaaaattccaagaaaggttgaaacaagttagagttgtcaatggtactctggttttatgcstacatgacattaraatctccagaaataaaagggagagaagaattagccacttgttcagatactcctgactattagcaggctagcaacattgaatagccagtttacwcwaacatctagagataagttgtaactccttttccttggtttaattttgtgagacctcctgtcccattctgcactgcaagtcaggtagagtatgagcagctttcttcagcagaccttggtctacatcagccacacgatggcctcggtcccagagatgctgggagacaattccagggattcagttaaaaagtcatctgacatcctagactaaatatagatttttcagtgtgaaaaactaatccaaacttttcaaattagggaagaaagtcttctctctttagacaaaaaatggatgctgaatgccctgttcaaattattggcacaaatggcacaaattttatcaactttaaaaatgcataatgaagagaaaagaagccttcactaagctctaacgctagtcatagtgaatcgtctgttgtgttctcaccttaacgcggaagagtgatgttycagtcacacgaaatgattcctaccatacaatacaacacttgtgtgaggctctgtcctaaatatctcaattaccaatatgtggtttggtagtatttctcatcattctttgctcaagtgcaatgagactacaactaggatgtgaattttgagtatcctrtctaaaactcaaacaacgataggaaaaatccatttgttttttcatttgatttttactraggactcagctcartcttaaatgaatactagtctttttccaaagcattgttgatcaaagtaaagcctgtgaggcaagggctttttttttttttcctttrtctttttttaagagacagagtcttgctctgttgcacaggttggactacagtggcacgaccatagctccctgcagctttaagctcctgggcttaaatgatcctcccacctcagcctcctgagtagctaggactttaggcacacaccaccatgcttggctatttaaaaaaataaaaataaaaatgggatctcactatattgccaaggctggtgcaaactcttggcctcaagcgatcctcctgcctcaacctcccaaaatcttgggattacaggtgtgagccactacacccaacccaacagggtttttggtgcattatacattaatcctcagaagagcatttgggtgaaggactattatcccaatttctagaattataaactgwggcttactgctaataagtggaagaacagaaactcaaagccaggtctttaaatctccaaagtccttatgactccattcaatattcccacactagtattatgtatttttatatatatcacagatatgtcatgtggagggtatgcaaagagaaagagagggaaagagagaaagagatagatagagagagagaaaggcagaaaaggaagaaatttgtaatgascagtttggttttctagaatgggcctagtaatttgaagagctaaagagataaaaattcttacggcagatcaaattccaaataagcattctcagttattctttatttgtttgtgtttccmccttcataactactccagctattgcctctagtctccctcctaaggatattactcagaaacatagtcttcctagaatgctcacaaagcttccattatcactaatgagagctacttatgtgcacctggggaagagctacctgttaatattctatctttattttgctaacgggctcagccttaacatttttcactattatttggctgctccaatgtctctctttttttattgtgtctttttttttaactccataatgtactttcttagtagcactagttatgagttagcagaactgagtgtacctgagtagggatggttccaggtaacttaggtaaatgctgctcatccttgacagttacatggtgtttagagctttctgtgggttcacaaattagcggtggctcacacgtgtaatcccagcgctttgggaggccaaggtgggtggatcasaaggtcaagagattgagaccatcctggccaacatggtgaaaccctgtctctaccgaaaatacaaaatttagctgggtgtggttgtgcatgcctgtagtcccaaatacttgagaggctgaggcaggagaatcgcttgaacccaggaggcagaggttgcagtgagctgagatcatgccactgcactcccgcctggagacagagcaatactccttctcaaaaaaaatgcagcattccattaacacaatagatgtgttccttaatagagtgtatagctaatacaggcatactgtggacatattgtggtttcagttccagaccaaggcaaaaaaaaagcaattatcacaatgaaacatgccagacaaattttttggtttcccagtgcatataatagttatatttacactacactggagtctattaagtgttctttaatttttaaaatactttattgctaaaaaatgctaacaatcatttgaaccttccggaagttgttatctttttctggtggagggtcttgcctccgtgttgatggctgcttactaatcagcgtgatggttgctgaagattgaggtggctgtggcaatttcttaagacaacaatgaaatatgccacgttgatggagtcttctcctcatgagagatttctctgctgcatgcaatggatgctatttgatagcattgacccactttagaacttctttcaaaattaaaatcagtcttctcatactctgctgctgctttgtcaactaaatctatatgatactctaaatcctttgttgtcgtctcaacaatgttcacagcatcttcccttcaggagtaggttgtatctcaaaaaaaccctttctttgctcatccataagaagcaacccctaatccattcaagttttatcgattgcagcaattcagccacatcctcaggctccacttctaattctagttctmcacttctcttattatttataccacatctgtagtgactttctccattaaagtcttgaacccctcacagtcattcatgagggttggaatcaacttcttccaaatttcagttaacctcaatactttgaccttctcccatgaattataaattattttaatrccrtataggattgtgaaacctttccaaaaagttttcaatttactttgctcagacacatcagaggaatcactctctgtgtcagttacagccttacaagatgtatttcttaagtaataagacttgaaagtaaaaattaatcctkgmtccatgggctacacaatggatattgtgttagcaggcatgaaaacaacaccagtctttctgtccrtctccatcagagctcttgggtgaccaggtgcactctcaatgagcagtaatattttaaaaggattttttttctcagcaataagtctcaacagtaagattaaaatattcagtaaaccatgctgtcaacagacgtgctgtcacccaggcctcattgtcctatttctagagcacagggagaggacatttagcataactcataagggccctagaattttcagaatagcaaatgagcatttccttcaacttaaagtcactggctgcattagcccctaacaagggaattagcctatacttcaaagctttgaagtcaagcatgaactcctctctaagtatgaaagttatagatggcatctttttcaacagaagctgtttcatctacattgaaaatctgttgtgtagtgtagtaaccttcatcaattatcctaactagatcttctggacaattttctgaagcttctatatccacacttgctaaatcatcttgtacttttatgttatggagatggcttctttccttaaaccttatgaaccaacctctgctagcttccaacttttctcctgcagtttcctcacctttctcagcctccatagaattgaagagaggtagagccttgctctggacttggatttgtcttaagtgagtgtcatggttattttgatcatatatgaaggccactaactaaaactttatatcggcaataaggtggtttgttttcttattatttttgtgttcactggagtggcacttttaattgctttcaagaactttttctcacatttacaacttaggtaaatttcatactttcagcctgtcttgactttcaacccgcctttctcactaaggtttatcatgtgtagcttttgatttaaatgagagatgtgccactcttcctttcaatggaacacttagaggccgttgttaaggttactaatttgtttaatttcaatattgctgtgtctcagggaatagggatgcctgaggagaggaagagagacagaagggggaacagccagttggtggagcagtcagaatacacacarcatatatcaactaagtttgccatcttttacgggcatggtttgtggttccccaaactaatcacagtagtaatctcaaaggtcactgattgccataacaaatgcaaggggtcttcaaaaaatcatggaaaatatgtattaggaaaacactatacatggatttcaaaaattctgcactaaaacaagctagcttattataacatgtctgaatagaatctaatttgatgcactaagaacaataaggtatctatttaaaaagagcccctatcagagccacataaatattgctaaaatggaaccaagaacacacatgaaatttatgatgaaacttgtttggaagaakggtgaaatcaccgatactttatgaaaagtttataggcacaatgtcccaaaggaatcagcagttgacaaaaagagaactcarttttacaaagggataagaaaatattgaagatgarccctgcagcagctgactatccacgtcaatttgtgaggaaaaaaatacatcttgtttgtgccttaattgaaaagaactgagacagcagaacaacagccaacaccacagacatctcaactggtttggcttgcacaactgtgacttagaaattaaggttgagtaaagttttttctagatgggtgccaaaactattgtgtccagatcagctgcagacaacagcagagctttcagtggaaatcttaaataagtggggtcaatatcctgaggcatttatttgaagaattataggagaagataaaacatggatttmccagtataatcctgaagacaatgcataatcaaagcaatggctaccaagaggtagaagtgttacagtcaaagcaaaagcagaccagtcaagaacaaaggttctcacaacagtttttgaggatgctcaagtgatttttcttgttgacttcctggagggccaaagaatggtaacctaggcttactatgagagtattttgagaaagttatccaaagttttaacagtaaactcccaggaaagcttctccagggagtctccatcatgacaatgctcttgctcatttctctcatcaaactaggacaatttttgggagagtttcaatgggaaatcattgggcatctaccttacaatcttcatttggctccttctgacttcttttagcttcccactctcaaaatatttttaaaggacaccaatttttcttctttcaataatgagaagattacaacattgatatagttaaattcttaagatcctcaggtctttaggaatggactaaatggctagtatcatcacctataaaagtgtcttgaacttgatggagcttrtgttgagaagtaaaatttatattttgtgatttttaccttttaattgcttttttccacaaactgttttaatctccccatattttactaataatggaaaagtttgcaaatcaataaatgtgattcacctcataaaactaacaacaaaaactacatgatgatctcaatagatacagcaaacrcttctgataaaattcaacacctcttcatgttaaaaactctcaatgcagtaggtgttgaaggaacatatctcaaaataataagagccatctttgaaaaacccacagcgacatcatattaaatgggcaaaacctggaaacattctgcttgaaaaccagcacaagataatgatgccctctccactactcctgttcagcatggkattggaagtcctggccagagcaatcaggcaagataaggaaatatagggcatctactttgggaggctgcagtgggaagatcacctgaggtaaggagttccagaccagcctggccmaatggcaaaacccgtctgtactaaaaatacaaaaatcagccagtgtggtggtgggtgcctgtagtcccagctacttggggggctgaggcaggagaatcacttgaacctgggaggcaggggttgcagtgagccaagatcatgccactgcactccagyctgggtgacagrgtgagactctgtctcaaaaaaacaaaacaaaacaaaaaaagaaatacacagtatcaaaatagaaagagaaaaagtcaaactatctgtttgcagacaacatgattctatatctagaaaaccccatagtcttgacccaaaagctctttcagctgataaacaacttcaacaaagtttcaggatacaaaatcagtgtacaaaaatcactagcatttctgtacaccaataacagtcaagctgagagccaaatcaggaatgcaaccccattcacaattgccacaaaaagaataaaattcctaggaatacagctaaaaaggggagtgaaggacttctacaaggagaactacaaaccmctgctcaaagaaatcctagatgacacaaaaaaatagaaaaacattccaagctcatggataggaagaatcggtatcattaaaatggccacaccacccaaagcaatttatacattcaatgctattcctctcaaactaccaatgacattcttcacgtaattagaaaaaaaaaaaaccctattgtaaagtgtatatggaaccaaagaagagcccaaagagccaagccaattttaagaaaaagaacaaagctggagatatcatggtacctgacttcaaactatactacaggggtacagaacaaaaacagcatggtactagtacaaaaacagacacatacaccaatggaacagaatagagaacccagaaacattgccaaccatctacaactatttgatctttgacaaagccgataaaaacaagcaataggaaaaggactcccttttcaataaatggtgctgggataactgattagccayatgcagaagactgaaactgaactctttccttacaccatatacaaaaatcaactcaagatggattaaagacttaaaagtaaagcctaaaactataaaaactctgaaagataacctatgaaataccattctgaacataggacctggtaaagatttcacgatgaagatgccaaaagcaattgcatcaaaaataaaaattgacaaatgggtcctaattagagagctgctgcaccacaaaaaaaaaaaaaaaaaaaaaaaactatcaacagagtaaacagatacatagaatgggagaaaatatttgcaaactatgtatcaaaaaatgtctaatatccagaatctgtaaggaacttaacaagcaaaaaataaacctgacaaaaaataggcaaaggacatgaacagacaattttcaaaggaagacgtacacgtggccaacaagcatatgcaaaaatgttcaacatcactaatcattaragaaatgcaaaccaaaagcacaatgagataccacctcacacctgtcagaatggctgtttattaaaaagtcaaaaaattacagatgctgtggtgacgagttcgtggagaaaagagaatgcttatcgtctgctcatggaaatgtaaattagttcagttattgtggaaagcactttggtggtttatcaaagaacttaaaacagaattaccatttgacccagcaatcccattactgagtatatacccgaagaatacaaatcgttctaccataaaaacacatactctcatatgttcatcacagcactattcacaatagcaaagacatggaatcaacctaaatgcccatcattggtagactggataaagaaaatgtggtacatatacaccgtggaataccatgcagccatacaaaagaatgagtcacgttctttgaaggaatatggttggaactggaggccattatccttacaaacacacacacaagcagaaaaccaaacacttcatgttctcacctataagtggggactgaactttgagtagatacggacacaaagaagggaacaacagacagtggggtctacttgagggtggaaggtgggaggagggtgaggatcgaaaagctctcagctgctatgcttattacctcgaagacaaaataatctgtgtccaccaaattgccacgacacgcaatttacctatataaccaaccttcacaggtacgcctgaacctaatataaaagttttaaaaaatgaaataaatcaatttgtcaccatgttaatatacttaaagataaaatacagtgctcatctaagtgggggcagaagaaagcatttgaaacaaaggaaaagtttgaaatgctgtgagaatttgcaaaatgtgacacaaagacacaaagcgagcacatgctattggaaaaatgacactgacagacttgcaggacacagaattaccacaaattttcaatctgtaaaacatgcaggatctgtgaagtgcaataaagtgaagaccaataaaacaggatatacctgtatgttgtgtcgtttgaaatagagatttaaatcaattatggatccagcagttagcacttgtcctgcttagtccctatcccagctgactctcacagcctcactctcaccagaaccaattagaaggaaaaacatcagccccatttttcacagcagcaaaagtggaaattcatgcaattatgtgcaggaatgcagatgaagcagaggcccaacactccacttccctttcctccatagcctgagtaccaagtacctttcctgccctttgaagaaacaactccaggcttcctattctgcagtaagaaatttagcctgatactcacacaagattatttattttgctcaaattcaagcactggacttgtatgggctcacagcctattatttgcccccttcagccgatcgtctctggaaatgtcctgcccttaagatgtaaatcttttttagggcgtgttgaggggatagtctctttctgtgacccaggctggagtgcagtggcatgatcttgggtcactgtaatctctgyctcctgtcctcaagtgatcttcccacctcagcctcccaggtagctggaactacaggcacaggtcaccacactcagctgttttttaaaattttttgtagggaacggggttttgctgtcttgcccaggctggtctctaactgctaaactcaaatgatctgcctgccttgacctcccaaagtgctggggttacagacataagccacggcacccaacctgaggtgaatcttaagacgagatttcctagaacgacacagttggcttgtttcacatggagtctccaagaaattcccccattatggcttagcctacagactcttaatcctttccyggatgctgtagttattttcattttctacttcttactcatatcctgcttaatccatgccaaagtaaaacattggaccctcaggtattttagggacctatataaaggaattctaatgtgaattatttagcaaaatgacccatttcctaatgacgttttatataattctgcatttttatttcctagaaagttcaaagaacaagtaaacctctttaactgcatacaaatattcagtttctgtgtacagtattttcactaaaacttcatatgatttacagcaaaacttatttcccctataaaatsattatgttttattataaaacatcttccacctcgaactcttccctgttgcattctcacttaatcctgttacccagtacattacctgcacctagaaatactatttctgcaccaaaaggacatgtgctttatcaatcacagagtgtaagctaacaaacatattattattattaaygtattaaaacatctaataggtccttcgtaagtacttatgtcatttttgaataaaaatcagcttttaaagtaggtgttttagggacaaagtgattattttcggaaaagagattttcagtgtgttcaaatcacaacatagcaagtatggtagcttaactccacctataaattaaagaagcagcttgtatttttaagtttatatgcactgaagtatgctatttctcgtttgcaagtaaaaacataacataagtgaaaaaagaaaacgtattagtctgcttgggctgtcagaacagaataccacagataaagtagcttaaattatagacatttatttcctcagagttcttgacattaaaagcccatgatcaagctgggggcaggattggcttctcctgaggcttctctttggcttgcagacggcccccttctcattgtgacttcatgaggcagtttctgtgtgagcactgagctcctggtgtctttatctcttccgatagggcacctgtcctatcaagttaggattctgcccttatgacctaattgaacctgaattacctccatatggcctctatctttaaatatagtcacattggggacttcagcatacgaatattggagcgacacaattcagtacataataggaaggtatcaagaattgatcctctgtctgtgggcaggatctctgcagcacacggctggaactgtttcaggatgaattcagttttctttgtctatgtttctgtaactttgttcttaaagagggcctaaattgcaccataagtaaatttgatgcattctggtgtttttatagttatgagaacaatttcacttttgtttactgccaatattgtgtatttacatttcagtgatgttcttttacattgtctcatgagataataaaaattaccagaataatgctgtttaaacagacaataaccaatggtgatgggattaatgacaaacaggatgacctgggcaatcacttctaatattctttgacaaataatcaccatggagatatttgtaagaactgttaagtggaaagtaacagaaacatctttaatcacaaaatagagtctattggtttacataattaagaattacaattcccacagatggcttcaggcatagcaggatccaggtgttcaaagtaaatcatttggactcagtctcgctctctctttctctttagatatgttatattcattgtgaagtcagctcttgtgtggcattatcttaacatctagccatggctaagaaagaatgccgcattttttccttcaaaataactctgtctctacttttgatcctgagctttccccttgacaagctattgtgtgtagagataagatatactcattgcctaacccgaaaagataattaccaaatggtggataagacaagatttgctttaaaaatctcagaatgcagggtccagggcactaaaaagtggatcaaactcactatcttgttcaatcatgtttagaaatagtcttgctgattgcttattgggcggcgatgtattagtttaattcttccataatgcgaatgatttgtaactctctaagtggtcatatgtattctagtattgttctagaagttgggctcaggatatggtgaacatcagaatgactcgtgaggcttttatcatataaagatgcctggacatgacacacagatattctgatttcagggagtttgtgctgtggccttgatacatgtgatytccaaaagttctccttgggattctgaagcacaaagtagwtgagaaactgctatttaatatatgatacttttkttctcccatcacctattccccatcattaggccagaaatttgaatttttaagaaataatagtatcaataatacctataatgtgtagaatgaaccctctgtaccagacactctgaaaagcactttatatacctcctttacttaatccccacaaggaatctatcactctggtgttctccccatgaggatttagaaccattaagtaaactgtgcaaaattatacctatggccgggtgcagtggctcatgtctgtaatcccagtactttgggaggccaaagcaagcaaatcgcttgagctcaggagttggagaccagcctaggctacrtggtgaaatcccgtctcttcaaaaaatacaaaaatatctcctcttgactctgtcccaaatacttgtctccctggctttaggagtaacacaatatgttatgttatttttctagagaaattttctagagaaatttaactcagtttcttcaggtatctgatatttgggttgcacatttcattgctaagtatctcattaaggtaattatcttaaataaagaatcagttatcttcttaaaggaattttgccatgttgtgagaactttcaggtcaaactgcaaccagatttttttttaatttctgtattatgtttgcatctcaaatatcataactaccattgtaataaatttaaccctaaatcctaattccaataaatgatacaaaaaggaaatcatgactatgagtaaacaataggataataastgttatgctcctcaaaagtcatttctatgttcgattatttctttccactgagtagtggtaattgacacatgcaaagaagaccttacatgttccctgacttttcaagtttgaatgttgtctttctaacagcgatgaatagattcgtagtatcttttctctaacttttaagggtagactcatatatggaacactttaaataatttgtgcagggttcaggtatggctctgtgaacattgcagtgaatgtgttgtttccttctttaaataaaatatatttcaaaaataaagaaaagaaataatatttataataaatagctaatacacagtcatgtgtaccacttggacctttgaaatgttcacatttaccatcttgaytacaagtatttgttttttaagaratataattttggctgggtgcagtggctcatacctgtaatcacatcaccttgggaggccaaggcaggaggatcacttgagcccaggagtttgaggctgcagtgagctatgactgcaccacagcacttcaatctgggagacacagggacaccttatctctaaagaaaaacttttaaaaatttttaaaagaaatacaatgttatgagcagagttgaagtaccagtatgtctacctgtcttccttwccagggtaaacctttatcctggagtttgtttccttccrttcatgtttttgtgcatttactacatatgtatgtactattcttatgtcccagttctttcctaaagaaaggattgaaacttctctgaaactagctaactcattgtcatagagatgtaaagaaatgggacataagaatagtgagattgcctttaaaaagttaaactatagaatgaacattcaatgaatcagcagagatatgtcaaatcattttacctgactgaatgtattaacatatataaagaaaaatgtgttaacgaaagatcattggccatcccagaagcaaaatctcactgctaagtctctttgtaaattaataaattaattaaactaagagttcactcactgtgatttgccttcccatgcagatttcccaaggggagaaagtggccttgtcaagcagattcaaatattccagtttttaaggcaattrcatttctcattgtaaattgaattgacatttagtcccaagattctgtttaacattagtctgcctctaagagatagatctgctcactgagctgacaagatcagattttctaatgtctcaggcttctctgatcagagcctcccaccaaaagctygtatttggagaggctctcagtagccagccatatgggtttttttccataaaaacacttatgtttatgccagttaaatcaatctttccttcatgatttttctgtttctactcatagaaactatattctattccctctgaagacttatgaaatattaaattcagtttcttctatgatttgatattttaagcatttgccaatttaatctcactgggtaatgcagttcatgtatcaagagaagcttaccattcatttatttactcattcatgccataactcttcctcaagtgactactgagtgacaacttgcatcttgtcagatgctgaaaagatgactataacgggtttctttcagtctactggggaaaacaaacaagtttactgcagtttggtatagcatctgtaatagtgctattgagtaaccaatcgaaatttggagattgagagtgtagaaatgagaggggaagtgggaagggaagaaggaacattccagacaggaaccaaagccccagaaataaaggagaatgagacttatttggaaaatgtgagtagttatatataaagtaaaaagacaaagcagtgcaggtggggagaatttctcaagggttaggttggaaaggtgagcagagattaagcatgaccttatttattccacaagtcacttgacaagagtattcccaggaaatcctctatcattctcgtctactatgtttrtaattctaccagggattcccaaactttttctgtaaagaaacagcaaatatttgcataaatgcaccaagattattaaaatatcttttatggaatggacttaagattttttgtctgctcaaaactctttcaacaaggaaatgcctccccattctcactgtgggaatgccatgttcatgcaagtgactcggcctgtttgtccagtccacaggtgggcatttggcccaaactaggccatagaagaacttccctggatattttagaaactatcactaagaaataggctgtaaaatatcaagttaggtgagtgtcagaactgtcagtctgtcactgagaaagagacagtaactgtcatcaagaaagaaactgtaaaatataaacttaggagctgttaacagacatgttctatcaagtgaacaggagagcaaasatatctagsttgcaacaaaaaaagaataataaagcaacctacagaaagaagcttgagtacaagttggagactcctaagcagattcgggtcttgggtcagctattgcagatacctawctataatcttatccttgggttctatgaaacatccagtgtccttaaaatacattattattttggttttggtttaaattactttagtttctgtttctgttttttcaccaattaaaaaataataatacacgaaatcgtttaggcacayagtctatgcttatctgtgtttatttgatttgaatstagaaaatgtctacacaaataaagaggaaacagctatccagaacacacacacacacacacatatacatgtcttctgaaatctttatatacaagataaaaatacccaaatggaaaaaaaaaaagccctatctgactaaatatattagcttgttgccaaagaaacgacagacattctttacatctttgtgacartgaattagctactttcagagaagttttgatccttcagtcttacagagaaaatsctatgatcaaggttgatgayraaatgaacttttctacatcaccaaaacagagcagttgaatagtargtgaagccaactctcaaatgagtctactgacctattgagacgcctttcctctatattacttcagagatggtcaaggatcagcaatgtgtggtcacctgtcaatagtttatttataactgaaaaatatttcaggtgacagatatggatcagcatacccaagcatatttggccctaaagaatttgaatagagggccgggtgccgtggcttatgcctgtaatcccagcactttggcaggccgagtcgggcggatcacgaggtcaggaaatccagaccatcctggctaacacggtgaaaccccgtctgtactaaaaaatacaaaaaattagctgggcgtggtggcaggcacctgtagtcgtagctactccggaggctgaggcaggaggatggcttgaacccgggaggtggagcttgcagtgagccgagatcgcgccactacactccagcctgggagacagcaagactccgtctcaaaaaaaaaaaaaaaaaaaagaatttgaatagaggtacctactccccctcaggatcccttgagcatacggaatttggcagaaatttacagtcagccattccctttgcaataaatgagatgaaaggattgtatcagcagcactatctgtttctgatataatatgtctcctcttctaaatatatactgcaatcatctaggttagtggttctcaaagtgtggtccctggaccaacagmattagctgttgggagcttgttctgctgcatattattctttgagaaccactgctccaggacaagcaaggctcatttatgacattttggaaggagtaagaggtaaacaatgggcagtgagaatgcttacattcacttgtttggacaacaggacaacgatgctcatataatcaaatgtttgagtatgcctgatttttcatagcatgcatgcatgataaatatattatgtttggatatatttgacttgtataaaaataaacatttrgatatcacactagttaataaaacatgtctctaatatgtaaaggcttctcacaatccattcttggatttttctttctcsttttctttaggcaattacaggaaatgattgggccactcaggaattttactagtaaatgaaagttgaaatactataataacaaattattttcatgttttaaagtgtttttaacttatgcttattaagtgaagaaggacttatccactcaggcatgcttacactaaatcagtatttagcactgaattatattttggaagaatcaagagaataattataattatatatatagtaacatgccaccttttatgtttctgcatagctcaggtcactcaatttcattacaggaaattgtcagtaatctaataactttaaatgttattaaattactgttaaaacagtaataagcataagttamaaacatttgttgaaacagtaatctagtaactttaaatgttattagattacygttctaacaaaatgaattcaaactggagaaaaagaagttactgaatatttcttcaattaattgagctccaaaaacccattccttaaaactccrttttcacattagagagatatttttgttatgaaaattacatcttttttataatataacattcctcaaacttatatttgaaaagctrtcttttgtttaystagaattacatttattagtttttatgattattagaaaatattatttttatttaatattaactaaatttttaaaaataatttttcatctctgcctttcattctgttctttagccaaataattttctaaacaaatacttagcagaataatacaggctgttgagagatttttcatacgccaagtgaattgctcttataatatttgttgcactattttatttaatctgtcactaggtcaaagtgcatatatattggtttttaaaaatagaaaagagccatttcatatttatgtaaatctttctgtagcatgatcaagattttacaaaagtttattgtacatatggtcattttgattagacattacagaacaaaattacttttataattataaacaaagtttatttctttgtagtttactatttgaatcacttctaaaaataaacaaaattgtctgattttttatctcgttaatatttttttctaaagaggaaaaacacaaaaatctttgttacagaatccaggaacctcacaacaaggaaagtctttgctatttctaaatgaakgttgtcactatagttccyttgtttcccttggkaaaagatatgaagtttgatcacctatttttgtgtttatgayattctaaaatatctgctcctcgccctcctatagtattgaaaatctctgcattgtatgttgataagtttgtatgtttgtatgtcaagaaaataatgaaccatttagttmtaatttttcaatggtatgaaaaaatctaagtgacaataaacttgtatctgtcaaaattcaaactcgttggaatataatctgtgacgtgtcctcgtatatataacttacatgtaagacagattggattttgctcttaacagctgttaaarctgcaatatttgcagttaaactctttaccaataggtggtgctagaaagtttaatatttattccaatagttgaarttatttggaaaatgtgctaaacatttttttgtgtttaaaaaaaaagtsctrtaaagcagtatgtacataattagtccttgcttgccttttttttttttttttttttttttaactttacagctccatttacgaaagttcgactggtcggtgggagcggccctcacgaggggagrgtggagatactccacagcrgccagtggggtacaatttgtgacgatcgctgggaagtgcgcgttggacaggtcgtctgtaggagcttgggatacccaggtgttcaagccgtgcacaaggcagctcactttggacaaggtaatttaaagaaaatcttgtgaggtttgttgttgttgtttcagacagagtctcattctgtcgcccagactggagtgcagtggcgcgatctcggctcactgcaacctctgcctcccggattcaagcgattctcctcccttagcctgcctagtagctgggactacagccgcgcgccaccacacccggctcattttttgtatttttagtagagatggggtttcaccgtgttagccaggatggtctcgatctcctgacctcgtgatctgcccgcctcgccaacctaaagtgctgggattacaggcgagagccaccgcgcttggccagaaaattttgtttttaaaaaaatgaaatgtaggcattctctaaagacagagaataaagtagtgacaggaacatagtctaggcttggtacagtggctcacgcttgtagtcccagcactttgggaggctgaagtgggaagatcactggaataaatgagttcaagacyagcgtggacaacatagtaagatcctatctctaccaattaaaaaaaaaaaaaaaaaaaaaagccaggcgtgatagcatgcacctgcagtcctagctactacagaggctgaggtgggagggtcgcttgggctcaggagttccaggttacatgagctatggtcacgctgctgcactccagcctgggtgacagagcaagacctgtctctgaaaaacaaatttttacagaaaagtagaaaaaggtaagatgaacttctcaaatgcctagaagatattaccaagtgctaatatgctatgatttattgagtaatgactatatgccacgcattgtgttaaatrcctgcatagcgttaataataggtcacaatcacatcctttactattttacctaaaataattttcatattaggctgggcatggkggctcacacctgtaatcccagcactttgggatgctgaaggtgggtggatcacttgaggtcaggagttcgagatcagcctggccaacatggtgaaaccccatctctactaaaaatacaaaaattagccaggcatggtggtgcacgccggtaatcccagctactttggaggctgaggcaggacaattacttggacccaggaggtggaggttgcagtgagccgagctgcactccaccctgggtgacagagtgagattccgtctaaaaaaataatgataataattatcatattaggtttaagagatggatttaagcagaagtctcaggttctagagtctttaggtcccagaaggataatttaatttcatgaagagaggagatgtcagaaaatagactggtaatgtgcagaacttctgtagccagtttcagcccctggccgtagtttttaacttgcaccctaaaggtttacatagaagaaacaaaggaaataaacagcttcagagagatctgtggagtttccaaattttccatccctgtcccatatttagaacatttttcccaggttgaaaagtgtgggtttgaaatcattcttgcacctataaaatttatctccaaaagtaaaatagtaagatattctcaaggtcaayagctagatttttgcttttgttttctttgtttttcttttttgtttttctggagaagaggaaaaagaaaaaatcctcaactcttcatccctagagaattgaatgatgccatcagttatttaacaagactgagctcccaatctgagtttccacattggttttctgttttgtttttgtttttgtttttttggttttggagacagatctccctctgtcacccaggctggagtgcggggtgtaatctcggcttactgcaacctctgcctcctgggttcaagtgattctccctcctcagcctcctgagaagctgcgactaccagcatgcaccatcacacctggctagtttttgtatatttggtagttatttttggcttcccaaagtgctgggattacaggtgtgagccacgccacccagcccacgtttccaaattgttttgtgggaacagaatccatttctatgataactaacatccacagaatgaaagaccatttatttaaaatacataattgtataaaacatttcaagtgactgttaccatctatgaaggggacacccacagttctaatagaggacataacgagtcttatccatgctcttagtcacctggtaaatgactgatgattcttcagctttagaaataaaagatgttttggattctcaagatgtgcttttgttgacaaaatgaagtataaaatttgccagttatttagataatataatcaatgcagacaagctcagtataaaaaaaagaaaagtatcctaaaataccactagtctggatgaattattytgatgcttatattatgyagagatctgacaagtctgtatttagcattgtttctttaagacagtggttcccaacctttttggcaccagggaccagttttgtggaagacaatttttccacagaccagggatgggagaaggtttggggatggttcaagcacatgacatttattgtgcacattatttctattattattatactgtaatatataatgaaatgattatacaacttattatgatgtagattattccactcactatgtggaatcagtgggagctctcagcttggtttcctgcaactagacggtcccatctggggctgatgggagacagtgacacctgaagtgtgttgcttatgtacagtctactccataatctcactttggttgctatcactgtagaaaaccctgcttcactaagatagcatgttggaaatggaagcaggcttttcagtgcttttgtggcaatttcaggatattctgcttygaaagtttaatccagaatgtatggaaatttgaagttstctcaaacatacctttaaaggcaccaaaagcagctgtacaactgaagtacatcaactcactttcgactctaaagcctgccatcagatgcagcttgtcactttccactcactgacagggtttttgatatgagtctacaagcaattgatttactattgtctctgtgccgtcacacctctctgctaatgttaatctttatttgcagccgctccccagctctagcatcacggctgcagccccacctcagatcatcagacattagattctcataagaagcgtgcaacctagatccctcacatgtgtaattcacaatacggtttgtgttcctatgagtatctaatgctgccactgatctgacaggaggtggcactcaggcggtaatgtgagtgatagggagcggcagtaaatacagatgaagctttgctcactcacctgctgctcacctcctgctgtgcagctttgtttctaacaggccatggacactattggtccatggtctgtgggctggggacccctgctttaagaaactagcccagtagtacagtggctgaggtgaggctttttcatctattacaaagagaaaatcaaatggagagcaacagtagtagtatatgtactttaattcaaggaaagctagtaagtgctggcaacatacagcctgtagtatgaaagtgaacaagacgtcatctctagctttatttcttctctgagcatgaagctttgccatggacttcaaagatatttttccactggagttacaaacataggtgagaaaaacatagctgaagactattgtcctaaaaytgtattaactttaaggcttagtctcatgagtaaaatagtattttcctcaaaacttttattcattcctgcttatatctctataaagtagggatttctggtctaaagaactggtaagaaaggaagataataagtatactgagatactaagaagaaaatggtttttttyaaacttaaataaggaatagaatgacagagtttagtctcatgtgaagttacttacttggctatgtggagataagtctctcaagttttcttgacataatttgtctaaattttcaggaggctgtttgtttatggtagttggtgattctatacattgtcccagagttttattatcatcaaacaataaagtgggtcaggattttggtttccttttacattttttcagcatctagtgaagcaaactggaaagattaggagttttctaacttaaaaaattgcaagtttaaattttagctgtggttattgtgtttcagaatttcaatttcctttccaataaaatgagaataatactgacctggcagatttgttttgaagcttgagttaactagcatatggaaagcacccagtacaaaatctgactcacaatgttgtattgctcactactgaaggagatcactgctagcagcaacacaaactgtgttatcacacatttatttgctattctctttgaaagagtsagatcgctattacattgtatattgacatcagtgatattccaaggctaattcaaagtagatatcccactaatatgacttagattttttattttatagacagggtcttactctgtcacctaggctggartacaatggtacaatcacaggttaatgcagcctcaaactcctgctctcaagcgatcctcccaccttagcctgcagagtttctcgggaccacaggcctgcaccacatacctggctaatttttttttaaatcttaatttcttatagagacaggttcttgctaagttgctcaggctcatctaaaactcctagcctcaagcaatcctcctgcctcagcctcccraagtactggaatgacaagtgtgaaccactgcacctggtttgacttagctgttgtttccactccctgcgtagagttcagtaccaaacaactaaagaataattatgagaattttaaaataataaagcaaaatgagctgagagaaaaaaatagaaccaacattatttgttctgaagaaaatgatttgaaaagtaarttttatgatctacttcactggatattgtattttaagagacaggcttacattattcactgattggggattagacatggcaaacgaggtttttatggaaagctrtttaaaacattcctgattttttcactcctccaccttaaattcacagtttcactcaagaggaaaagaaaaagcaattttaaatacagagtagagacaagaaaagaaacttagaaaaatgagtggatgagtaaagaactaaaagagaaacatgcattgttttaattatttatccttctcttaggaaagtgagaagaatcaggttcatatcatattgtacatcattaccaaaattgaaacaaaaagaaaacaatttttttttcgagatggagtttcgctcttgttgcccaggctggagtgcagtggcacaatctcggctcaccgcaacctctgcctcccaggttcaagcgattctcctacctcagcctcccaagtagctgggattacaggcatgcaccaccacacccaactaattttttgtatatttagtagagacggggtttctccatggtggtcaggctggtctcgaactcctgaccgcacgagatccacccacctcagcctcccaaagtgctgggattacaggcatgagccactgtgcccagccagaaaacaatttaaatgaaccctctttttataatgcaccattatagaaagaatataatttttggacagtctccacatatttttttctggttttaaatagcaaacctggcttagcagatagaatccttagttttaagaacaattagttttgcagctgcaggtaaaatgacttataggaataaagtttcaagcatgctcctttaaataggttctctcatttggatgcacctttttttctgactagacaaaacaagtttaattaaggaagcactgaggggcatctactgtttatcaatgcacagggcagggaaaggagagtgagtcactttttgccccgtatccaggctttcccagctattgtgcctgtggtctccctgcagcaaacttggatgagttttatyatacaacagtggtacctccaagaatttgttccaggtatatctgagcctgtatggatgctgatgagggaagtaagatctggagtaactattgcttcttctcctgagtttatagtgctgaaactccaaacctgaaaagagaaacaaaagtaatatataaacataaatgccatttaaaagttattcttagctgtcttttctttgcttttttattaccacttttacataccataatcaattttctatgtgaaattttcaaaaaaaaaatgtaagggtaaacagaaggcaatcaaaaaatgcacctctatacctctgaactatccyttaatgaatgggagtaaatataatctcaaagataaataaatatatcaaagggtcacaagtcaaatttttacatactgctccttgcatgttgaatgttttaaaatgtaaacatttgaatgttaaatattatggaaagtagtatagggctggtccatacagctgggtaatcacagaaaaatagcatatttttttcatagagaaaataagtagggctagcagaggtcatcaaagttgtacaaatttacgtagtcattatggtggttgggggtggttgggggtgggtgggagtgggaagaagggtcaagattcatgccttaacctttctctcataccatgctttctccaccagatggaacatccttccaagtcctttatacttaagatcttcatttctaaagagcttgcttcttcagaatcttagtatcatgaaatattaaaggtagacaaagtcttaaagctatgttagccttactcctttattctgcatatcataaaattgaggaaaaatgagtggtttctctataagcacaaaactacaatccaaactataggctatattgacccattcttctctactttgattcccaaggtgttttcaactttaatttacattgtttttctcaatggagacactgttcacaaaacacttcccaactaggcttaaaagtcatacaaatttatgtcactcagtcatgactagaaataatgaaaatacacattcaggcacttttaactattaatgatatttgctctcccatttatctattcagcagctgatctcaaatctcatcattttataatatatctggatgatgtatgaaactgattaccttttatttttcatggaaatgctggtaagattaaagatacccaaatcccccaaagaaatatcagtatctttcattttttaaaaagaggtgaagaggaggtcaggcacagtggctcacccctgtaatcgcagcactttgggaggctgaggtgggtggatcacaaggtgaagagatcgagaccattctggccaacatggtgaaaccccgtctctactaaaaatacaaaaattaactgggcgtggtggtgcacacctgtaatcccacctactcaggaggctgaggcaggagaatcatttgaacccaggaagcggaagtgcagtgagccgagatcacgccattgcactccagcctgggcgatagagggagtgagtctctgtctcaaaaaaaaaaaaaaaaaaaaacttaaaaaaaatatataatcaatatcaatccctacaaccctcaaattataarggaaatcatagatatatatatggctaggtatataggtggaaagatgagagagagagaaagagaggaagaggattagagattaaaaacatatctaagaaacacacgtaatttttgtatagctttccaccgaatagaaagaatagttcagaggcacaaaaaaaataataacagtgacagccccaacaacgaagatccttgaataacagttattatctaaagaaataaaaacaaatttgttttttatctcattggtttacacaaggataaaattttatgaattttatactatctgcattaactttttaatgcagaaaacaatttggaatgagayggaaaatgtgtattaaataaatttttcccctgggctcaatagtcttgaatatattratataaaaataaaacaacaaatctttggaaattacttctataattctatctagacatctatgtaacccatgaatatcactaagctttaagtgtcatcatgttctgttgcctggatctattctttgtaaatttgagaaagtcatacaccstttctcagtctcagtttatgtatctrtgaaatggagataattatcattatttaacaaggtkwttataaaaagtaaatttagaaatgtatgtgaaaagacctagcatattaccttatacacaagcacttaaaaaattttcactgtgtctgaaactgttccacatagcaaaagacagagataccaaattccacaatacatttgtcwcatcyatgtgtcctcagaggaaaaataaccagaataagaatcagaggctctagatgccagtatttgctctggcatgattgyrtatgtgatctcagttgcttcatctacctagaacataagccctcccaggaagtcagtccacaagagtatggagtttggtcttgttcactcgtgtaggcaccaaaggagatttgctaaataagtaagtstaataatgaaggaggttgcagtaagtcattgatttaaggcagtggctcagggtggatacagggtgagaatcctgtgcgactttgagcacgtacagttccttatccttgctgattttcagtttcctcaacagtaaaatgacacaataatggcattcagtttttgaaagttatttgaggattgcatggaataatacatcacatgtataagtgtttcctgccacataagaaattcttaaaagactggacttaaattttcattatcaggaccacaaccttggtattctaacattcgtgaattcccttactgcaatttctaaaaacatgtgcttacatgtcagcacattagtcaactaaataatttctttcctttgctrttcatgttgggatggccttgctggtgctgtagacattgggagaattcccactctcagtttccttttcctggattgtacaaattctgcactgctgaaatctaaattcactgagtakacctacaaaatacaattcgaaagcatcacagtagcccgggttcacaattcatggagccattctcgcactctccaaattatgacagagccatggctttcaccaaaagtttaatttctgtttgtttatacaatttataaatgmcaataaatataatagatataatttataaatgtctcgtacttcggcttcctcctgtattaacatgggaatagtcttactatttgtgcaattgtttttatttgcctgtatttttaagtagccctttgaggctttcaaaaagtttttatagactttatatacttataaggaaacacagatatacaaatacgtatacacatacaaacatgctcacacatacaatcacaaacwcaataggaaacatgccatgcctagtaagataatttgggaactaaaaagtgtccctggcaaggtttctgattttgagatcatattccttttttcttttccttcttctgccttaaaatttcaagtaaaaaagcctcaatactgttataaacacctcaaaaaatacttgggctctccaacttactgttaacactcttacaattgatcagctcaggaaaacctttgctttgtcattttcttgctgtttgtttgtgtttgcaatcagtagcattcttaatccatgrtttccttacaggatggtgtgtaggccctttgctgattagattagttctactttaattaaaaacagataatgtatttgataaaccaggcacacrtaaattgaaatacaygggaagataasaaaaggaggaagatgctgatattaagttttcctttttccggtttatyttatgtgcaaatataccccaagaccctttgacatacagatacgcttggatcatcaggttattacatgtacccatgattattaaggctcaaactttcttctttatttttagattaataataaaactaatttgtcaaatccttaaaaaaacattcttaatctctacttttatagaactgtgtaggtaactttgttagagctcttcttactttgcattttagtagtttacatgttaacagagtataaagtgttctgaagcaggagattaatttttgattyctactagagagcacagaacttgcatacagaaaataatcaacacttttttgtttaattagtgaaggaattaatggctttgccccactcaaagagaaacactaaactctaaacttactaatgcagttatacctcattattgcaggtactggtccaatatggctgaatgaagtgttttgttttgggagagaatcatctattgaagaatgtaaaattcggcaatgggggacaagagcctgttcacrttctgaagatgctggagtcacttgcactttataatgcatcatattktcattcacaactatgaaatcgctgctcaaaaatgattttattaccttgttcctgtaaaatccatttaatcaatatttaagagattaagaatattgcccaaataatattttagattacrggattaatatattgaacaccttcatrcttactattttatgtctatatttaaatcattttaacttctrtaggtttttaaatggaattttctaatataatgacttatatgcygaattgaacattttgaagtttatagcttccagattacaaaggccaasggtaatagaaatgcataccagtaattggctccaattcataatatgttcaccaggagattacaattttttgctcttcttgtctttgtaatctatttagwtgattttaattactttctgaataacggaagggatcagaaratatcttttgtgcctagattgcaaaatctccaatccacacatattgttttaaaataagaatgttatccaactattaagatatctcaatgtrcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatkgaataattagcttgttacaattctaggacatggtgtttaaaatttaaatctgattaatccattttaacaaacaatgcaaacatyttcagtgcagaaggaagagtggtttcaactktttggagtcttttatgaagtcagtcaacatttacaaccaaagggcgggggggggggtggggggtgcgtctttagtcctaaagggacaataactctgagcatgccccaaaaargtagyttagcaaccttttgttggtagtcaacccatccccagggccatagtgtagagtgtgaaaagctaccckgaaacccagtaatyctaccctgaaagtgactgyctgcagaaagaccagyagttgatattaaagcgcaaatgaattcaacctcagccctgaaaataacagaattctgaagtttcctatgactaattcacaaaaaaagtaattgtaaactagtactattatggaattactctactgttctttytttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtwcactttctgtctcaaaccctggctgtaatttcagctakttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcrtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgytccattaaaaaaaacagaaatttgcgatttggtttttttgaaaaaatagctcagctgaccagaatgaatgtattctactwgttgagccatccagcatcacgttaaatgcaaaatgtatatwtaaataaaagaagaagaaaaaagaaagaccaaagggatgtagaaaatgaagaataaccattaatatctaagggccaaacacattccacctaaattatctaaatagtttcaaatcaaaactttccattttttcaaaacgtatagaccatagtagtttgtacttaagtaaagcattacattaatttgtaatgtgcctattacaaataatatacarttgacccttgaacaatgcagaggttggsagcactgatcccttcacagtgaaaaatccacatataacttttgactcccccaaaacttagccactgagagcctactggtgaccagaatccttaccaataacataaatagtcaattaaccatttttgtattactaataatgtcaactaacacattttatatgcatgatgtactgtattcttacaaaaaaataaactagaggaaagaaaactttaattaaatcataaggaagagaaatatatttactattaatcaagtggaagtgaaccatcataaatgtcttcatccttcattgttgttttcatattgagtagtctgagaaggagaaagagggggagttggatttgctgtctcaggaatcgtagaggtggaagatccatgtataagtggaacagtgcacagttcaaacacrtattgtttaagggttgactgtaataatatttgctatkaagggtaaaatgaaatatttctaccctcagtcatttgtttgatcagtatggcagtgatatgtatgtccaaagcaatcacactcaagagatacaaatttaccatcactgggttacaatggtaagcattatttactctccggagttggagaagctcaaggctggtgaagctcaagatctcatgttaactaaataaaatcaagattatggcagagaggaggaaaaagtcaatgtttgtcaggtagacaattaacaatgttccctcagaaaagcacaattaggagatgattacgttgagatttttttaattcattgagacagtatrtaggaattttaggaacatgtgtttggcactagatgtggttttggcttttaatcacacataaaaccataatatagcctgatttttttcaactatgcattttctttgcactttttctttattgaatggtaggtaatacattttaaaatgtttttctttaaccacaccaatcttctggttacataacatactgaaatatgtattcctttctgttatttatcagctattttcctttgcagagtaatttatatttaaaactcttagaatttatgtttttaaaatgttaatatcttaacaagaacttatgtatatgttattattgagtacatttacttaaacaaacaaacaaaaacaaagagcaatattaacaaaatggtggagtaggcagcttcatgaattcattcttttagagaaatatcaaaaaataaatagaaactgtcagaatcaactttttcaggactctgaaaaaattcagaattttacagcaactaagcaaatgttgagtcaagaaaaaggcaactttgaaacaacagtaaagtttgtgatatttttacctgccttccccctacctcctcctggatgcagcaatgttttttttttttttttttttttgycttgaggtagtggtaggcagtctacattcgtagcttgggcccttgggccctggttccatgggaagcagagatgaccttcctcacaaacagttgtgtttgtctgttttaatctgtctaagaaattccctgaaggactgatgcaaagcattcaactctgtttcacttaattttgaattcaggttggtaaagcagtggccgttgttcaaaaacactgttagctgaaataacaaccctcaaatgcatgggtcacaacattatagttgaaacatgaagtagagagcataaggcctggtagcaaaaactgaagacagtttctttgggaaattagggtgtttaaaaaaatgaaygcagggaartttagaaagccgcatgcatgctcagggygaaacacatgccttgaaaagaacctaaactttcaccttgggctgatctctaggattagtgcaaatctggctaagtgttaacggcgtgcccaggctcagaaacaatytgcaaatactgagggagatggattgttgttggttgtgttggttgctgcakattttgtgttttgtcttttatttctgtttttagtgcttggcattcaaaaacactagcttaacacaaagtaaggaamagagactccagtgatcatcaacaataaggaacacagtcttggtaaaaatcattcaggatagtcacaaaacaaaaataagcaaaagaaattaaaagaatggtcactgaggaagtacagatgttgtacctacttgacaaagacattaaaacaactgtcttaaatatgctttaaaaagtaatggacaaagaatgaaaggaaatatgaaaaataatgtgttagccatattagaatatcaataaagatacaaaaattacaaaaaatagagccaaacagaaactgcatctgaaaatacaattactaaaatgaaaacgttattagagggctttaacagcagatttcaacaagcaagagaattagttcatctgaaaataggacaatttaaattgagtctgagaagcagatagaaaaaaataatgaagaaaagtaaaaagagcttaagggacatgtgggacaccatcaagtgggccaaaatatgcattttgagagtcccagagacagagaggaagtagaagaaagaataggtaaataaatactaaacaaaacttcccaaatttgatggtaggcatgaatctaaaagtccaagaatctcaaaaaactctcacaccaagacaaactggtcaaactgccgaaagaaaaagacaaagagagtcttgaaagtagcaagggagaagcaacttgtcatatacaatggaccttcaaaaagattaatagctgatttctcatcaacagaaaccataaggccagaagacatttggatgacatatttaaagtactgaaagaaaaagaagaagaaacaaaacccccaaatctgtcagccaagaatatcatgtctggtaaaactgtccttcaaaaatgagagagaaattaagactttcccagataggctgggtgcggtggctcacgcctgtaatcccagcactttgggaggccgaggtgggtggatcatgaggttaggagatcaagaccatcctggctaacwtggtgaaaccctgtctctactaaaaaatagacaaaattagctaggtatggtggygggcgccggtattcccagctacttgggaggctgtggcagaagaatggcgtgaacctgggaggtggagmttgcagtgagctgagatcgcaccactgcactccagcctggatgacagagcaagactccatctcaaaaaaaaaaaaaaaaaaaaagactttcycagataaacaaaagctgargaagtttattgccagtatgtcctgccctcgccctctgagatatgttaaagggactccttcaggttgaaatgaaaaaacactagacattaaactaatgtcatatgaagaaataaagatcttcagtaatggtaagtacatgagaaaatataaragctagtattgttgtattttgtgtttataatttcattttttaatttcctgcatgatttaaaagatctaagtgttaaaaataactatatgtttattgtattatacacatataaacatgtaatatgggccaacamcaaagtgtgagaaatatggagtacttagaagcagaggttttaaatgttattgaagtcaagttggcatcaatttaagacagatgttataaatttaggatgttaatcaccatggtagtcactaacaaaatatctaaaaatatattcacaaaagggaataagaagaaaacaaaatggttcactacaaaaaaaagtcaactaaawacaaaagaaggcagtaatggaagaaatgagaaccataaaggtatgatgcatatagaaaaatgttggaatgtcaaaagttagttcctgtcagaattacattaaattcaaatggattaggttctctaaggcagcaattggcagaatgaaatttttttaaatgataactrtatgttgtctgcatgagactcactttagattcaaagacacaaacacattcaaagtgaagtgatgaaaaaggtatttcatgccaatagtaaccagaagagaaatgaagttgttattttaatatcagacaaaatataatttaagtcaaaaacttaaaaaatgaaaagaccattatatatcaattaaaggacattatatattgataaaagagagaagacacaaattcatcaaaaagatataacaattataaacatatatgcaccaaaaccctgagccccaaaatatatgaagcaaacattgacagaataaagtgagaaataaacagttctacaatagtagttgaaaacttcaatacaatacgttcaatgatgcttaacacttctagaaagaagatcaataaggagatagaggaattgaaccaccctatacaacgactagacctaacaagcatatatgtatgtgtgtgtatatatatacacacacatatatacatatatatacacatatacatatatacacacatatacatatatgtatacatatatacacatatacatatatgtatacatatatacatatatatacatatatatataaacatttcacccagcagcagtaaaatgcacattcttctcaagtgcacatgaaatgtcatccagcatgcaacctatttgtgattgaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatatatgtatacatatatacatatacacacatacatatatacatatatacatatacatatacatatatacatatacatatacacacatacatatatacatacatgtacatatatacatacacatatgtacatatatacatatatacatatgtacatatatacatatatacatatacatatgtacatatatacatacatgcacatatatacgtatacatatgcacata

SEQ ID NO: 13315 - DNA, 35101 bp, Homo sapiens
  misc_feature (1)...(35101): n = A,T,C or G, or insertion/deletion polymorphism (see Tables 1-2)
ccactcccctgcccacccgtctccgcacactctgagctctccttccacacagcctgctcacatccagacccttgcctcagcgtctgcttttgggagaaccaaaaccataacaggacaaaaagaagggaacacagtctccgactgcacttgggggtcccaccagagtgtgacggtgccagcagacactaggagaggagggcgcttgtatttcctgtggccactgtaacaaatgaccaaaaactctgaggcttaaaacaacacgatttttttttttttacagttctggaggtcagaagctctaaaatcaaggtgtctgcagagctggctccttttgggggctctgggaggggaatctgttcccaccttttccagctaccagaggcctccacatcccttggctcatggcccctgctccgtcttggaagcagcctcctctccttggaccccatcaatgcatctccttctctctctcgtaggacctttgtgatgacatggggtccacccagccaatccaagaccacctcccacctccgggtccttaatctaatcacactgaatgtcccttccccaggtagcctacccgacttgcagggatctggacgtggccattgggggacatccctctgtctgtcacaccacacgccagaagctcaragagattccagggagggaggyggattctcatgttctccgagaccctcctgggccagagccctgcctgttggaccctgtgatgtcagtgggtgcagcagcccccgagatggatgcgggtgagggcagcccggggctgtctcgctagccctcactgcatcggccccattctgggtcaatggtaggtcaacctggtggatctctgaggtgaccaagcttactgacagatgaactacagcctcaggaagagggtcatggctggcaggagccagcggggggcaagaccagcagccctgagtgctggtgcaggccacgcagggcccagcctctgtagccagaagtcagcgccagtgccggtcctgagcaagatggccatttcacagatgaggaaagaaggctcagggctgtggggactgtccgggtgggtcacatggccggcaggtttcagggcctctctttccatctggtgcccacagttacgctgtggcttgggtgtggtctggagctactgcctcaggacccaccaccatcctggcagtgtggtcccttcagaaaagctgaaaatgcaaaartcaggcacatgcacctccccccatgagctgctcaagagagagragcagtcacgcatccttayggagaaaaggagaagcaggacccagaaagggtttccctgtaagattcctcagggcccagcaggcctcagccccaagattgaggccaaattattggaggggtgtgtgtgtgtgtgtgtgtgtgtaaaactgagtatgtgagcatgagcccagagctgggggtgcaggccacgcaggtgtgagagtccacctccccatctcgctgacccctgtgtatggaggagagatggaggcgggggaggctgtgtcctgcccaggccagccgcctgccagtgacagtggaggacttgctcacagtggggctgcttggggtcacacaggagtggcctggcaggcctggcagccccagccctggagccagccacagactcctgggttctgcttccctgggagcttccaggggagtgtcactggggctcacgataccgaccccttctgggatsagtggccccttgcttttggcacagagcttcagggccagagggtgcctctaatccagtagctgaggaaagctttcagtggtgctctgggcacctctgtgacctgccctgggcccagycctcatgctgatcccactgtagccaccctactcagtgccccagrccctggacacctcaggccatgggatatcccaagcattcaaactctcacggccacctacgcttatgagcagaggcagaggcatggtgccaccgctgcctcctcaggcaggatatgctttttgtttgtttgttttgagacagggttgttcgctgtcattcaggctggagtgcagtggtgtagtcagggctcattgcagcctcaaactcctgggctcaagcgatcctcccgcctcagcctcccgagtagctgggactacagtcttgtgccactatgcctggctaatttgtttttatttttattttggtagagactgggtcatgctatgttccccaggctggtctcgaactcctgggttcaagcaatcctcccgtctttgcctcctaaagtcctgggattatagaggtatgagtcactgtgcccagcccagaatgtgcctcttaactttcataccgcagcccctatgctcaggacgaggagggacataggccagctgccccaagttccccaaggggactgtgccaccctggagtgggctctgtgatggacagagtcaccgtctcccagcagctcccaatccatcccatcacaagtcaggtctaggcactgccatcagactgatagttgaatttttcctgccaagaggaggtccctaagagcctgagccacaggcgagggacagtgctgtcctgtggccaggccccgttgtcactggggagtggcctggcctgttcactcacccagctccagtctgcaccaccgtcgctccacttgkggttgtcactgcctgagkttaggacgtcagcagaagccagcctcatgtggcagaggcgatggggaattacagcctgcaaaggctgatggcatcagagagattcaggaaagcaaagggcttattaaaaagctgaaattggttctaaacaaggtcagccgtcgatgcgccttggagggaagccaggcgctgagcagcaggaatggggcttatttcctgacaccrtggccgtgacaccctgcacctccccggcctaccccacccccaaccccactcccacccccattcccatccccacccccaccgccacctctggagggcaacgtgcacccagacactggagcagaggcagcaggggtgggagcagggaggaaagccccccgcggggcaccacagggaggcatgtggccaagagagcacctggcaagcaggtgtcacctctgaggagggtgagggcaggaggagagctgactgttgcttccttaccctggggtcggattgctcccttttaaaatccattaatgcaaggaagggcgcagccacggggccatccgattggattcgctccctcccryccggccccagtctccgcagattttctctgcggttgcatttttcatytgagcgtcccttcctcttgactccagtggaatttttctgaccttggctgacaaggtgtgcagccccctccagctcagggcaccctctttggggtgcttgccccaggcactggcccaccctgtgagctcaggcgcattgtctcgcctctccgaggctgactctcctgtgtctgagacagggatgatcgcacacccagccacccaaggctggccaggatggaggcagggcaggggaagccctggtgcggcctgacttgtgtctcctgtccctccctaggacttagttatcagtattttggaatcagctgaatcatttctgtcaaatgctagaggaaagccagttttgagttggataaagaaaatgtctttgattcctgttaaaaataaacatgtgtgcataacactgctgagcacgagaccgcacctgccgtccctccttagagctcccagcagctgttggtctttggcgtatccgggagaggagcgaggcctggaggtgtgttgagccgtccaagggctggtagcatcaggggctcttcactgcctctcgctccacagaaccgctgggttgaaggaagctggagggatcaattgtccttgtcatccaacttcctgtgtctgtagatggggaggaggcgctgggttggaaagygcttctctgaggacgccagctgcgcattcaggagggcggagcaggatatgaccccagagctctgaccccggaggagcaggaggggtgcctggggcctcaataccccagaggggagagaggtgccccccttcccacaacgcgggccccagctggtgctcgtttagcctgttgtctagctggagccacctgggtggccaccaggctgctgggagggctcacccctgagctgggtgtgctgtggagcccgtgaccctcacctctgcctctgctggcttttgttatcccgtgctgggaacaccagtgcctgcccaccccggaggctcktcgtatcaccggctcgctgtggccgctccccagtcccgagagtgaatgtccgggatgcagcagacacctgcttacaaggcacaggtgaggaggttttggaactaatctgaggcatgaaggtgaggtgctctcaggcgayggaggtggcatgtcctgatgggaaagccaggccttcggaggctgagacccttcccaaggctcaccagagaactcccaagagtgtctttcccctggcctgggagacaatttcacaccaatgccacactctattgcacaggtgattatgcacttggwcctcacctgcctgrgctgtgggtgggggcgaacggtgcccctctgggtgcaatcagtggggaggggctcatggcctgagcttggctttgcaggatggcctggccactgtggggcagagagcactgcctgcgagggccaggggaaggctggcactttctccaaatttcacgttygtgcaaagacacagtcattcctttctacagcgtagagctcagagctgaagcagcctccagacctgctgtcatgggtatttaaggacctaaatgttgctgtcagcctatgacatgaatgtgcccctaaggctagattctgggtttctccagagagacgagaaacaggagggaaaaggaaggaagggagggaggaggytggggaggagggacagcttctagtccrgctggagagatctgtcaacccagcctgggggktggagctggagggatcaagcagaatgtcctgaaggcagctgccctcagtctacttgygggagaggacaggagggagaggtgccgtggtgagactgaccctcgggcccacgggtggatgatggcaaaggtcctgtggcaggtgtgggagaagcagggctgcggccagctgccctgagaggcttcaaattcaggccagatctgctctgggcaagaggaagctgtgggtttgggagcttcagagacaggggagcaggcctgtcactcaccctsttttccttaaaggctgtcacccccagcagtgcaccctgcagcctgcctatcccctgtgcagctccagctccgtctgtccccagcaatgcaccccacgcccatgtcccccactccctatgatgctctcgcgccttctggagcmgcagtggtaccagctggaggctgtggaaaaattgagaggagacaaaagtgggaagagcaggccrtggagagagtgtctaaacacagggactatttggagattgtcttatttttggtttgaaatgggcccacctgctagtattgtacaaacggctctgctcgctaggccakgcctgcagtggctacgggcctatccttcactggtcagcctggagcagctcctcggacctcagtctgctcatccgtgggtagaggcgacgcagaccccatcccactggggactgggccagacagcctgtgaggcagtcagctggtgcctggccagagggtgtytgaaaggcctcttggctgcagggtgcatctgcttttgggacagctcttcagagccatctcagaagggacagcatccgcctgtctacttcaactcccactgatgacgtccatgtgtcattagtgccaattagaggagggcagcaggctgagtgcttggcctggggcgcaagcttgtgggagggaaaattggattccccgctagacaaatgtgattacccgtgctgcctggacccaccccattcaggaccagggcataaatggccaggtgggaccagagagctcaccccagccatgcccgccctcagtcgctgggccagcctgcccrgccccagcatgygggaggcagccttcatgtacagcacagcagtggccatcttcctggtcatcctggtggccgcactgcagggctcggctccccgtgagagccccctcccctatcacatccccctggacccggaggggtccctggagctctcatggaatgtcagctacacccaggaggccatccatttccagctcctggtgcggaggctcaaggctggcgtcctgtttgsgatgtccgaccgtggcgagcttgagaacgcagatctcgtggtgctctggaccgmtggggacactgcctattttgcggtgagtctctcctccctgccagctctccaaacccttcctgacccggcaccccatctggccgtctttctgcactcaccctccttaayccagaaagttcttctstcacctstcagtgtttgagttgactctgctctgasccaagtctgcaccccgagcttgggcatcatggggatctcagtttgaggacaaaataggaaagacatgctttccatggtccttgactgcccgccccaaatcatgggacccagtaatcccaaggaatggaactatacacagaggacgcacacaccacacacactcgtgccgctccacaccccacacgcgcatgagcacagaccccacgaccctcggccctgtaaacaatgcctagtaccacgtccccagagcacacatgcccactgatgtgggccaggtggtggcgcgtggctgggcacagcatgaggcctgcacacccatgggatccagcctgacctactgtgcttgtacccrtggaccractgagcaggtgcagacaccctgcccctacccataggtgtygaacaagccccacagggctcagccaaaactgttaggatgggctcttgactcctttccgtccaaatttacctccactcttgtttcacagggtggagaaaggggaaaagtttcccttcaaactggaggggactttaggcccttccacaagctgcagggggtccccgaagtgggcgagcccaccgcctacaatgggtcctgctccmgccttcctttccacatgggactggccaccagggcttctttgtggatgaaacccaactctctccacagaaacacacaaaggagtgacaaaaaagttttatttctgaagtcagraggtgcctgctttatctgggagtgccgagctggagcgggggagctgtgtctgtgyggagcggccggctccagctctgcaycttggtctcaccatgggctggtggggcggagagtccctctctgcctttttgggtgttgtgaattcatgagggcagatggtggctgctgtttctggagctgagcttgccccctccaattcccaagactcggccaggaggcacttgcctgtgtcgctagtgaggcttagggccacccaggtagggtgagtggagctgcctgggaagggccctgctctgacccatrgggctgcacagattcctgtgcacaaagacactctgtggctcaggttccagccaagaaagacctgggacagccctgattctgagccgtcagccgtctggaggagcagctgaaccccatcgctgacagtttggggttcttcgcaagcctctgccatgaggcaccctgagtgcaggagcatttgctcctctctggggcagcgtcccccctgcctgcatttcccggctgctagggaagccagaggaagccaggtgactttgcctttccgtgcrctggcaaggttaatttgcacaacaaattcctacgaaagcaaatgtcagccttattattcctccctaagcaatatgttcaactaatatcttcttgatttccagctgaaatatcacaggcgaactttctgcctctgtttaaaatgagtctctcggcaaaccagcggtgtccccagcggggttgcattgtgtggcttttttctctagggaaagttttgcagtatcttttgcagatttcttttttctcaaggaaatgaagaaaagatgttttaccctgaatgtaagattaaaaagaaacacaacccaaagtccttaaggccaagggcccgaggctttcttggggtttccatgggaaaggccaggcagggcagggaagcagcttcgtttggacaattctggtgggctctgggtggctggggtggtctctagttgcctggttcctggccctagggtgwtttagggttggggcaatattggcctggggtgtgagagtcaggtggaggaggtagctagggatatgggcttggtgtgggtcggaatgttaggaatatgattctcacacamgygtgaatgttggagggcaggacaggtgtaaacaactctgaccatctgtttgagccttcaatcaattaatagatgccaaatagacaaatatggaatctaagaagggcccttcttgagtacgaagggcagcctgcttgttggggaaggctcctcgctgtctctcagtgggtctccctggtggtcttccatgtgacctggcctcgggccaccgtgtccctgccccttagggcccagtgcaaggggagcrgccggagayrgggagggcagaggtcactgatccagatcccaggaagcatcctcggagaatgcagcaggtccaatgcctccctgggcctcagtttaccttctccaagcagggctgggactaaggtgaggggaacaatgcctaggctgcagggtttaaagtggtgcttcaggctgggtgtggtggctcatgcctgtaattccagcactttgggagggcaaggcaggaggaccgcttgaggccaggagttcaggaccagcctaggcaacatagcgagaccctatctcaaaaaaaaaaaaaaaaaaatccaaaattacatgtatttataaagtaataaagcagtgcttgttctcagggttgtgccagtgcagggtgggcacctgctatcaatcaccaycttagatgtggcaccctggtttctctctcctttcctgttcatgtcccaccctgttcccaactctcccctttctgaggctccgcaactctcctgcctgcatgaatgtgggcagcattggtctraggcattgttcccagtcytgaggwggccttgggagcctcaggcatcttcttaagaagctcagtgtcccgcccrccaggcccgggaatgcccatggctaacagaacctgtgacctgctggcaagtgacagccctggttcctggctgcagaggaggaaccaactccactgtcggggctcatctccactgtctccaggcagaaatggagatagaaggtgtgagtgaagccacagccccaggcagaaccctcagatccacagggactgaggcccagcatccccagatcagctggcaatgaatgcggagctctgccggggaatgccctcttcccctgtggattggccyggcttggctccttmatgcctggagcccagtgcttgtctctgcaggamgcctggagtgaccagaaggggcagatccacctggatccccagcaggactaccagctgctgcaggtgcagaggaccccagaaggcctgaccctgcttttcaagaggccctttggcacctgcgaccccaaggattacctcattgargtaaggggtggcygcgagtacccaggagggcrtgggctgcktgtatcatgctgccatcctgtgccaatgtcayagtacctttcctgtccctgataagtctggggcctgggcctggccagctatgacrgagagaaagccaaggaggatggccagaggcagtggtggggccaaagcmcttaggatggtccagctctgctattgcccctgagccctcaaagacgcagctctttgccaacacgtagctgacatggtttctagatgcggggcttgtgctgaagcctctcccattggactagaccttgcttctggatgtctctctcctcctggtcctgttaaccatcaggtgggattctggagcccaggcgacctggctttccatcccggccctgttgccagctcgctgtgaggctcgggacaactgcccccctcctctggacctcactttgcccatctgtaaaatggagatgggaactagatgatctgtayggcctgaccaactctgggagttcatgggagccataaaacattgyaaaagccataggcttcttatgctgctctaagagccccccaacctcttagggaaagcaacccaccttgcccttgaagacaaaactcttttaactctagcacacctgacagcttttgtcttgtgtaagtaatcctttggtgtggcagtggcctgggctggccgttagtgccaggtcttaatcatgggtgtagctgagtgaccacacgggaggccagtgccatcgaaagattgattgcatttccggagagaaggggcacctgtgccgtgcagggccacctgcagagccctgggtttggtcaggaggcagatgcaggagctaggggagagcccaggcctgaggctttcttggggtttccatgggaaaggccaggcagggcagggaagttgcttcatttggacaattctggtgggctctgggtggccggggtggtctctagttgcctggttcctggccctagggtgatttagggctgaggcaatattggcctggtgtgtgacagtcaggtggaggaggtggctaaggatatgggcttgggacgggttggagggttgggaatatgattctcacacaagcgtgaatgttggagggaagggcaggtgtaaacaactctggccatctgtttgagcctgcaatccattaayagatgccaaatagacaaatacggaatctaagaaaacagmacagctggctgtttgccagatgaggaaactaaggcccggagacggggagtggatgtacccaggggttcggggtgtgctggggcagacctggtgccagaagaggtgttcttccaggaggttgttgagcccttaccctgcttcccagtggacgaggcaagggtgagcagagaaccctctggaagcacctcacagggggaggccaatgcctgtgtgtgctcagcccagtggccccaggccaggtataggggcctttgcctggagttctgggcrtcccctgcacagggcggcccatcggctttccgcaaactcaaagagcaaattagccacccacacgggtctgcactgtggagtgcccagaaagctatgaaaggcactttccacacccgatccccgtttccattcatgacagcatgtgaggaagccagccccacagcttgcctcctgagtctgcctgtggcctccagcaccgcgtagatccatggagctttctgtggctgcttggtcccctcctgccaagctggtggtgactacataatatagcgtggctccgcagctcagcgtgaccatcagcaagccccagggtgtttccttcccttcatagagggcactgaatcctcaggctgggctgctgaactgaccaatgatcccccacacccagtccccagtgaccttggggttggtggagggaacaaatgttccggccacactggctcacggcgggcccagtagtcactggttgaatggatgttaagtgaatgtaggtggaatgtgttkagaagagaaaagtatttgatggccggtgcaaataggggatcctgggggtcgtcagcccgggatktggccccagccagggccatgcaagcctcaagggtcccttattcacagagatgagagtgaggtgtgtcacctggtaggtgtgggtgggcagggatgtggcatcctctcaggagcccaactctgggggctctgagagggcraccagctgaaccctgtctcggctgcaggacggcactgtccacttggtctacgggatcctggaggagccgttccggtcactgsaggccatcaacggctcgggcctgcagatggggctgcagagggtgcagctcctgaagcccaatatccccgaaccggagttgccctcagacrcgtgcaccatggaggtccaagctcccaatatccagatccccagccaggagaccacgtactggtgctacattaaggagcttccaaasggcttctctcggcaccayattatcaaggtacgtgcgggtccagggccgaggtcctcgcccagccctgccttcctccngggcctgggttgtccctgaccctggagagctgtccacagtcctggttggaccaggtgtcctcttatcactggaacctcaggcacctgcctgagcaggggagcagcragtggtcttggcttccccatcactctgctcactcccctaccctcaaagggccttggagctcccacttccctgcctggaccaaagtgaccaacatcttgacttctgcatctttccttgggactggaactgctgtctgtctgccaggccacctcccccttcatgaaaaagcagctcgagtcagaactcacttgctctcgaacacccgtccggggaagacagaatagcaaaggcgatagctgtcgagtgtccactatgccactagtcccgggggaggggcgaggtgatccctccttcatcataagagcccctagtttccagcagaggaagtgtggcccagggaggttgagtgtccagggtcacatagcaagaaggggcatgtccttgaaggtgcactcagagaggttatgtgagtgtccagagtcacacagcaggaagaggcatggccttgaaggtgcgctttgggcccgggctctaacctcagggctgccctgcctcccactggggctgcaggagctgkcccggccacagccccatatgcatgaggacggctgcgtcctgtccctgccttggcaggaartggcctgtacgaacctcatttccttcactctggagctgcctacgggatttctttctgggctgatggctccaccctcaaggctgtgaaccccagaagtgcccctgaaattgtctggatcatccctcccattttacagatgggcattcggaagcccatggaggagggctgctggggaggggagggtgggcggccggttcccgggctcagagggctgcctcctcacagtaysagcccatcgtcaccaagggcaatgaggcccttgtccaccacatggaagtcttccagtkcgcccccgagatggacagcgtcccccacttcagcgggccctgcractccaagatgaaacccraccgcctcaactactgccgccacgtgctggccgcctgggccctgggtgccaaggtgcgtgccctgcgaccccagcatggtgtctcctgcctgggcccctggcatcyccacacctctgtttycccagcttcaccgtctcagaggcttcaagaaggggctcccaagggggctcaygaggccaccagaagggccaggcctgaggtggccccctcgcctctgtgatgtctgaaatgcttcaagccktttttttattttccacagaaacgcaagtgccscaggaccttatgccctcagtgggtcctgattctgtttcccamctggagtcagggttttgtgtacaggtggtcccagggctggctggcggtggggccagtgttgaggcctccacaggctgagacgatgggggtctccccagctcttacaccygtctagagaaggggttttgggggaaggctcagccctaggcaccagctcctctccccaactccctgacccgagtctcacaggatgttcctggggcgtgtaatgagctgcctgtcaggaggaagcatcgctctaatcctgctgcgccccctccaccacccctgaggctcaggccccaacagttgactgggtttkcccctgcccagacctggggccctctcaggacacaccygtctgtctgacaccttgccccacacaggcattttactayccagaggaagccggccytkccttcgggggtccagggtcctccagatatctccgcctggaagttcactaccacaacccactggtgatagaaggtaggsggytctgctgccatcctcctcagaagccctaggactcagctgtgttgagccagtgagcaaatcccrcccttcgtctgcccagcatggtgcccccgctgtacagctcctcttggcacgaggcccttgcgtctgcctcatcygctgtccatcttccatggctgtggtgggctccyagggacaggaccycgaggggctcactcctcacagcttcgccagggcccagcagtggcsccacacctccctcctcrtccctataatacgggctgccatcggcgcagcactgtgcatcccaggggaaaggacaaggagaattttcataagggaagctgccagatgccaagttccaaatacagggagaggtgtgtgcataaacagggaggtggtagtaaagcagggcatattccaggacacaggcgctccggcctggccrgagtgcagggacgggaaggggagctggggcagctgctgttggatcacccatacctgagggtggagtgagcagggtcagcttttagcatggcaaggccaggtgatgctgtctcagaaactgaaaaaaatacttccctctctctgttgcaccagcatctttcaccatatatagacacacacrmacacaatgcacacacacacrcacrcayrcaygcacacatgtacacatatgcacgcagaagcayacacatgcacacactttttctctctctctgaatggtgcttcttcttttcatttgtgcaaggtgcagaagtggcctaagagataggtgctaggctgtgcctcaccaccttggggacgctgggtggatgacctcacccgctgcctgttctcccacctcccacagctattgtgaagctgggaaaggctcacgcacagaacttgctgtgggyacggggctgtgctcagctaacagtcgcctgtggttttttttttttttcctggctgcataagtaataccttccgccactgttggagttatctccacatgcacagagaagggtataagtmagcttgggccttagcatgacacgggatttattgctcatttaaaccctgaaagcaaatggatttttgaaaactcctgaagcatcagggaagtctgtctcttcatgattatctggttgtatttatggatcctttgccaaatataaggacgctcctgtcacttcacccatcttgagatgggctgcttttctataaatatcaaaatcccacaattatttcatgatttaatccccatctgaattttaaccaattgcaacaccctttttattattatcctctgatgtaatcagcctggagatacaggagccgtttgagtytggatggtgtaggggtgtcgagggaagaaggcagaggcaagaggagttgttttggcctcatcttaaaggaaacaagtagggagatggttgggccccctggaagtgccctgcaccccagtccacagccctggstttgaacctcagcttggccacttcccagccctgtggtcttgtgtggagtcttcagttcaggctccatcctcagtttcttaatctgtgaaatagggctgatgattctcactgtgcaaaacttccaygaaaggggtaggttatgcttagagcatttttggcacccaggkaagatgttagtatctgtaccaccctcttggtttgatcagaaagggcaatgcatgtacactrgtgagaagatggacagcagaaaagcatgaagaagatgaaaccaccccccagctcccggctccaagttttgaagtgagcactggtcacccagctatgtgtctgtcctgactgcttttctggcccattaatttttttcttgtgactagaattttatatctttttttttcattgttgtttgtttttttacttaaacttcatcagaagcctcttccctgtgaattaaaaccccttgtcaatttcacactccttgcygcctgacatcsctttcctgtacataacccagggggcagagcctcctgctgcacagcccctccagaccaccccgccatgtccrccatgtccaccatgtccaccatgcatccgggggcatggggccaggcctttagatcctccrccaaccatgagcccagccggtactcagagcctggctgctgattcactaggcatggagtttcaggaacggtggggctacctggatgacacctggttgtgaggatgttcgagtgggtgccagcatccctgaacctctgtttttttgttttgagacgaaatctcactctgtcacccaggctggagtgcaatgcacgatctcagcttaatgcaacctccgcctcccaggttcaagcgattctcctgcctcagcctcctgagtagctgggattataggtgcgtgccaccacacctggctaatttttgtatttttagtagagacagggtttcgccatgttggtcaggctggtctcgaactcccaacctcaggtgatccacacacctcggcctcccaaagtgctgggattacaaggcntgagccaccgtgcccggccccctggacctctgaccatcagtttcatgtgaccactgggaggctggcccagggagcttcagggactctccaattagcaaacggcaaggagaactaacaggtgtggccacaccataatcaggagasacagtctccgtgactcgaagaagcaccatgttattcctttggaagaggcccttgagtgtgggctgaggctcataaagggacagcaagtcatctgagagcacacagcacgctgttgaccaagcaggacctggcctgtgcatgaacgggggctagacctgcaacgctggccctcctcctggggggccacattctcactcaaattgytcctgagatgtcagcttggtaggtgggttccttgggtctgcaggacataaatcaaagtagtaaaagtgggggctgctgggaggatgtgctccttgaatgcttcttgttaacctcaacacagagatacactcacacttgyccagctttgacgcagggccagggctcttctgtgccatcggcagatgggagttccatgccctcttctttgcccagaccacaccctgcaggttgtcaccgtcytgcaggctgatttccagcttaggttcctttgaacgtggaagaagaacatcaaagcacttatgaaacaatctgagcacagaactcaagttgtttacgagtttccgtctatcagcagcatctcacccgcacctgattccatggaggctttaagtggctcacgttgatcacatctttccatagcattcaactagttttcatagaaacagcagctctttcttccyagtgagtgtagcctgtttgcgttaattgatcttgcgagctgcctggcatccacaggtgtggaaacaaagacagccagctcttggtctgcctagcaggtgggarcagatggggggtgaccggccctgcctcctggctgagggtggctggggtcatagggataatctgtccrcagggggaagtgagagggcctccacttaccgctcacctccatccatcccaccttctcccaggacgaaacgactcctcaggcatccgcttgtactacacagccaagctgcggcgcttcaacgcggggatcatggagctgggactggtgtacacgccagtgatggccattccaccacgggagaccgccttcatcctcactggctactgcacggacaagtgcacccagctggtgagtggggctgggcccggcactgcaccctccctcctcccgcgtcccycagtggaggcctggcaggtsgtggcccacgaagggtggcaggcacagctttggtttcccctgaccctgaatccccctgcggtcctccctcttttctgtatgcaagggaaccctgctrctgagaggccatttgtgtgtgtatgcacctccctctccagcaataaccatggctcccactagtccacacccacgtgccaggcttccacgagctgcattttaaaatatgccttcattatgtaagcaacacacacatgcacttgccactcacaagcgcwggcactgcagctaaagagaacgctcccctcatccgctgccgcctcyccctgagatagccacttcttggctctttgtgtccttccagacctttttcctgtatatttcaggaagctcttgcaggtgttagaaaccttttgtgtttttaaaaagttgtattgaatagttaacaaatttttcaacaaatgggaggcatttttctggtgatttgcctttttattgctgcatagtattccacaggatggggttttcaccaygcacctgagcagggcaggactaggtgaggcagtgaagtgccgggtacaggatctcagggagcacccgtcctcagggctatgcacgctgggtggaggcacaggttggcgcttagactggcgccaacagcaggtcctgtccttggcttctgstgagttcagagagtgactactaaaatctcctcctttgcttgccctatcttggtccaagcctgtgmtgaactgtctccctatcaatcagtgtctaggctgttctcaacttttcaccaatagaaagaagcttctgggaaatccttgtccatgtaggaaaccattttctcatgtagatttctaggcatgaaattgctgctcagagatgtgagtgttcccttgagtaaatcttgcaaaatgcccctcagaaagcccatcttctgctccctcccacacataggacgagagggtgcccggttttactgacccactggattattaatattgtaaatattttctgtcatttgggaggaagacatgtcagtgttgtttaacttgaattttctatttgtggacttgaggatcttttcctctgcctcttggccatttgttcctgttttctgttcattcctrtgctcggtttttccagtaggtggtttgtttttcttactgttggtttctaggagttcttcttatatgatggatgttatttcatagtttgtgtatatgttacaaacatttcctcctgtgcggtagctttacttctcacagtgacctgcaaagtaagtgttgacgtacccatttcacagatggggagactgaggcttgctgggatcacactgccagcagtcacgcagagkgaagattcaaataccagtctgtctgactttgaaagctgtggccgtgacagcagatttcgttgtaatgaggtttagagtggattttccttcctagtaaatgggtcgattgggatttgttcttcatgtggstgagcccccagagcatcccagtcttccaagcaaaggttcctcaaggctgaagggagacggagctctcagccggcatggcacccattgtctccggcaggaaatcagctccttttgtcccagacgggggtggacactctctcccacttccctaaagcgcccactggtgaagcgtgggcccatgtaaaaggcaccttggccagggctcatggggaagagcggcttccggccagrcagcactcactgccccttgcagggccttggggccttcgaccccgctgaccgctgactgtgagaacgcctctctccagcctcaggaatacagacccgcctccccttgccagagtcctccactaccttaagtaacagaatgagaatgttcagtcttgtctctcctttggcagataaaagaggggcacaaattctgcagccaaaatctggcctagtctagctatcccagtgaaataggccaagacaagagtgctgctttggaccagagtgcccagaagagcatagtcctccctccacctggccgacacctggcatctctgggccagggtcggcctctgggggccaaaggggcattgggaccctttgggctcccaggcctggcacacartggcctctcaagycattgcaagggacacaaagctataggcgacggyaaggtcagggcggccgctgcttgggagcgagagggaaggagcaaaagtgagtcctaaaaagctcggccatctgggaccttcagggatggggctgtcgggaccttgagctctgggacctgctgactgcatgaacaaactgggcagagcctggcagcgggtgggcaaaaggacaactgactcacaaagaaaatgctcgatttcaggaaagacgtgttcttttctttccttctttccttcttttctttcctttcttttctttttctttctttttctttttctttcttttctttcctttctttctttccttccttccttccttctcttttctttcttccttcctttctttttttttttttttttgatggagtttcgctcctgttgcccaggctgcagtgcaatggcacaatcttggctcactgcaacctctgcctcccgggttcaagtgattctcctgtctcagcctcctgagtagctgggattacaggcacgtgccaccatgcccggccaatttttgtatttttagtagaggcggggttttaccatgttggccagactattctcaaactccttacctcaaatgatccatgtgcctcagcctcccaaagtgctgggattacaagcatgagccaccatgcccagccatggaaatgcattttctatctaaaaaaagttagcattaggttagagaaaactttcgttctctggaagattctctcatgccccagtgatggcataagacctcttgagatgagggctgccatcttttctgtgaggccggcctgcagcctcagagtgtccagctgcagcaccccatggtcacatccatcttggtcctggatgaccaccttccagttgtagctacagctcccagctgtagcacggggtgatgctgagcacagggagaatgcagccttggctgctttgaagctgaaaggaagccacaacgcagggcagctgaaggtcctgctcggcccaccacgtaggggacctgccaagtaccaccttctgccacttgcttttccctggacagcaagctcttcagcacagaggccacgcgctgctcarcttggtggctttgccacaccctgtccacgggaggctcgccttaaaggcctgttgactgagtgaagatgaacctgtcaggcttcaggggctcaggagaggatgaaggactcggaaagaaagtcgctcctgagtgggactaggggctgcttctttgggagctgggggctgttgcggccmcctcgctcttccccgtgaggtttctgatggtggctctaacctggccggggagaaagacctagaaaatgcaagtgttccagggaagcaaactgcccagggtggctgctccctaccgggtcctggccatggacgggagggtcccctcgggggtcaggccctgacactgcagccccccgaccccacaggcactgcctccctccgggatccacatcttcgcctctcagctccacacacacctgactgggagaaaggtggtcacagtgctggtccgggacggccgggagtgggagatcgtgaaccaggacaatcactacagccctcacttccaggtaggaacctgcaccccacccctgccccgcccccacaccctgccaccacacgacctcctgggtctactgtttcctgacaccatagggatggctccaggctggcttctttytcctgggccagccccacccgccccccacccatgtggcctgtgctccccacttgggtgtctggtgtctgatcgtagggaggcctctggcacatggcagatggtggtgggattcgggagacccaggcggccctctgggaacatcaatcttggtcttggataaccaccttctggtttgaatctaatgccctccctggccagaagccacacttagcgggctctggcttccactgtagaggctggggcaaaatggacacccccagaggtcagggaggcytgagggaggacacagtggccgggggtctggtctgcagctctctgaggtctcctctcccccacccctcggctctgcctgccccaggagatccgcatgttgaagaaggtcgtgtcggtccatccggtgagtgcccagcgggaaggctgtcccactcactgccaccagctggggtggctgagagggctgggggtgccaccagaagragagggacacagaaagtgatagggggagggagagccatccagggcagggggagggtgcctgtgggtggctctgggctgggctacctcatggggagactcactcaggagttcatggagagacgttggaaagagtggagcagacaggacactcccaggggacgcgtgtcctcagtctgatggrccgaccacaaacccgagagtgtttgggggagatgagggcactaaggcaggcagtggagccctgatcccacagarggccaagcccaggcctcggtggggacttgcccaagtcctttgagatgtgtcawggcccaccagctgcacccccactggcctgggccctggccctgttgtgacccactgggtcacaggagctgatggtttataacttgctygggaacactcagcctgtgaccttcgcacatkaatctgctgggctccttgtagtggacgacagggactgtaccccagaggtgccgtggcatgcacagtggcrtggtcctatgggggcgaggcctccarcacctgccaacrccaggtggcaggtgctgatggtcacattggcttttcctcagggagatgtgctcatcacctcctgcaygtacaacacrgaagaccgggagctggccacagtggtaagtcacccccgcttccccctgcacctgcccagggcgartgttcagcctgagccatctgaggaaggatgacaggtcttgactcctcacttagggcatgggctcgtcccctcaataagccagtcgttctcagctccctgaaccacagtggcagcatcaccagggagcttgggatgaatgcaacctcctgggtgccaccccaggcccactgagtcagagacacaggcggtggcatcgggcaatccatgttttaacaagctcccagcggatgttgacccctgctcaaggttgagaagcactcacaccaagaagcttctcagcacccggggctggtgtggggagaagctgtaggacaagaggtygacctttgccccgtggagctcaaggtgcaccagggagacaggcctggagcacctgctgctaacaacaagcaaaattacaaaacaaaactttaaaaaccaggttgaggaggcagaggtgcggggacctgggagggcctygtcagaaatgtggctgtcacatggagcccaggggagaggggaggaggtgaaggaaggctctgtgcaggggctgcgtgcgggaaggcccagaggaccaagaacattctcaggatggaaaggagaggaggagagggtggagacatgggtgggggtcaggcaggatgagcgtcagctgaggatgcattttggctggactgcagacagttcaaggagaatctgcactggagagatctattttcaaggctgggtatgcaggcagcaccaggacacgggcagccacgtgatgcatcacgcagcggggctgcttccgggagccaaaggggatgctgttcacaattacctgggtcccaggcacaagccagggctgtcctgscaaatgggmcaccttgccagtggatcygtgccagctgcttcggtaaccatggtggtctccaataattatcctgtgaattgtgtggctcaagtggagcagacctgggttacagctaccctgacatccctcagcgccaggaactcaggtccatgtcacagccctattctttgtgttttaatccaatgtggattcacctgatgtttactgagcccagactgccastggtttattttattttattttatattttatttttttttgagacggagtctcgctctgtcacccaggctgtgtgttctcagcttgctgcaacctccacctcccgagttcaaccgattctcctgcctcagcctcctgaatagctgggactacaggcacccaccaccacgcctggctartttttgtatttttagtagagatggattttsaccatgttggccaggctggtctcaaactcctcatgtaatccctcatgctgggattacaggcatgagccatagcacccagccagtgtttgtattttcacaggtgagacataaaggctcagagagggcaggcacttgaccaaagtcacacagctgatagatggctgagcygggatttgacccagggtcttgtgcctcacagctgttaccccacccttcctgtctcccttggatttcaggtgacaagtgtcctaggttcctgatcacaaactcagggtggrgrcaggacagctttgtcagtcctttattctctctagaggaggtgctcagtatatcacagcagtggctgatgtcgggtgcttgccacagctcagcactgctctaataactcatcctaaccacaccaagccttgctgagacctctgagcaatcccaccaggagatacagtgaggtccagccactcaggccacacagcgaacaggaggcagggctggtatgggtgcaggtgccaaccccgactgtgccgcctctcggctaagcacctgtgcagtgactgagtgggctcgcaaacagakggctctgcaggtggagcaccccaggcaagtccccaccatcagccccattctgcaggcgyggccccggggcmrgggatgggagggtcttgccgggcatccagcgaggagactgcatattccctgcccaatctggcttcacggcggcggaactgacgccacgtcccagggcgttcggggctgccaggcctggtgagcaccgcggacatctcagatggccgttctgcaggttgaggccctcggtgccagcgtccccgtgggcagttctgtggcttccctggcccatgtcstcctcttggcagtggccacatcacagcaccaggtgggatcaaaggggagggcagctccccaggtggacctgarcttctcacactctgacaagccctcgcctgctgatccaagacacagtggcctttgaaattcgatttccttccccaggtgaaagaggagaacagattctacacagggtcggactcagttcccttttgatgtctgtggtggcagagggtggggagggacaggaactcacacaggagggcaatcrtcccgatctgacgggggcgggatggatgagaaaagctgggaaaggaggaatcyggcccagagaacaatgctggcaaaaacgcgtcctggccaacaggtgccaggtttcgtctctgggcagaactgycccatgctctttgtctgcacgggaggagggggcggcagctggtgtaagtgccacgccaagctttgcccagtccctttgttctgccatagagtaaagattgcctttcttccccaccagccagatgaaatccccaggcccacagcagcttcacaaacagcggggagcctggaggggcaagggtggccagggcgtcatgtcccggcccctgacctgctgggatctgagctgctgccgggggagctttgctctctccagccccagctcctccaagctgctgctgttcttcctcctatggctgaggctccacggtcaccagctccaagagcagcaacccagcgaggggcttaaagctggcagtggggactcagagggtgcctgccctgcccctcccatgcgatggcaggccrtagggttgccgtgagaggctggaggttgtcgyggcctctagtcacggtcctgtcttatagagtccctgctcccctcagagccacgttggagaaatgactggtggacggtgcggggctgcagtggaaagggcctcccttgcagtccttggctccaggctctcgctggaggtcatggggacagcttccagacaatggccgggacgctgggtgcactcaggctgtgccaccgatgctgtggccaccacggggcatccccttgcctgctctgagactcagtttctgtacccataaaatgggcacaataacaccccatccgcttgtcccgtttcatttttcctcacagcatcatcagtacctgatacgaatttcctggttgactcactcactcactgcctgtctctcctgccaatggtggcaattccttgagggcagggactcggttccccagagcatgcctggcacggtgcagtgaacagacgagtggacgcagtgtacacgtgggtgcggcgaaagctgctggatggcagygtctgcgtggcatggcccggggctgacgggtctcctccaacttgcaggggggcttcgggatcctggaggagatgtgtgtcaactacgtgcactactacccccagacgcagctggagctctgcaagagcgctgtggacgccggcttcctgcagaagtacttccacctcatcaacaggtgagggctccctgcacaagctccctgcccccagggaaccccgacacagaacctcgggcctgttaggcggctgggcagattggaggagtccaggctaagttctaggagcagagacctgtggcggcatcactcacccctcccctcactcgtttcctgctgagtctggatttggcttcagagcctcctcaacccagcctgcagcagccattacccacccgccaaggtgacaggagaggtgaggccgttgccggtgaaggcagcatctggggtggcctggcggaggcagyggggctggggaggaggtggcaggacggttgccccagggacaggactcgagttgcagggaggtgttgctggtgcccactgggctccctgcccgtcagctgctccccagcctggctgttccttgtcccsrscaggttcaacaacgaggatgtctgcacctgccctcaggcgtccgtgtctcagcagttcacctctgttccctsgaactccttcaacygcgacgtactgaaggccctgtrcagcttcgcgcccatctccatgcactgcaacaagtcctcagccgtccgcttccaggtgcgctgccatgggcccgggtggggcatgcagtcaggcaggcctcatggggggccccagtgaggggtgatgggyctgcactccaaactgctggcaaaagcactcgcacaagacaatgagagcaagtgccaggtggtgacacataggcctagacagccagccagccagcagagagagaggagagaggagagagaggagagagaggagagagaggagagagggagagggagagagggagagggagagaggagagagagaggagagagagagagagagagagagggagagagagagaaccaataacgaggcaaggaagggagggcaggcaccctctctggtgacacctccacactgtaccraatgccaaatgcaggtggtgtgagcagggcgcactaacctgcctaaaaataaagcacyaggggaggggaaggtaagaaacgaaccagtctgaagctgcgagctggttttttcctccttatctgagacccactggtattcgaaggcatctaatttatcctgggcccactgggctgtggtcaggagsccagggcctatgcagagttagtcgcrtaaggtgccgcagcctggagatccaggaagatccttcccagaagcatttgggagccrgattaactgctaagtcaaacatcctcagcaccaagggaaggaagggctaatactggcttgctgagaatagtgtggggtggacgtctgatggggttgaaaacttggcatttggtgtagccttgaggggaagagatagctaaaaaatatcagagcctgcagcmaggggctctggttgctacaytagggtgaatgattaaattgggtggggacagaggcggggagaggcctggatgactcccaggttcctgactaggtgaatgggaagccaggggagggggcatttactgaggtgaggacccccaaaaagcaacttgggggagcagagtgagttcagtttgagacaagctgagtttgagggcaagaatccaagaggtggctgggaagtggctggggaagcagccacccatcttgcccytccagcctcagtttacctcctgcccccttccttgcagggtgaatggaayytgcagcccctgcccaaggtcatctccacactggaagagcccaccccacagtgycccaccagccagggccgaagccctgctggccccaccgttgtcagcattggtgggggcaaaggctgaggggggacctactcctccccctcctccatgctgtccctgtgggctcacaccggcactgtgcactctactctgcgacgatccccatggaacagcmctgcaygcccaggatgaaggggccagaccacgcccctgcctgagaccacggtccaatccagccttcttcccccagggtcccctgcatggctgagagggtgtgggtgccctgttgacctaccctggaccgagtggaccacgacctcgtccatttaaacccggctgactcagtgcagggacagccygcacagtggtccagggtccagccctccgccagccctgttccgcctcactgggtgtggcctggcttctgggacaggcaccatgctgggccggggtgtggaatcaccgggaacrcccccgcccccgccccgctgctcccggtgtgcagcgggtgcgggtgccgcttaaacatttccctgctgagtggctcgtgtttcacagtgggcggcttccctgcgacggaggcaggaccaggcatttagctagttagagactcgcctgggaaattgctccattcctgagtaaacagatattttcgcccacctaaagggaagccctgacaacaactatcaccaaaagacgaggcggcaaagatccagcggggcttctgggcgccggttccacgtggggtggaattattagcaccagcttgcttctctgccggtggggccagcgctgaacagaccggggtggagtcagggctgtgctttccgcgtggttctgccacttagggagtgtgccttgggcgggccatttcacattcctgaccctcacttttctcatctgtaaaaccaggctgatgccgtgcgggctaatgagccaataaagctcacacttgggctggcacccactggaggtgggtatgtttgcactccgggccgtcgctccaggagagagaascttgctcctgagcctcctccctgtgccaggcgtggtaccaagtgcttccccctgagcgtcctgaagctgcctcagctggcctgggtgggtctcccctkcctgccctctgagctgcctctcagggacaagttcagctctttgatggtttctggagacagtaacagatgcacttgtgttcagccacttcagcaaaacgctgcccagcctcatggggagagagggagatggatgggcctcggagtcccctcgcatcagctaagcggctgctgctkctgcaaggcacttcacttcatcacagaagggaastcacgagcccagsagctctgcctcacgttgtataaatcacagcttcttgtggtccataagtcacggcgctagcgctgtgaaatgccaggccccagcctggagagccrctccggccctctgtcatctttacagcctaggtgacagtagacacggagcaggcccaagaagcctcttcccgcgatcacacccaattgccagcccagagaagggtcccagggtcctgcccaaacrcctggggggcacttgtagcctgccratctcgggcagggaaactragactcccagataagtacctcacctggkgcccaagagcggcagtgattgggaatcctagccagctctggaacctgccacagcgacaaccccacccccacctcaccccccactcacactctygctctcaggctggttatcctcttcctcttgcagagacagcagccgtgtcccccctaccmcgctccagcagtacccgcacctcctacacccagataagcrtaaccccgtggttgctgagagttgccacttgccccacactgaggctatgcacagcygtggcaatctcgtgaagccatgtagtttctgtttccattgatggaggaggaaactgaggctcagagacctaaagttaggtgccaaggtcacccagagtaagccggggagctcgaagtgtccccaggtctgactccagtgtctgaatgctcaacctctgcttacttaggaaacaggaatttccccaggacccttgtgggggattttatctaaaataagttccttatttagaggcttaggggaagtgctttgttacctgaaaatgacctacatgccccaagccaaagggactyygggctcgcccaccttccgaatgattggggtgtgagtccagcagcccaggttgctattcctgcccctgctgtgtgaccctgagttagttactttccttccctaggcttgggtctccctatctgcccaccgaggagagggttccccagcctcccagggggcagggactgctagggtggcacaaccccccatctgtgaggtgctcagagccctggggtgaggaatgctcatgcccatcagtgttgagagaagtggggcgaccccaggctccagccagcataggggtgcctgcccgactgggtcccagagcacaccagggctgtgctttctggtggcygctagcctcatgtggctacttacgattaattttaaattaattaaaatgatacaaggtcgggtgctgtggctcatgcctgtaatcccagcactttgggaggctgagatgcgaggatcacttgagcccaggagttcaagaccagcctgggcaacatagtgaaatcctgtctctacaaaaaatacaataattagggctgggcgcggtggctcacgcctgtaatcccagcattttgggagactgaggcgggcggatcacctgaggtcggtagttcgagaccagcctggccaatatggtgaaaccccgtctctactaaaaatacaaaaattagccaggctgtggtggtgcgcgtttgtaatcctagctatttgggaggctgaggtgggagaattgcttgacctgggaggtggaggttgtagtgagctgagatcacaccactgtactccagcttgggcaacagagtaaaaccctgtctcaaaaaaaaaamaacaacaacaaaaaaaaacaaaatggaacctttctgcgtcccattcatacccccaacttttcacatggcccaaggctgtctcactgcacactgtggtatagcgctctgccggtgacgatgtaggcactttcttttttttkttgtttttgagacagagtttccctcttgttgcccaggctggagtgcaatggcataatctcggctcaccacaacctccgcttcctgggttcaagcaattctcccacctcagcctcccaagtatctgggattacaggcgtgtgccaccacgcccagctaattttgtgtttttagtagagatgagacttcaccatattggtcaggctggtctcaaactcccaacctcaggtgatccgcccccctcggcctcccaaagtgctgggattacaggcgtcagtcactgcgcccggccagtgtaggcactttcaaaacagtttgctcagaattcctgagaggcagtactcagccacagtgagcgtcatggtatcaatatttccagaaaaaaaatttaaaaatagctacgaaacggtgtttttaaagttgaggtctggaagacctggctcggggtctgggaaggtgggtcttttgtgatgtggtccccgggcggtgcacttgggagccatggcggggccaggacctctggcagcgcagggatggagcccgcaggtgatgagcttgggaggtgagttgtggaggctgcgctcacatcaatgcccagtgccctccccgaggggcmaggttctctctccacaggggcgggggaagcacacaggggacagggaggggtgctgggttctctctcctcgggacagggagcgcagccaggtkctctctcctcgggacagggtggtgcygttgcgtgcattccccagctgcagccacgagaaacaatttggagcggaacccgggctctgacctcccctcatyctcagccttcccccagggatgggccgtgagatgaatgtggtcaccggcccaatccaggggtctatggccaaaccgcagacccggaggaagcaggccaggccatctggggagccggctcccctcctctcctcccctggctcccacaaagctgtctcatccagaagccaggcccgcctgtgagcaaggkgaggctgcaggtgttccttcagcctgaagcgtgtgaaagccaacagcccccaccctkgtctccagccgcagccccctccccagactcagggggccaaacccacttttcacagccatctgtaacccaaacgtctgcccacagctttgttcgagctcagtccacagtgggccgcgtggcctgggagcgtccagtggcagctggggcctgccaggactgctgcccccagatcgctgtttgctgtgtgtgtggctctgtggggccccggctccacgataccctcaagcatctgcctcccgctcttcccagattgcagggcatgcctggcaagactgcgcagtgccgctctgacgggcctgatctgaacctgggctcggggggacaagggaggggactgagcacgtgggatggacagagatgcacacccctcccaggcaggagaggcagagctgcttctgacacacaggcagttatcagggggaagagaaggtgggcagaggagccaccccatctcaaggcagcgtgcagggcagagcctaagagagggtcctcctgcaagggccagacaaggaggagggcatgggcaggaaccgcgtccaaatcaacagcaaagacaaaggtcacctagaaagggggactccaccagactcttacccagcagcacgtccctcctgcctgggcctggtgagcgaggggctcaaggggaaactgaggcaggagctggcacttctgtgtggrtgaggaggrcaccaatctgaggccccgcccgctccctgcttcggctcctctgtgttcccgggctgccgactctcaggaggctttgccacctgaagaacagggaggtcsagcaaggtaagaagagctttccagctcctgttccgacctgagagccgagaggcaccatcctgaagaatggccttggtcccaggcctccatgtgcgctgtggcagacaatgccagtcgatcacctctctttcctgacccagacacagcctcatgctcttcagccaagtgccccagggargcccgccaccgatcagtcaagcctggagtaaaagatgaagcctatttgcttcgctgttttcacgtggggcttatcaagtatttactaagcaccttytagaagcttggaaagggctacaagccatggtccctgagcccaagacacttacaggtttgctttctgggaggattggggtggattagagactgccttccagtcagtgaccacaggatgggccatcttggtctctgtccgtatctggtttgggggttttcgcaggactaggcctaggctaaggacagggagggcacaagttctggctgggtccagggtcctgggacccagggccatttgggacctgtgagaatggatggacagcatgggatggggcatgtggtctgagccctcagtagattcccttcaccctcttgttgttggggtcgaagggcgacttcaggtgagcctgggcaccataggtcacccccattctctccagggcatagtccccgctcttcacaaagtccagcgagacctaggagcagaggtggggatgaggatcactctctgttggtaggtacagggctcacgtctgcctgyttctctggaggagggggtcttggtcttgctacctgccctgtgggcaaactcatccctgtgccagggactcctttctgaacccaggcattgccccagagcaggtgcagttcgtgtccatgtgatcttgagttggacatgggcatctggggtccggcaaagccaaggtctggcarccaatatgacttccaccggacaacacacctcccaycccagcaattccagatgcctgggaaacagcagcaacacggtggcttccccggacccgggcaagcacagcggccagagcagcgccgaggctgggggccaatccggctcgaatccctcggggcaggggcggctggaacagccttctagacagcttggcctctgcatgctccccatcccacaccctggctcgggctccccagcaagysctcgggagccagtcagccccaggtgcaggtgctcttaggcaggaggagggtgtcacctccagcctggcacwgctggtgacgcctggcacttttgctgcagctgctatgaggagggcaggctaggccactcagggaagctgttcttcctttasagcaattaaacccaaggtcagggccacaggagggagtctcgggctcygctctgggagtcagagggctccttcttgttcctagcagctcaggactggatgaaaaaaataaaaaacaaaccaagctttttctgcgacaggagctttaggagtggtgcttctgagccatgtgtgcacctgyagggctgagagctctgagctgccccccgcaggcaggcagcatggagagctggtggccttcagatgtccacgggcakgcacaactcaaagcgggcatctggccttgctaacagatacctacgaggcagaaacgccttccccatctcggagcctttcccatcaatgagcaggtttccctatcttaggmagaaacctccgttaccccacttgggtgctagaaaatgtttaacaaccagctctggggtgaggtgggtgtgactgtagcatttgcccatttccatggtgcaaatgctctggacagccctgatggagggggcaggagacgtgcaccggccgctctgggtgcatcgactggttcccsggctgcctgtctggatgccgtttaacctcggaacctcggcttccctggtcacgttggttatggacccatccctgactccggagaaaggcgagcattactgttctttgaagaaatggcaaaggagcctccactccccagcccaccctggcatggagcccataaactccggtttggctgggccccagggctgtggcccccaggaccatggccccagggctgtgtcaggaggccctgcccaccgtgggagccatgccatcacaatccccacatattaaga

SEQ ID NO: 13316 - DNA, 23597 bp, Homo sapiens
gctctcctccttatgggttgtgtagacttgaatgaggtcccctctccaagcctttatttactcattgctgcaatgacagcaacctctctgcttcataaaagggtatatgaagcaaccctagcatggtctccaataagctcagtgggcattccttctctgtccccaccatatccatatggcctttctacaactatttctatgtttaaaagagctaaacctgcctgttatcccatttattataattctttcatttcgtatgtctaactgcacttgagtcctcacaattcagatggatagagtgaaggcttttcagaccctcaactgattaggtgaggcccacccacactcaatggggccacctgctttcatcacatggatatgctgaagacagattgttgaaatattctttgtttttaatttaaacttgtttcatcatactggttcttttgaggtgattttcatctcactttcaggtcgtttgagagtttcatcttactatataatggttgaaaaaggaaaggaagtcatcacttgcccaaggtggtggtgaattcccattctgttaccagccaagggaagggattaggggaaaatatttcacccagaaaagtgctgtgttgtttgagttcgccttttggttattaagggtactaatatatttttcatcaacaatgacttaaggcccctagaagttcatgaacctggtgtgggtgtgtgtttcccactcagatgtgctgtgtaacttgcacctgagggtaacacgaactctccstgggcaagatgtaaccagggaaagaaaggagaaggcagagctcagagcaagcagaaagccaagcaggagaccaaaagaggcctcagaggccatgtttgcatcttccacagagggacagacacattctctgcctctccagtaaacacaaacatgcaaacatgcacacacagagacatgcacacacacggaccatacacaccacaccacacacacacacacacaactacttatgtttctgaatattacaaacatcattacaaaatatgaaatgtacaaagaacaattcccggtggctcatgcttgtaatcccagaactttgggaagccgaggcaggtagatcacccgaggtcaggagttcaagactagcctgatcaacatggtgaaaccccgtctctattaaaaaakacaaaaattagccaggcacagtggtgggcgcctgtaatcccagctactcaggaggctgaggcaggagaattgcttgaacccaggaggcggaggttgcagtgagctgagattacaccattgcactccagcctgggcaacagagcaagcctccgtcttaaaaaaaaaaaaaggaacaattcctgaagcttctgatgatttctggctgaccatgaggttggaagtgggaacacattaagggcttaatgatgggacacagtgatgtaaccactgtggagccacaattgaagtgctgagattcagcattggaagacatctctgtcaccaaatgaacacgcctccctaaagagctctggcagtgagtcaaaggcttcatttgggtcaagacagagttattatacaaaaagccaagtttcattctacaaatccacatcggggtcaatattttaaagtgatttcccccaagttctgtgtagagcaagctgacagagaagaaatggctctgagatatctggcaaggtgcagatggactgaccacaagccgcttatccccactgtagctccgggctcccttctaccacagtggccatatctgtgaggttctgccctttccctggggccactgcatcagtcagggctctccagagaaacggaatccacaggaggtatacctatagcatacacaaaggctttattataaggaattggcccatgcaattatggaagctgacacatccaatgtctataggtccaaggtcccagttccagtcctaagagkattctcctagttagagacttctctctaactagggagagtgttggctttttgtcttcaataacagtctactcaggccctcaactaattgggtgaggctcacccacactaggaagggccatctgctctcctcagtctactgactcacttgtcaatctcatccagaaaccccctcacagacacattcagaataatgtttgaccacatatctgggcaccccatgccccagtcaagttcacacatacaattaaccatcataactatctgttagaccccaccttgcagggggcagtcctcctctggaaaccttcaggacttgaagtgtcaagctcatgtgtgcaaactgtgaccaacacacattttcctgagaagaggcctcagacaaacaaaaaaatatcatgcatgcacatttactcagataatgactgtctgttgcagcctttaygctaaacagagctaagagtagagatagtgcagattaactcagacccagaaacttggggaggcaccctgggatcctggaagcagatgctgggagggcagaggggaccgagaaaggaggtgcatttactcagctcttctgagacaattctgctctcctgcggtgcactcgttctgctggagaaagggctcactttgagtttgaatcttaaaactgcatgtcctttaaccacactgtacctgctcaccaggctgtggacactaaattgttgggaaagtgaatatatttcatttttttaattaaaaaagcatgtaaggttatattacataattgtgatatataatacatttattcaaatcatatttaagtttggggccacatgattttcaaaagtatacagatataactcatagtatctttcaattttattcccataagcctagatttgatttaaagtctaagcgcaaaggtagagaaattttttagttgtttagtacctgccattttatttttctccaactttttattatggaaaaagttcaaagatacaaagaaggagaacagattgtacaaccccttccctaaatccaccacgtagaaccaataatcaccaaccttttgtcatatcagcttatgtgcacgtactgtgctgaacaatttaaaataagttttagacatgaagacattttaccctttaatacttcagcagcacctcctaaaattaaagccattctcctaaacaaacattatgccattatcacacctaaaaacattaacaataattctatactatcagtcaatatcccctccaatttgtaatttcctccaaaatgtttttgtgtgcgtgtgtgtgtgctgatttgtccagctgggagtcaatccggatttgtacttattgttatacttcttcttttcagctgttcttataccagaagaatccttcaccccttttwcttgacattgattttttttggaagagctcaggactgcagaatgcccacactctggtagtccagtttttcccatggtgtcatttaactcatggctcaaactcttccatttcctgtaaacttgcagtaaagtctagaggctttgcaattgattcaattgaagcatctttggcaagcacacagcaacaatgatgttgtgtgtttcttttgcatcacataatgccaggttgagccagtattagtgacactgagtttgatcttyctgtaaggtacagccagatgtctccataaaaaaatggaaaatggaaaacctttttcttttttttttccaattagcacccgttcgcctgcacactttcacctaagggtttgacacccactagtgcacactgcctgatttaattatttcattaagggttacagaatggggatttcctcattctcgcatttctacgtttatgagctggcattcttctgttaaactgctttcacttgtgaaacaggatgcagaggaggagacttattcaacagaattgtagggagggctgtttctctcaaaaggagtggtgagagaagatggtctctaccggggcatggagggctccttgtcagagtctagtgtctgagctttaaggcccaggaagagggcagcagatgggggtggggcagtgggtgagtgagaggcccgtgtgtggggagacccactgaggacagggatckttaggsaaacggagcctcactgaaagaggaatttcagtgatgccatgggtcagatcctgggtctctcttagggaaacctgccataaagcatgagagccacattactcctcaggscttctgggctccgattccgcagactagttttggaggcatcaccacgcctcaaggttgctctgttatatcagggtaactgactttctctaggaacggagacttgggtgccccttaaaacaaccctcagccagtatcctagcagtaaatttttcatcacgggaagcaactaattgaacagaggtgtgatgaacctactgaccactttggtaatatagacacagtggccacagtatgggggattgttatcctggttgtgaccaatgccaaaggagcatgtttccttcttttcttgacttgatgctgtaggagtccaacaaagggaagcacattcaggcccacatgaaacttgggacagaagtggcttctcagagccgtgcaccaggcactttgaacaagttggaaggctacagtgccggragactccacagtagcacaggcgaagtggcttaggcgaaaacgctgggaagtaccccagctcccgggggccagagcctctagggctggcagcctcagcaggcagagtcacttgcctccttcagctcaattgctgagggcttgcgtttctctgcagggaacaggagtgccgccgacttccactcttggtgcccttcaccgctcaaactgcaccccaaataagcgtatgcaccctgctccaagagaaggatgcgctgggctgatcctctggaggcaagagggcaaaagacagaaagtaacgagcggcctttgcacaaagaatcctcaactctctgcagcggcccctgcggcccaatcctgccggcccaggaatgcacggtcggataacaggcctctccttgctttttcgtcttcttcctcccgcttctctcctctctccttttcctcctcctcctttttctttaattttctcctttctccccaagcttctacagttgtttctgtgttcgctcaatcatggcctttggcattgattgaaaatttggcagttccttctctcggaattctgtttgaagccttcatatggatttattattattattattatttttgccacacaaaaggggcaaatccgcgtgaggaagggggtcgcatgggggtcggctgagatctgctggctgccggtctaggaggggcgctgctctgtgccggagtgggctctggtgcaccagcagaggctgggggagagtgctgcccccgcctggagcccaagtctctgcgtgcctgggggtagagcgcggagagggmccaggcaggcgccggaggggacccgcgmggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagtttagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatcwggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacacccyccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatsctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggkaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttacttttggaataaagcaaagagtgaacactaatactgcatcagtcttgccctctgttaggggccgccccttctccccacaccagttttgcaagatgggctggctggggtctgagaaacccagtgcctccgagtcatggttaaagcccatctcagacaccaacacaccgctcacaaatcaacatcgacctgcgaaaacatggacatgtgttcgccaagagaacatcctcaatcaatcccagcagtgctacttgatgataatcaacacatgggccatggaagaaattaccccatgtccataaacaagaatgaatagagggtagtgtatctacccacaccatgagagcaagaatattcagcatgcaggtgcatctatgtgcatgactcgtacaagcatcatggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcratctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagtycctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctmgccatcccagtacttccacgtttttcrtgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttyaygctgggcgccctgcccattctgggctggaactgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcrgacrgctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgrtcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaaraaaagtgaacacgtttgtagaactttcataagcacacagttgctgtgttgrgttctctttaaaaacaaggacaaaaccaaccagcgttcaaaggaacctcccatcagagtcccctaaagtattttaggttcagtgagcatytgcctgaataraacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccrctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaacyttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaataacctttcccctttcttcttacccactatcataggtggtattttaatgaagcrtctgtgccttgggtgctatttacaccaattttggtaggtcatactattttgagaatggtcttttgatagggagaaatttctaagacccatggtaataaaagtgcagctcaaagacatgggacctcttgtcctgccccatttgctgttgtttatgcagcaggagagaataggtcagaaccaacctttgcacactagctttctcccacacaaacggtccattttagcctctctgtcccacttgctatgtaaagaggaggccagtgctcggcataactgttctggtagcgatgcttgttacaactcatgatgaaatgtcccaacgcaagtgaggacgcagctgcccgccccagagctagaaggtaaggtgagttctctaggagtacatctgcccggatgcattttcattccgcagccttgatgaatgggacgaggctttgttgtgactgttttttaagcagtcccccagggaatcactgaaaatacctacttcttagagaaaagtttcaagctcccctcctctcttttgtgaggcaatacaaaatccatcatccaaatgaaagatacttttcacaacagcctttattgcctgcagacttacatgtatagtcctttaaacaattaactgtttagaaaatggttgtttctctcaacccttgagccagttattccacgctggtaagaccctttcacagaaatgtaacaaggtgcattttatagaaaacatctaattaaatcaccagtttcatgcttttaagttgtatctacaagtgcaaaactgcaacacccaaatgtttttagtatctaagtcagatatccaaaagttagctccataatcagaaatgcgcacaccactgttctgataataaaggcacattttccaataaccaattataacaagaagtgcagcattacctaaattgggtgtgtcatcttcccctcctgggtcacaggatgacacctggggatgcgatgccgtgcctgcacttggcgatcccaggagcacagaaatgcaccagacagatcatgaagggctaatgcttggaaaccacaccatttcctgacagagtgaaggratccctgtggatttatcaaaagggaggagggaatttaagctaattctcttcacctgctgtattctcaaatctccaaaacaccagataacttaggttttttcatttgtcatagaacaaagattagagaacttgaaattcgttttgcatttccactcctcagggatgtcaaaaaagccagttctgttccagcacaaagtagaaagtggtgaattggcaatacgccaagacatagactgttacagtaattctttttgtttcacaaaagttaatggaaacaaaacaactttcagataatattcatttgtcagtatgtataatttgccatccaaatgctttttaaaaagttattatcttattattacacattaaatttacatggagttgtctcctaatcctgggattttaacaccaaatgtttaattctgaatacaaagaaacattcacatacttaattttacaatattctggaacaagttatattcaaaagtcaaatgaacagagaacattccacttgcaaccaacacatagctgttaacaaaattaaccccattaatatttaaagacggatttatccattaatgcctgttttaattgtcacttgattttgatggttagaaactttggttatggtaaaaatgatcacatgagtgggaattcattacctcaaagctcaggaccacagctccccatgtgcatgtttttctgtctgcagtatttcaaggtgagacaacaaaatagacacctaaaattgtatgagattttattcctggtgctttttcagcgagaaccatttttccagacctagggaaggagcctgtgtgtttttggcctgaaggattcatcaattcagagcatctgtgacagccaggaggaggaaagaagggaggctgggatcacctcccgccccttctagcatctctactgagagtgacaactccaggctgtccacccccatcctgagccttccacactcttctccrtgccactaacactcagtatctgacgcctgcagtgcgaagcctccagagtccccagactgacctgggcactccacccttgctggttctactttacttggacacacgggtaccttaaggcttgtcacactccaacacctttgtgtgtgtgtgtctttatttctttctaggttataaactcaggcagaggcctcatacattcacttctctatcccaccatcccagtacagggccagccacatattaactaatgcacaaatgaggccaagaaactggctagaaatcccaagaaactgtgccaagtatatgcagctgcacctgggaatacacgaaagcatgacatcacgagcacagcctcctccaccacaccttccctttctcctccttccctgctggcctcagacagctatgcatggctgcatgaaggaagatctaaatctggacttgttttatcctccccttcccttcttctcacctttattctgcctccaccttcttctttctttgtcttcccccrctggcttctctgtcatttcccacagtgggttcccccaatccctgtggtcctcatgtcctgttcttgttctctttgtgctggatctcacatcctacagcatccaggaccatcctccatggctgatgccacagcctgccaattcccaaattcttcacgtttgtttgacttcctacttagctgtaaaaccaaagcccagggaggagtcccaaggtgcacaacacagagccaatctgcgtgtgtacagagatgcagatccgtttttaatcaatgtaagtatatgcgtatatgtatatacatatgcaattcacattcacaagtcctggtataaagttgcaatttttctggctgctataaaatgtgccagttttaaaactgtgcatttgttgcttgcaaacttataaatatgtataaaccccattataaataaattatggctggcagatggcatttaagctgccagcaatggttgcatggagttataaatgcttattaattctccacttttaaattcacagcacggaccctgggatctgtgacatgaagtggtgtgaaagcataattataaattagaggggggaaagccatcaataagagacaggtaagggctggaaactctcaytagtgagtggttctcaaagtcaagacttcagagcagctgcaccagcatcacctcgagattttttgaaatgcaaattcccgggccccactccagacctagggagtcaggaacttggcggggccaggggggtggaagggcctgcaatctttgtctgaaccagctcacagggtggttytgatgcctgccttccactcsaagtctgcttgtcacgaacgcctgtctcagctcagggacatccccggcttaggaagtatgctcaggtgtgtgcagggccagtcagaaattgtttccagaaacagcytttcataagtgatagacttggtgaataaataccccagctgtctccccgccttgctgggtgaactctggggtgtcagctctgtctctcggggttccccrgtgggattcagctccagttgtgcacatgacggtaacttacttgataatgcacgccttccccgtcagcttccttctctccctacttccgggatcttcactcarataaactacataacctcaagtcctctctcagggtctccttctggaggaaccccaactaagaggaagtagaaacactgtctctcccatctgaatgactcaggcttttatgcattttgagatggagcacagatgtagaacccctggagggaagcactgcttgccatttccgtggggcagggggct

SEQ ID NO: 13317 - DNA, 32070 bp, Homo sapiens
  misc_feature (1)...(32070): n = A,T,C or G, or insertion/deletion polymorphism (see Tables 1-2)
gggaatatcatattccctgatccaccctcatcagggaaggtagaaagaatgaatcaaactctaaaaagtcacctaaccaaactaatcttggaaacgcggttaccatggacaaaatgccttcccattgccttactaagaatccaaactgcccctcgaaaagatctcggcctgtccccttacgaaatgctctatggactgccttatctaaattccactactgaccttcctacatttgaaacaaaagatcagtttctaaaaaaatgtatattttgtctgtcttccaccctttcctccctcaggactcaaggccttctagggcaaactccaccctagttcgaattcccagttcactaacaccagcccagagatcatgtccttatcaaaagacggaaagagggaaagttcaaaccaacctgggaaggaccttatctaatactcctaaccactgagatagcaatccaaaggccgaaaaaggagggacccaccccttgcaaagtcatggactgtcactccaggaccaacaccctccaaaccaatgttcaaaagggtttrgtctgtctttttttttamttcctttagttaccaaagaacatcttatcatcartgtaacccgatcaccctgccctcaaacgatcacattcaatgcttgccttgtcatgccctgtggagacctttagagtcaaaaacagctagcttcttcagaaaagtacctctgcccctccacccgcttcagacaaatcagaaacccttgtgatggacaaccacgagccttccaggggttatgttataattggggagatgttatctagaccacccagtatcagggctggacctcctcagagggttgcaccgccctaaaaccttacatccaccttaccaaaggagtcacaccctcaaattgccaaaaccaccagttttcccaaaagtcagaagccctacgggacagcccccaagggccattcgacttccagctcttgatgccaattttacctcatgtctctcatggcaaggggaaaatctgacgttcctsggaaacctgatgggatgtactgggcctaaacctttccaagagctaaccagtcagtcagccctaatccatccccaagcagatgtacagtggtattgtgggggaccaatattgagtactctgccaaacaattggagcagcatttgcrctccgatccaattggccatccctttcaccytggcatttcaacaaccagacaggaagcaggtaacccaaaggaaaagagaaacccytcacgggtcctttgayctctcatatttacatagacagtatcggggttgcgctggggggtacaaaatgaattcaaagctcgaaaccaaatagccaccaggtttgagtctgtattattctggtggtccactataaacaaaaatgtagactggatacattatatatactataatcaacagtgattcatcaattacaccagagatgccataaaaagaatagctcaacaattaggcyctaccagccagatggcctgggaaaacaggatagcccttgacatgatattggccaaaaaaaggcrgagtctgtgtcatgattggggtccaatgttgcacttttatccccaataacacagccctggacrggacaatcacaaaagccttacaagccttaccaccctagcaaatgaattagccgagaactctggaatagatgacccctttgcaggtgtcatggagaaatggtttggaaaatggaagggactcatgacctaaatmtttacctcccttgcaacagttacaggtgtactcatccttgtgggctgctgtatcataccttgtattcgtgggttaacccaaaggctcatagaagcagctctcacaaaaacctcccccacctctccccatccatagtcagataagctcttgctcctagatgataaagaagaacaacaaagccaactcctgttaaataaatttgaargggaagaactataaaacagaagaggggaaattgttgggacaactaagttcctcttcaaagattcaacttcctggccataacttggaaacaaatcctacccctacaaccttttcaaaaatcacacctttaccttatttgggaaggtttaagcattagcctgtcggggtcagcttagattatgcggcccaaccccagccaataggggaaggacacagaaacagaaacwgcsttaccccagccaataggggaaggacacagaaacagaaactgcgttaccccagccaataggggaaggacacagaaacagaaactgcgttaccccagccaataggggaaggacacagaaacagaaactgcrttagggataaaaaccccttccctcctttgttcagtgtgctcttgggattgtaacaggmacaggcagcacccttctacagaagtaaaagtgacttgctgagaaattttctaagtgcgggtttcttttcgctacaccragcacttgtttccaacacatgcaaaccagaatggaggtctccctggacctgggtttgggccacaagcttgcaagaccttgggcaagactgttccctcttctgaaccaagtccttccctggcccagccgcttgtgagtaacacatcagtttcatgcttacacctcctggtcttgtgagtaacacatcrgtttcatgcttacacctcctggtctgaccgggctctcctttgcagagccttttattccttcccttcctctgaacactggctggctgctttcagggaagaagttcarggcagtggcagggagctccttgcacatcgccatgacaaatgttttatggaaacagtgagctgatgggacgaggggtcggggctagaaagtcagccaaaaggtgtgagaacccggactagcccccagccctgaacatggcaggccactgtgccatggtaggggagtgaaagtttccctctgctcctcttagggttccagctggggctccttacaaaagagaaaaacagttcattaatgcatgtagtgcacctcactgaagaagcttcaacaaaaagcaactcagaacagtgacttagaactgggttatggagcaacttcaacaaagaataatcaacgtgtggggaaatgacaggacccaggagagcggttttaggcttccaagtttgggaaaccrgcaaggtgagtattgggaggaaactaaggyggaagtttcattcacagagccctagggtgccttctttcctctggctgatgcgtctctctcctataatttccatcctgcctcagacagcagagggacagggcagagagagatttccctgcttctgctgcatcttagttgccttcaactcaagataatttctgaggctcattttggagtgacatattctggtgtccttcacggtacagggcacagcctcagaggaccagatccacagctgatcactgagctcttccatgtgccaggcccgtccagggagaacactcagccccacaaacagggcaggtggcaccaggatgctgggcggcagcctaaccctcagctcatgggtgggtggagtggagagcaccctccccatgtggggctccctggtcgtggacctggagaccaccaaggctctgcagtctcagaagtggcctgttggaatggggtctgcaggcagggaagccttgggccagagtccctcaggggcaggaacacagcccccaggcttgtcccacttgtccctctgaatagttaagggctgcccacagggaacttccctccctycctcccttcctycctgcctccctccctcccttctttccccttttcttctttcatcctcccctttcttccttccttactgtggtaaaatacacataacatgaaatttaccatctcaactatttaaacacgcacagttccatggtgttgagttcactcacatcrttgtacagccatcaccagcatccatctacaacactcttttcatcttcccagactgaaactcaacaccgttcacagctccccattcccgccttccccaggcgcccaccattctcctctctatttctacraatttgatgactccagtccctcagatatgtggaattgtggctgggcrcggtggttcacatctgtaatcccagcactttcagaggccaaggcaggcaaatcaccttaggtcaggagttctagaacagcctggccaacatggtgaaacccagtctctactaaaaatacaaaaataagccgggcatggtggcacacatctgtggtgccagctactcaggaggctgaggcgggagaatcgcttraacctgggaggcagaggttgcagtgagctgagatctcaccactgcactccagcctgggagagagagcgagactctgccaaaaaaaaaaaaaaaaagttaatagaatcgcatggcatttttccttgttggactggattttacttagcataaggcatcaaggctcacccacgctgtagcaggtgtcagcgtctcctccctttctagggctgagaaacattccatctagagacagactcactccgtgcagccatgacgccttggtgaacaccacggctgcttccagsttttggctatggtgagttccgttgctaggaacacagatgtgcacatgtctcttccagaccycctttcaattccttgggtgtatacacaaaagcaggattgccagctcatacggtaataatatttttatttttatttttattttttgagaaggagtcttgctatgttgcccaggctggagtgcagtggtgcgattttggttcactgcaacctccacctcccaagttcaagcgattctcctgcctcagcgtcccaagtagctgggrttacagactcgagccaccacgaccggctaatttttgtatttttagtggagatggaggattcaccatgttggccaggctggtctcgaacttctgacctcaastgatccgcccgcctcggcctctgaaagtgctaggattgtaggcatgagccaccgcgcccggcctcgtacggtaattctgtgtgatgttttgaggaattgccacaattttttcctgcgcctgcaccagggacacgtctcggagctggcgaactggacttggggtgggagggaaaggaagcattaaagatgcccccagctttcacggagatgagaacggtgccccgggagggcgggacgggatcagggtcctgtgaacgggktatcagtgtaaactcctctgagagatatcaggaaaagcaggaagaagcctctgggacccttcgggaggtaactcctcttcgcagcggggcgcgctctcccagtccctgcagccgccgccgccctctcctgagcttcctcgagcggacgccaggcaagggcgggggtcgtagcggggcggagcggggctttgtccacggaccgcgcgaagaggcctcagggcccggcgcgggcgccggagggggactygctcgcagggggaacgcgaaggttcctcagtctgcgggacgcagagctccgtggggccgcgagccggggccggggaagcgactctgcctagggggacgtcgcgggcgcggggcacagggtcctgcggggctggagggctacaggctgcggcgcgcgcgagccggaaggccggggatcgtgggttctggggccgcagcttcaygggttcgtctcccccgcctccccgggggagcaggatgtcagggggtcgcccccgcccgggagacagggtgtcaaggggcccccggggacggggcttcaggggcacccggagccgctcggccccagggcgggatgcggggacagggccccaaggtaccagggccacgaggggcgcgcgggtcccttggggatgcgcgcgaggaggcgccgtcccttcctagcaggggtccctggggacccgcggccgcctcccgcgcccctctgtcccctcccgtgttcggcctcgggaagtcggggcggcgggcggcgcgggccgggagggggcgcctcgggctcaccccgccccagggccgccgggcggaaggcggaggccgagaccagacgcggagccatggccgaggtgttgcggacgctggccggtgagtgcaggcctcggccccrggtgcccgcgagggagccgctaccgcagggaatgcggggtgcacccgacagccgggccggggtgggggcgcycagggctgcgaggcttcrggccggccgccgccccagcctccgagaccctgcgtcctggggagccggcgggcaggtgggctyggccgcgctgtgggtgcctgggayccgcagggaggatgggcgcggtggcgcggcctggcggggggctcgtctccggggtccccggstcctggtgagagcggggtccctcgacgccgtggcggtctccagcctctcctcgcccctccacgctccccgccttccatgagctgctattttcagcacctaccgcccgaccctggaytaggacaaggctctgggctgccctgcccgccccccagcccttccctcgggcacggcggccaggcgcccgggttgaccgggaacagcctccataccccaaacgcggaggcgcctcgggaaggcgaggtgggcaagttcaatgccaagcgtgacgggggaactgtgccccgggccctcaggtgatataggagttaagaagaaattattgaggcaaccagrtgcggtgactcaggcctgtaaccccagcactttgggaggccgagggtggatcacctgtccttaattttcttggcgccagaagatgaattgagtatttaccyagacaacaacgtcgcttcagagggagggatgcagaacgcagggccacggggygcaggctgcaggccagtgaaccccaacsccaaaggccagggagagccgggtggggtacccagagccagcacacagccctttaatttagaggagtgctgtgtacacatytggggagagatgttttactttgatttggaatcaggtggcggataaggcatactgaggcctgacttggtgagggctcctgccccggaggtgcagccctggaggagcgggaggcagaggagtggaaaattcatgaagaaaacygggtatggtgtaggtcgaggccctgccctcagtaatgctcaccatttgtcagtgtttactgtgaggcagcactgtgttcartatcgctgagttctcaggaaggaacggtaaatacttcccgggtcattctttcacccacgggaaaacaggtttggagagatctgggacagtgctctggtccyaggcaggaagggctgagtggggcctgggactcargtctgactgcaaacacctgcctcctccctgtgctgccagcgccttccgggttcttccctgtccctcctttgtggtctttgttttcccttttttgtcttaatatgtttcaacggatgtatacaataaaccgcacatraaaggtacagctggatacatcttgacccagtcaagatgatgaacacagctgccaccccaggagtctgtcctgccccrcrggttatgctgtcttagttggtctcatgtcagggagccttggaggaccagggwcgggcagttggtctctatactcctggggttctggcactggctctggcccatgaccgcacccaagacaaacgtcttgaagactaagaggttaggtctttgagaaacctggcaaatgagtgcccattctcaggttacccacattctgcatgttgatttagtcatccaaccaatgttggttgaacactgatgagaacaagcaggcctgtgctagaaggtgcctgcagccaggagctggtgagctggtgtccttagggacaccaatggcgagggacccagtgtgtggaaatctgggggacaagcatgccagggagaagagctcacatggggaaggcccggctccacaaatcagtcaggcttgttggggcgggcaggagagcagggtagtggagtcagagggagtgatcccccgaaaggcaggaagaggacatgagagagccttggagatgacsrtgaggatgtggttggtgggcggtgagctgggtgtcatgtgctggctccttagagaatgctcagctccttcacacccatcataatccctggaggactgagaccacgtgcaggagttttggaagctggcagtgcacccagtcccggctctcctccattctggtgggtctcaccagagattggccaagaagagatcaaactgttcctggaccaaactgagggtggggctgctatctctcgyggcccaataacgagatgcagatgaactggggagaaagagastttttatttctgtaaccagttacaaggagaagacctggaaattatctccagaccaactcaaaattacaaagttttccagagcttatataccttctaagctatatgtctatgtgtaagtgtgcattcatctcaagacrtaagtaattgacttatgttaatctataactaaggtctgagtcctgaagaccttcctctggatcctcagtaaatttacttaatctaaaacccttatcttgtctcctaaatcatgggggtttgggaagttccttcagacccccagtaaacttatttgtggagtcctggggaatttcttcagatccccaataaaacttrtttaatcctaaatgggtcctgttaagaattccttygttattttgtcatgcttgaaggcccaggaaaggtctaggcaaaactcttggtgggattttgttatattccagcctttttataagggcactggcttttaatatttaatttaaccactcagtcagtactgaaacagttgttagggaggcctgcgttagtgagacctgacctgccacaamacatcttactcggaatgctgcccataacttcaaaaaatcagctttgacggagccctactgaacacacstagcatctctcttccttcagcttagggtcaaggggctggggttgatggcaccrttgaaagaaacagctttattgccgtgtcattgatatgccataaaattcacctgtttcaaatgaattattttcagttagtttacagagttgtgaaataaattttataacttttccatccccagcccaccaaaactccctggaactcctcygcagtcattccccattcccacctggcctcagacaatcactttctgtctctccagtcttgccttttctggacagttcctatgaatggagtcctgtgttacatggtcttttgcatctgacttccttcacttagaataatgattccgagattcatgtatgttgtagtatgtatcagtatttaattcctttttattactgaataatccattgtacagatagaccacattttgtttatccattcatcagctgaaggacatttyggctgtttctgcttttttagctattttaaactgcacgcagcactgctatgaacatttgtgtacaagactttgtgtgaacatgttttcatttctcttgggttgatacccagcagaggaattgctgggtcatacagraagtctgatttaacattttaagaaactagcaaactgttttccaaagtgactgccccattttacattcccatcagcagtgtataacggttctaattttcttttcctttttcttttcttgagacaaggttttgctctgtcacccaggctrgagtgcagtggcatgatcttggctcactgcagcctcaatctcttgggctcaattggtcctcccacctcagcctcctgagtagctgggactamaggtgagtaccaccacatccagctaatttttgtatttttggtagagatggggttttgccatgttgcccaggctgttctcaaactcctgggctcaagtgatctgcccacctcggcctccccaagtcctgggattataggtgtgagccgctgcgcctggctgagggttccactgtctgtacrtctgcagcaatacataccattcttgtgggtaaaaggtggtatctcattatagttttgatttgcatttccccaaggwcaaatgatggcaagtggcttttcttgtgctttttagccatttgtatatgtttttggtgaaatgcctrttgaaatgttttgcctttttaaaaattgagttgtctcctttgttcagttttgagagttctttacatacacagtatcatatatatatrtatatatatatatatataccagatatatgatttgcaaatattttcaaycatcaatagtttgtcttaacacttttttattggtrttttgaagtagaaaagttttacattttgatccattccaatttattaactttttcttttattgtgtatctggtatcatatctaagaaatcttaatccagtgtcacaaagatttaatcttatattttcttctaaccgctttctagtttatgtgtaagaatctgtccattttacctaagttgcataatttgttggcaaacagttgtwcatagtatttccttgaaatccttttaatctctgtaagattggaattgctgtctcctcttttagtcctgattttagttatttgtgttctctctctctctggtcaatgtagctaaagctttgtcaattctcttgatcttttcagagaactgmcatttgattttttttactttatctttttctytctgttctctagttcattggtttccactctaatatttattaatttccmytcttctcaytttgggtttaattygttctgtcttttcttattgtagttacttacaatggaagcttacacacttgatttaagattttttttctaatgtagacatttacagctataaatttcccttgaaacacagctttagttatatctcataaattttggtatgttgtgtttacattttcattcagctcagtgtatcttttgattttcttctttgacccattgcttatttagaattatgttgtttaatttctatgtatttataggtttcccaaatttcttttgttaatttctgatttcattcccctgtggctagagaagaaactctgtggatatcagtcctttcgaatttctcagaattgttttatggtccagcatatgattgaccttggacactgttccatgtgcacttgaggagaacgtgacttcggctcttgccaggtggagtgttctagagatgtcagttggtgtccagtgatgtcaagtcatttgtatctactgattttctttctaattwttctatccattaytgagagtggggtaggattttggtgtccaattattgtttttttgttktttttkttttgtttgtttgtttktttttttgaggtggagtctcactttgtcacccaggctggagtgcagtggtatgatcacagctcactgcagcccccacctcccaaggcttaggtcacctcagcctcctgagtagctgcaactacaggcaagtaccatcatgcctagctgatttttgcattttttrtagacagggttttgccatgttacttaggctggtcacgaactcctgggctcaagtgacccacccacctcggcctcccaaagtgctgggattacaagcgtgagtcaccatgcctggcccaaccrttactggtgaattgactgtttcacccttcaattctgtgagtttttgcttcatgtattgctgcrggataattaaggaatcagagagaccgatggggttgaggaggaattatttaattatttaggygcaccgacccaatcagattaacatscaaaggacygggccccaaacaaagagtcaagctaccttttaagcattttgtggggtggggggagatttgtgcagggggaagagtattacagaagcragaaacaaagacagttattcagttaagacatgcattacattatttcttacttttcaaggaacaacacgttttatgactcaagattatctgtttagtgaccttgcagctgcacagctagagaaacagagtcttcgcaatgcctgggaaagggagagataaggctcactagccacagaaaaacagmcagttaatttttaaaggactccagccctttctcttcctcaaggggaatyggttttttacatayaactgagtttttgcttacacagtttttaatttcttttaattcctgttctagtattttggggctaggttgtcaggtatgtatatatttctgtytgttatattttcgtgatgtattcactttatatcatggcagaatgtttctctttagtaagatttttgatcttaaaaaagtyggccagatggggtggctcatgcctgtratcccagcactttgggaggccaaggcaggtggatcacctgaggtcaggagttcaagactagcctggcgaacatggtgaaaccccgtctctactgaaaatacaaaaaaattagccagcyrtgatggtgtgygcctgtaatcccwgctacttgggaggctgaggcacgagaattgcttgaacccgggaggctgaggttacagtcagccaagatcgtgccactgcactccaacctgggtgatagagtgagactctgtctcaaaaaaacaaaaaaattatttagtctgacgttagcatttctcctcaagctcccttacggytgtttgcatagcaaatctactatccttttgctttgacctatttgtatcttwgtttctaaagtatgtatgtctctcacaggcagcatatagtcaaagcttaaaaaaaaaatccagtctaacgatctctgccttttgattggcatgttcattctattcccattcaatgttattattgctgtggttggatttccatctatcagttcacaatttgttttctatgttttatgcctttttgttcttctgttcatcttttactaccttcttttgtattaagtattttctagtgtagcatttaaattccctttttctttttaagtgtatattttaaagttattttgttagtgtttgctccagggattacaatatgcattttaatttatcaggatctacttcagattaatactaattttagtaaaatacaggaacttgactccagtataactccatttcctccctccttgcttgtggtttgtagtattattgtcgtatatgttcatctatatatgttataaactcaacaacatggtgttataattattgtttcacacaatcttatttcttttcaattcagtaagacaagtaaggagaaaaacacttttcaagtcttttatattacactgtatatttatcactgactttactcttgatttcttcctgtatattcaagytattgtctggtgacctttccttgctccagtatatataataacttcattgcctccttgctcctttatgctrttattgtcatatatattatatatgtttatgctgtgagcccatcagctaagtcagcttagcaaggtctcaagatacaaagtcaatgaataaatcaggctgggtgtggtggctcacacctgcaatcccagcactttgggaggccaagataggtagatcactygaggccaggagtttgagagcagcctggcccacatggcaagactccatctttacaaaaatacaaaaaaaaaaaaaaagttgagtgtggtggtrygcctgtaatcccacctacttgggaggctgaggcatgagaattgcttgaacccaggagggagaggttgcagtgactggagatcacaccactgcactccagactgggcaacagggcaagacwcagtytaaaaaaaaaaaaaaaagaaaaaagaaaaacaagaataaatcaattatttttctataatacttgccacaatcaattgaaccatgaaaaattttaaataccatttacagtagcatcataaaacatgaaatatttagagaataatttaccaaattaggagaaatgtctatacaattaaaactgcaatataaaccaggcaccatggctcatgcctgtaatcccagcactttgggaggtcaaggtggccagatcacttgagcccagaagtttgagaccagcctgggtgacatagtgagaccctgtctctacaaaaaaaaaaaaaaattagctgggcatggtggcatgcacctgtagcccctgctactcaggaggctgaggtgagaggatgacttgagcccagtaggcagagattgcagtgcattccagcctgggctacacagcaagaccctgacaaaaaaaaaaaaaaaaagaaaaagaaggtcacaaaaaaacagaaaactgcaaaatattgatgacaaaaattaaagaagacakaaataaatggagaaatataccatgctcatggattggaagacttacattgctaaactgtcacttctccccagatggatctacagagtccacataatctcacttaaaacyccagaagaaatttttgtaaagttgacagctgattctaaaatkttacatagtaatcagaataggttgatattaggatagacagatagttcaatggaatagaatgcagagtttagaaatagacctacacagaaatagtcmattgattttttaakagttgctttttgataagrgtgctaaggtaatgtgatagagaaaggaaagtattttcaattcaaatggctgaaatgactggatatccattgagggaagaaagggactttagcctttcacacaatacacaaaaattatggaattctgaagaaaataagagaaaatgttcatgaacttggggtaggcaaaaatttaatagatgagssaaaaaaaaaaaaaggcccaaaccataaaaatggtttcatttttataaggataaattagagtttataaaaattaacacttcccttcaaaagaaaaattaaggaaaaatgaataaataagccaccgactgaragaaaatatttgttttctaagaagtattttgtttttcrttttatgggttcatagtaggtgtatatatttatggggtccctgagatattgtggttcagtcatacaatggaaaattcacatcatggagaactggtatccatcctcttgagcaattatcctttgtgttacaaacaatccarctatactcttttagttatttttattctttttttttttttttttttgagatggagtctcgctctgtcacccaggctggagtgtggtggcgccatctcaactcactgcaacctccgcctcccaggtttaagtgattctcctgcctcagtttcctgagtagctgggactacaggcacccaccaccacgccyggctagtttttgtatttttaaactttttttttyytttttytttttcttcttttttttttttttgagatggagtctcgctctgtcgcccgggctggagtgcagtggtgcaatctcggctcactgcaacctccgtctcccaggttcaggagattctcctgcctcagcctcccaagtagctgggattacaggcatgcgccaccacacccagctaattttttgtatttttagtagaggcaggatttcaccgtgttggtcaggctagactcgaatgcctgacctcgtgatccacccacctcggcctcccaaagtgctggggttaygggcgtgagccaccacgcctggccttagtttttgtatttttagtagagrtgaggtttcaccatgttggccaggctggtcttgaactcctgatctcaggtgatccacctgcctcggcctcccaaagtgctgagattacaggcatgagccactgtgcccgacctctcttttagttatttttaaatgtgcaattaaattattattgactatagtctccctgttatgctatcaaatactgggtcttattcattctttctatttatttgtacacattaaccatccctacataccctctcacccctgccactacccttccaagtctctgcgaaccatccttctattctctatctccatgagtttaattgtttcgatgttttgatactacagataagtgagaacatgcagtgtctgtctctctgtgcctggcgagaaaatatttgtaatatttgtatttggcaaaggacttgtatccaaaatatagaaataaattctgctcaataataaaaagagaaacaacttaatgagacccagtgtctacaaaaagtagaataattagccgggcatgttggtgcatgtctgtagtcccacctaatcaggaggctgaggggsaaagatcacttaagctcaggagttcgaggttgcagcgagctgtgatcgtgccactgcactccarcctgggtgacagagtaagatcctgtctaaaaaaaataaaaatagagggccrggtgaggtggcttatgcctgtaatcccagcacattgggaggctgaggcaggtggattgcttaagcccaggagttcaagaccagcctgggcaacatggtgaaaccccatctctaccaaaaccacaaaaaatcagctagatgtggtgcatgcctatagtctcagctactcaaaaggctgaggtgggaggatcacctgagcccaggaagtcgaggctgtagtgagccatgatcatgccaccacactccagcctgggcaactggagtgggactgtgccccccaaaaatatatataagtaaataaataaataaataaataataaaatgagctaaagatctggacaggcttcataagaagcaagcaaatggccaataaatacatgaaaagatgatttacctccttagtcattggacacacttagataccactcctcatccactagcatggctaaaggataaaagagtgaccatcaagtgttggcaaggactgtggttctcgtacattcctggygggaatggaaaattcagtcaccactttggaacacagtttggcagtttcttacaaagttaaacatacacttaccatatgacccatcttttccattccttggtatttactcaagggaaatgaaaacacaggtccacaaatacctgcacatgagtgtttacagaagctttgttgctagtggccccgaacagtgaaaaaaccacrgtgtctgtcaataggagacagaataaatgaattgtggcggattaacaatggcgtgcttckcagaaatgaaaaagaacgaacgattgatacacgtgacaatataggtgaatcttcaaaacagcatgcggtgtgatgcrgccagacataaaagagcatgtatcagaggattccgtgtatgggaaacgccagggaatcagatccatggttgtcagggtcaggagggaccttactggggtgattacatgtgtacatacattgtgtgaaactcatcaaaaccgtatacctaaagtgggcacattttattggatgtaagttatccctcaaattaaattaattttcaaagttttaaaaaatggaaccatttttgccacattgaaggaaaattatttccaccaagatttccctacagccaaacgatctaccaactacaaaaatggaaaaaataatttaggacatrtaaagttcaaatgttttgcctcccacgtttckgtttcaagaagctattcgagataaatcgctccgtggtcacaggacttagaaaggtggaggtaaacacacacaagcattataagataagaagtaacagatgaattagttgaaagggactgatttcgggggaaggaataggaactgggccaggagatagacgcctttcaggcttgcccttgtgaaaacgatagtcccctcttacctgcgggggataggttccgagatccccagtggatgtctgaaaccacagatagyaccaaaccctacagagagtatgttttctcctgtacacacatacctatgatagggtttaatttataaattaggcaccgggtgggattaacaaccataattaatagtaaaatagaacaattataacaatatactgtcygaggcgggtggatcacttgaagtcaggagatcgagaccagcctggccaacatggtgaaacctgtctctactaaaaatacaaaaaattagccaggcgtrgtggtgggcgcctgtaaacccagctactcgggaggctgaggcaggagaattgcttgaacccgggaggcggaggctgtagtgagccgaaggtgcccctttgcactccagcctgggcaaygagcaaaactccatctcaaaaacaacaacaaaacaacaacaacaacaaaaacaatatactgtaataaaggttacrtgaatgtggtctctctaaaaaaaaatgtgtatatatcttagtttgtgggttttttgttgttgtagttttgtttattattaagagacagggtcttgctckgttacccaggctggagtgcagtggtgtgatcatggcttactgcagccttcacctcctaggctcaagtgatccttccacctcagcctcctgggaccagaggcatgcaccactatgcccagctaattgttttttkkttttttttcttgatagaaatgagttctcactaygttgcccaggctggtctagaactcctggcttccagcaattctgctggctcagcctcccaaagtcctgggattataggcacgagccacratgcctgtcctcaaaatattttactgtactgtactcacctattattggcctttggttgaccatgggtaactgaaactccagcaagcgaaggtgtggataagggmactactgtacgtgactttaatatacataaaatcaccttaaagacaatgattgtttccagaacatgagcctctgagacagcagggagatactaggggaagttggtggctcctctccctggcaggaactggtctgggctcctggctcagcctggccatgaggctgtcctggcctccctcggtgggttcgrcagtgacctcgacgtgctcatttcagtgtggttcattccggtctcccaggggaagggggtgctgagtggaaggaggtcamtgggaagccggggtggctctcagagtctgcaggagcagtcgggctgatgagctgggaggagcagaccgcctccctcttctctgagtgggaggagggccagatctggactgggtttggagatgctcaggtggggctcagagcatcacctgtggggcagagggaccatcttggcagatgaaggcccrtcgcagggtgtgatrcctgaattacraggygggacaggtaaagtggggcaggtgagagaaggagggtgagtgatgtgatttttctactcctgttttccaggaaaaccaaaatgccayrcacttcgacctatgatccttttcctaataatgcttgtcttggtcttgtttgggtaagacacatttgaccatcgaggctggcctggtttggggagaagtgaccacagcagccaatcagacccatggggcctccctgagctccccaagtatcacagttatcagggtcctaaggacagttattgcctgcgtccagctctggcggagggtgtgcttacttgctcccttattttagcctcacctgggcaacaggctcatctcactcccatttaaaattttcctaagtgtggagtctggggctgggagagcaagccccttgcccacaattgcgtggctgggggtggggaaggcaattctgggtcccaagctgttagtcgcttccagacacagaaggtcccagaaccaagagtgaagtcayctgtcasctctactggggcatctctggacacggyctggaaacactccctgacgtggcctcagggactgcactgaycaaggcactggtggcggggggtgagggagctggggctctggagctccagcaggtgcccatacgtgagcaatatcccagggaccaccctcctgcccacctccmggtgtgggacgtggcgaggcgcctgagctttgctgagaacttgccctacctgcctcgaggccttgcagcttcaccgggaactcttgtgctcacgctgctggccrcaccatgcactttttggaggaagggaccaacaggcagtcttcgttctgtgtcctgagtcttggcacacttcctttctgcagttacrggktcctaagccccagaagtctaatgccaggaagcctggaacgggggttctggtgagtgcagggaagagcaggtggagcatccatgctggccrgggtgctggctgtgggcgggggtcccactctgggaactccccctccccttcctgggcccgctctctatgctctgcccagtgtagacrtgctcaactctgtggccttgaagggtcacctggatacctctggagtcagccttgacctcccttctgacctycagtcyccaactccaggcttacccagagttcccatgcatggtctctgctcccccatccccacccctcctccaccagccatcctcaactctccctttgctctcacccctacactgggttcccaaatcctgccagccctgctcttcagcagctcgcgtgcccactggcctccctgccttygacgtcctgctccagggctccrgtggggctgccctcatctctgtgacagcctcagacttgtctccccatccccatcagccctgtcccccttcttctcacagyagctggagtgatctttccagaacataaggtaggaggctctccatgwtctgatcctgccttcctgacctccccagcctcatctctccctcctctgcyctcgccctctgtgctccagccaacgtggcctgtcactcgtccacctgccatactgtcctgactccaggcctttgcctgtgctatggcctctgttgggaccactcttgtctctcccctgctgtgtctgctaattcccactcgtgtcagtgatccatggctgcagaacacaccactccatccatggaaaacaatcacaatcattgattactatctctccctgggcttcctggggtggactgggctcagctgggtggttcactttggggcctcagcagtcatgggmagacagtggctggggtcactgcaaagacttccctgcatctctggcagttgatgctggctgtcatctgagacacctacccagggcctctccctggggcctgggctcctgctyagcttggttgggaggctccaagaccaacatcccaagaaagatgagacagaagccagatcacctttttgggcctggcttcagaagtcacccagcrtcacttctgctgcatttatttcttakaaacacagaatatcagaccccatctcttgatgggagggggcctcatggtttgtagacatgttctgaaactccactctgccyggccttggcttcgacgtgtctggtgaatgtgtgggctgtgaggctyccygaacgtagacctcagactgcaacgytggccgttacagggtctggcacacgggcccacgycaggcccatcgccacagtgatggttgttctgtgactgtttctggtggcctctgctccacactccaggctgacgctgtgycccttccactgggaccctcgggtggcttccatgcacttgtgccctaaatcctgctcctagactaaacttcatctcctgtgttctcattctgcagcatggctgttagggaacctgaccatctgcagcrygtctcgttgccaaggtataatgtcagtgcctcccttcagtgsctcccatgtcacagaattgtcctgcagccctggcacatgtgtgccatgtgggagctggggcaggtcctctttcmtcctgtggctcygagggagggggccgctccttccccagtctctaccctgacttggccctcrtcctgcagccactcagagagcacgatggagctggagcttcagttttgaccarmtgcgtgtcgcyggcttttgtgtgtgtgtgtgtgtgatggagtctcgctctgtcgcccaggctggagtgcattggcaccatctctgcccactgcaacctctgcctcctgggctcaagtgattctcctgcckcagcctcctgagtagctgggattacaggcgcccaccaccacacctggctaatttttgtatttttagcagagacagcgtttcaccatgttggccaggctagtcttgaactcctgacttcaaatgatccgcccgcctcagcctcccaaagtgctgggattacaggcatgagccccggcacctggccttcaaattggcttttaaagaagatgaccagctggtctgttctgtctggggccttggagggctgtttcccaggatgtgggcctttatcagtgctgacctaggcaatcaaggccaagctggccacactgcttttgattttttttwaattgtgatgaaatacgcttaacataaaatttgccatcttagtcattttggagtgttcagtagckttaagtccattcacattgctgtgcagccatcaccaccatccatctccagaactcttttcatcttgccaacctgaagctctgtccccataaaatagcaactccattttccctcccccagctcaccattccatggtctgttgttatgagtctgctactccaactaccttttataagtggagtcaatggtacctgtgtttttatgtcgggctcaaatcactgagcgtgatgtcctcacggtccatccaggttgtaccaagtgtcagaatttccttcctgttttctgctgactccctgcttttaaaggccatcttggacattcaaattgtggccattactgacagttaaaatggccccggctcatgtctcctgagcctctacaatcctttargtggggacagtactgyggcccacacgtccccacaggctgcgtgtgacacytgacagtgctttgtgccactgtggagcaggtgtcactctcccacttctcagagaggaagccgggctctggaagccagcagcccacaaggaggcccagcaggcttcgggcccaggtggggaggtctgcacatctcarggcctttccctgggaacaaccagggacagaggccacacacccagcctcctctctgcccacagtgaattgagacacaaccccttacgtccctcccagccttaagtcaagtggaaagcaatggcccctgaggtcacttagtccctcttgccagtttrtaagtgctgaatcagagactctgagcttyggccctttcccgagktcccgggattatgagctgacacagcccccaagcaaccacagtgattccagcctgggagkgtggccttggcgggagggtcaatgcccagtcatggttcagcggctgtgcacacccctgcttacctgcatcccacgctttccatgcaaactcacgtggcggcgctttgygcttgcaggatggtctacccccagycaaaggtgctgacaccgtggtgagtaaagttactgacactgaaactgaacgcagctcaaggggctgttctgaaggtattagagggcggtttccttgatgtaaatctcagttggggctgcttcgttctctcctctcagattctcctgacatctgaattcagaggcccacatggctgtcctctttccctttgctttcwctgacttgcgtctcttgtttcctgtccctttgttstccaaagcccctgcaaaggcctgataggtacctcctacctggggaggggcagcrggggttgggtgctggggagggtttgttcctatctctttgycagcaaagctcagcttgctgtgtgttcccrcaggtccaatgttgagggagggctgggaatgatttgcccggttggagtcgcatttgcctctggttggtttcccggggaagggmggctgcctctggaagggtggtcagaggaggmagaagctgagtggagtttccaggtgggggcggccgtgtgccagaggcrcatgtgggtggcaccctgccagctccatrtgrccgcacgcctctctccatgtgcagtaggaagkatgtcctcgtggtgaccccttggctggctcccattgtctgggagggcacrttcaacatcgacatcctcaaygagcagttcaggctccagaacaccaccattgggttaactgtgtttgccatcaagaagtaagtcagtgaggtggccgagggtagagacccaggcagtgkcgagtgactgtggacattgaggtctctccttgtgttcaagacagagwggggtggcggccagccttgtcctcccagagggtagatgggaaaggtcattcatgcagcatcttactgagctcaygtgggctcgtgggctygtgggctcrccaggtcggtaaaacccagctccttctccagaggctgygtctcaccsagggatggtggcttctgctgccccctcctctckgtractgtggcyggccgtcatgctgagccaccccctcaatacaaggctccagatgtttcctgctcactgaccagagatagcaggagggggacacctgtttgctgtccttggaccctagaaagaggatgctggcagagccgtggtcacttctctgtcagatgtaggtggggcaggcaargcagttggccccagacaccaaaggaagtggctgacccacaaggcccygggactctgggccaggccagagagggagctagccaggcaaccgcagacacatacttgacttctcggcagctgtgggcagctgggccagcgacagtggcgraggccaggaatgacttactcttaggaataggtgcrgttcaagcctggagggaggaagctctagggtgcagaggcgggtgtgtggaggcctcgcgtgcagcttataatgagggagcacgtggccrgcctggccataagaggggcagctgcgtggggaggcgtggctcaggccaggctgagggggagtgagcrgrcrccagcctgcggcctgctaccagcctccagccacctgccctcagccctccttagtaagagggggtgctggtggtcccccatcgctgggaagaggatgaagtgartcgcagcccraggactcgctcaggacagggcaggagaacgtggtgcatctgctgctctragccttccaatggccgctggcgggcgggtgcaggacgggcctcctgcagcccaggggtgcrcrgccggcggctcccccagcccccgtccgcctgccttgcagatacgtggctttcctgaagctgttcctggagacggcggagaagcacttcatggtgggccaccgtgtccactactatgtcttcaccgaccagcyggccgcggtgccccrcgtgaygctggggaccggtbggcagctgtcagtgctggaggtgsgcgcctacaagcrctggcaggrcgtgtccatgcgccgcatggagatgatcagtgacttctgcgagyggygcttcctcagcgaggtggattacctggtgtgcgtggacgtggacakggagwtccgcgaccaygtgggcgtggakatcctgactccrctgttcggcaccctgcacbccrgcttctacggaagcagcygggaggcyttcacctacgagcgccggccccagtcccaggcctacatmccyaaggacgagggcgatttctactacmtggggrsgttcttcggggggtcggtgcaagagrtgcagcggytcaccagggyctgccaccaggccakgatggtcrascaggccaacggcatcgaggccgtgtggcacgacgagagccacctgaacaagtacctrctgcgccacaaacccaccaaggtgctctcccccgrgtacttgtgggaccagcagctgctgggctgrcccgccgtcctgrggaagctgaggttcactgcggtgcccrwgaaccaccaggcggtcbcrgaacccgtgagcggctgccaggggctctgggagggctgccrgcagccccgtccccctcccrcccttggttttagcagaacgggtaaactctgtttcctttgtccgtcctgttgtgagtaactgaagcctaggccccgtccccacctcaaatcacacacaccccctccccrccacagagacaccrttacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacacacacagacacaaaatcacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcccaaattcagcgcctggggcataagttcctggaggggtggccaccttcagcccccacggtaaggtcctgaggaaccttccccttagacaagggatcatggaggaggtctcttccggagcctggagggaggcctcaagtggtccttccacctcggcatcccaaagtgctaggattataagcatgagccactgcacctggccccaacatcatttattgaacagactgtcgtttccacattgtgtttcttggcatttctgtcaaaaatcagttgacyrtaaatgcatggattcacttccgggctctctattctgtttcattggtctgtttgtttttatgccaataycatgmtgttttgattattatagctttatagtatatyttgaagttaggtagtgtattgtctccagctttgttctttttgcttaagattgctttggctatttaggggtctttgtggccattactgacagttaaaatggccctggctcatgtctcctgggcctctacagtactttaggtggggaagtactgtggcccacatgtcccaacaggctgtgtgtggcacctgacagtgctttgtgccactgtggagcaggtgttactccctcatacgaattttaggattatttyatttatttcagtgaaaaatgtcaatgaaattttgatagggattgcattgaatctgtagattgtttggggttgtatggacattttaacaatattaattcttccaattcatgaacatgggatgtcttttttttggcacctgatctcagatatgggacagctttctaattatttgtatcttcaatttctttcacaaatgttttatagttttcagcatacagatctttcacttccttgkttggatttawttrcaagtattttttgtagctattgtaaatgacatygttttcttgatttctttgttagggtatagaaatgctacagattgttgtatgttaattttatatcctgcaactttactgatttcatttattctaacatcttattggtggaatctttagggttttctataagatcatgtcatctgtaaacagggacaatttaagttcttcctttccaatttggataccttttatttcttcctcttgcctaattattttggctgagggccaacttgttgggtttgttgttgttggtttttgtctgtgtcttttggtgtttcgtgttgctggcttttccagcacacagtcrcagatatatgaggcagaaagaaaacccagggaackcctgtcatgtcattcctcaggtcccaaggtccctacatggtctgccttcttctctccaccttttagtgtttggcatacatacgtttatgtatgtagttatatatgtatgtgtaatacccagggaaatatacagggattttaactgtccttagtgtagggcgtggggacaggtgcatctattctaccttgcctggaagtggaaaaatcttcaagaaatcaatttatcaccaactggcatgacagaactcctggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttcttcctgactccaaaagccaggcgccaccccatgctccttcccagcagaagctggttttcaccgggtcaggaggacaggatggctattcctgaccgttgtacagcagtgccacatctcctagtttccagaacatttaatgtgttgctgtggaggcctggcagctctgaagtagccccttgcgcccaggasaaaccgggcctggaggggtggggtggggtaagctgaagcttccagtatcccacgtgggcattctgttgctgagggcaacsgcccctccctgcaagggaggggaaggagcaggcaggcacacccktcctccctccacatttcactggagttgacctgtgtcctactgtggttgcacctggaccagcccagagggactggagtgactcttcccgcaggtagggcacagccagcctgggcacagggcctcactgcaatccctgcgccccgcctccctgggggatttccaggggttgtcctgctgcttggtgagctgggggtgtgggggaccacagatgaggcaggcgcctaaattgcttgggcggagtccggctgctctctccctccaggccctttcctgtgtcctcgggcccctcgggtccctgcaccaggccagcagcartcgggtgtcagaggttcaagtccaggctgactcctsggaygcaccgactttgcccaggagggctggggagagggcagccccaaagtgtcatctttgattattctttgtccccaaagccagccttgggcatgtgcccagcacagggagagctgctgcctcygtgggcttgagtcatttttgcttccttgcccctctctgctctgtttggtttaaaaaacaaaaaccaacacccatgggtgaggcgaggcgaggcgaggcttgccttgatccacccrcttcctcccctgcagcctcgggccccatcctcccgcgtggccgcactaggggtgctgggggcggagtggggaccagacctgagtgggttctgggttcrgcttcgcagcaggagcagctggggcatcatcagttgggcaggtgacccaggatctgaagcaggaatcttccaggtggaggtggggccgcccctctgcttgccacagctgccttctgctctgggggcagcactggctgagaatccagtgaagtaaggcctttgaaatggttttgattgtaaaagtaatgtttatgtttagccattcctttttttattttttattttttgagacgggtctccctctgtcacccaggctggagtgcagtcgtgaaatgtgggctcactgcaacctccacctcccaggttcaagtgattctcctgcctcagcctcctgagtagttgggattacaagtgcctgccaccacacctgactaagttttgtattttttagtagagatggagtttcaccatgttggccaggctggtctcaaactcatatcctcaagtgatccaccctcctcgtcctcccaaagtgctgggattttgccatgagccaccacgctcagccatgtttagccatttttaaaaggtgtgaacagataattaagtctattagcaacattagaaaatttaagttaaaatttaaatgactctagcaagaattagcctttaggtgccctgggtccccctccycacckccccccaccccgccgccttctgagaagcgttttgtaatttttcttatttataaaatgggtttgattcaaaactgacttttcctcttcacagtctcacaggtccttccccaggtccaagaggctcttctgtgtcctratgacaagtagctgcctagccgtggtggcacctcctatcacatgttaagggacccctccccagggccacacctggcagaaggtggcttatgatgttcgcagcttgaaagtagtgtaaaccaaagataaaattctaagcccactcccccagccatcggaatggacccctcctcttggccagggcactccaaagttaacctgaaaaaccggttcaggctgtgaagagaaggtggagtggacatgcctcatttatgtcctcctcccttttggaattcagcaaagctgaccagcatgaacattaacacagaccttaagtctgattagtggcatttacaatctatactctctgaagcgtgctacctggagkcttcctttgcatgataaaactttggtctccacaaccccttatcataacctagacactcctttctagtgataataactctttcaaccaattgccaataaaaaaattttgaatctacctataacctggaacctccccgctccaccttcgagttgtcctaccwttctggacagaagcaatgtggatcttgcatgtatttgattgatgtctcatgtctccctaaaatgtatacaattaggctgtgcccagatcaccctgggcacatgttctcaggccctcctgaggtctctgtctcgggccattggtcactcagattcggctcagaataaatctcttcaaatatttttcagagtttgactctttttgtcgacaataagctcatcagattaaagctgttggaactttaaattacttcsagccttgaaagaatgtgattctgacaccctagtcaagcagcaagtcgctgtgaactttgcttctccaattatagattaacgctcttcctttcttgatttgtaaaatgttatgaaagactaaatggcaccagatgtaagaccccttccctttcttagttactgaccttttgttacgaattaacttctttcttttcttgcacccaactcagaccagatggtacaaaagaccccatgcctatcaaattccataagacagtatgttaaatatacttttcccgaagggaacaggatataaccaaacaaattgctgcaactcataagccaatcttatgtggaaaatgtaatcatgctaaacctccttgtattttcccatttaagtgaagcccwaatccctccacctcagagcactgarcccattcctttagagtctgtgttttttgagtggtggtcgtcaaacttagagttcgaataaactctataacattggattttgaacctttcaattatttcaggtggcagaagaaacacacagaccccatctcttcctttggagttctgtactgctcatttcaaagggatttcatcctgccctctgtaaccacccaaggggttcctcctg

SEQ ID NO: 13318 - DNA, 55689 bp, Homo sapiens
ccctcagaggctgtacctggggaggaggtacctctcttcctccatttgacccaattctaaaccccctgtagcagtgacgtctgtcttcgtctcattccagtgcactttgtgaattctagagggctttcccagaaccaaggaaggctgctctgcccacagcaggccttgggaatttaacctccctgggagcagcctcaatgagtgatgctctggaactgctgggtcagtagcccagcccctggccccttggatgggatcatttgaagccctgttttctgcaccatttttcaagttccctgrtggggctgagtctggttgcaaatcgtgaaagctgccctatagtacttttaccagctgcctccctttctctgtctcacttcctcattcccctcctgatgtcccctgcacttcccagatacactacttgcccctgaatcttgccccttgaaccatcacaccctgggactaccccaggtgccactctgtttgttgtttctccgcctagaaggacgggcacccaggaagcaaaacgggagggcagggaagggagggtgttctggggaggcttgacaagaaacgaggcttttaaaagaaacagcagcaaagtgccaggcctgcaccagccagcttgagtcacactccagggactcagcaaagcttgtccaccttcctggtccaccctgggcctgtccatcctggagtgaccaccgggcgtttccagtaaaaatcccttcacttcacttccgtcatctccgagtcaggcaaggtggtggaaaccggggaagacctcagcttcggagctgctggaatttgtgtgactcacgccctccagtggtcacttgacaaatgacatagggctcacggtctggggacttgagcttgttagggcctcagaaccgggagggtcccaggaatgcctcttctcaatgccttcctttgacagctgagtggagtgaaggccccacaggacacgtgactcgccacgggacatgcacacacacaaatagagagtaagagccacgcccctgtgtttccttcacgtcccacctttatcatttgtgtcacatctgcatgcacctatactgttatttgcttaaacattttaccttaaactggctctctttaaaccttaaatatatttctaaaataaaatttttatcactttctgtgaggcggggcacacagtaggaactccgtctcctccttccatggccttgcacagagctggcaccagacactgacatggaggggagaacattcaaccccaggtaatcctcagctcctaccttgatctcagtttcccactctctcattgtcacctctccttgcccctgggtgtactcacctgtagcaaaatgggtaagcacacagtgggcgcacaagtggggtccagtcaaggtctcagacctgggtcagtcctcagctttgccacttacaaactgagtgacattgagctggtcgctcaaactttctgtgtctcggtttccttattggtgaattggggatagtattataatagtacctgccacacaacgttgttggaggattaactgagataataaatggaaagcccagggcctggctgtatttatggagcaagcaccagagcaagtgcaagctgggactccagggttgtagccctgccaccacctgactgtgtggtcttggacaagtcatttggctttgcttagcctcaatttccccatctataaaatggggctagtgatcattcccaccccataggactgttgtgtggattaaatgcttggtatgtttaagtgccttgctcagtaaacgttagctctgatcaattgtttttgtagaaaagccttcaaagttgctaacttccgagggctaactggatctgaaccatcttcacagcctggcatagaaacagatcaaatcaatccagtggaaaatcaattccaggataatgagcccaagacattcccgtgctgattgctgtcagcatggtgcctaggacagcctgggaaggcagggaggagggcatttctccacagcagcctcggaacctctatcgccaccctccggggggcccacctgtcccccgcctgcccttcaaggtgctctttgatttctccccagmagaattcacctgctgcatccatcatcagaagaggccaggaatgyggcctgctgggtgggcagggccaagaagaaggcagccgtgcaggcccaggaagccgtaggagacttgccaacctccaggagggggccagccctggaccctgcagacaggcgctctggggagggtaccagaagctcactgtttgtcccggcttgaaggctgtttgctgtgtgaccttggtgagtctcctaacctctgtgtatcatcacaatcattatcactatttttactctcctcctcttcctatttgccggttaagagaggattgggatagtggtcatggttatacaacattgtgaatattctaaaaaccattgcattttacactttaaaatagttaattggtaattttatgttatgtgaaatttattccaattaaaaattaaaaatacatacatgaatttaatgttacaaagggagagagaggaccgggaatttaaaagcaggtgtttgtggtgggacggggacctgtctgaggaaggatacttcagaaggcaagtcctggcatccacttgctctttgtcaaaagggaaattgttactctctgactcccagcaaggataataaattcttacttggctgactttttgctcaatggctcaaagcattttcttgtatctcgtttatttacttttatttttatcaccttttgtcacgagaaaagtcaggcccagagagaagtggcttttccaagatcacatggtaggtcagcagtgaagctgtgcctcgaayctgggacctttcaggytaaaggaaaccagaacatgccacgcccagatatgccgatatggcatcctgattatctccagctgaaggcatttgagaaagagcagctagagagagggctatctgaactgccctgtcctgcctgcagcaagccataaacattccttggagaaagatgctttcccagcatcaagatgagaagataacttttatcagctcagagatggcaccagagccatctacaaatacaaacaaaccttgctatcctactccttagctcacttccacatgtttaccttctcacagcttgccacccctggaagcctacaactgcattcgtcttgtcacctttctcttctttctttctttctctctttcctttcctttcytttccyttcctttcctttcctttcctttcctttcctttcctttcctttcctttcctttcctttcctttcctttcctcctttccctcttttttttccttttttttytgagacaggctagggtgcagtggcgcgaccatagctctctgcagcctctaactcccagactcaattgatcctcccacctgatcctcctgagtagctaggactacagtagctgggcatgccascatacccagctaatttattttcaatttttctgtagagattggatctcactatgttgcccaggctggtctcgaactcctggcctcaagcaatctgcccacctcagcctcccaaattgctgggattccaggcatgaaccaccgtgcccagccatcttgtcactttctaaaatgcattgctcttcatggcagatgctccataagccagagttctaagccgcagcattgagttactttcactgaggcttctcctgcgtggtgtgcatcacagacattaacaaacttgcttttttttctctattattaatctgtcttttgttacagtgtctttcccaacaaataacttaagatgattgaggagaaattatatttccttcccagctggctaattccaaatgtgtcctcaagcctggtgcttggactcaaaccctgccacaggtcaagaatgccacaccaagcagacgctgtgttagaggggcacctgaggtgacatgtttgacagatcacataactgaataactgcattttctgaaggaaaatcaacgaagtgctttgaggccaagtagatgggattcttgaggattccatgaatagcaaatagtagtatccccctcagaggctcttgggtgggggcattaaatgtgttaatacatgtgtttgctgcaggtatagccagaatatgtgaaagcagctacagggaatagagtgtagcaaactcctaatcatccctcaaaaccctgccctggtgtcctctcccttgtaaactttccttgaacaaggcagaacyagctacatcagcaccataccatccctccatcactacagatatcactctgtactataattatccatttatttttctaggccttgcactccctaaggccaggattctgactctttccctgagtgctgtttacctgaactgaaccggcatgaaccaccacgcccggccatcttgtcactttctaaaatgcattgctcttcgtggcagatgctccataagccagagctctaagccgcagcattgagccgcagcattgagctgaagcctgaagggaagatggctttgatatgttaaaactcattccagtttactcctatttttcattcattcatccacacattcactcaacaaagatccttgagctctgatatccatgtcttttttgtggctcttagtttatctttgacaaagttaatatattatgctgaatttaacttgggaaagacaagaaggaaatgagtggacagtggtagcaaagtgttgggayggtgagatcaagggtgactttttttccctttgcttctcaacttctccctaatgtagttgttattttacttttatgatggaaaaatgcatatgtatgggaatactgtatttcaggcattataaggaatgaaattataggccgggcatkgtggctaacccttgtaatcctagcactttgagaggctgaagtgggcagatcacttgagcttcagagttcgasaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctrtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccscagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccttcatttctggggaagcggctgttttgagagggttttgtttcttcctctttgagaaggctcagaaaattgtgggaattttctgcctacagagagaaggtgttggaaagtctaggtaaaaaaatgccgacatgaggtttggtcatttgaacatggcatcttggtcagatttcttttctgcaaatattagctgtggttgttacatgacaaggaaaaactttctgaaaagttcaaaatgggagtttgtatctgctaagaattttttttaacagagattatcttatcagtccttataacatgtaacctccccacaaatcctggtaagatggatatattaaacccattttatggatgaataaatgagtttcagttaaataacttgatccaggacacataactggtagagctaggattccaggatttgaacccaggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctgcctggctaatttttcaattttttgtagtcaaggtctccctatgttgcccaggctgaactcgaactcttggactcaagcgatcctcctgcctcggtctcccgaaatgctgggattacaggcgtgagccactgcacttggcctaaaattcttacatggactatattcactacactgtcttctaaagacagagtttttgcctctttgatcttcctcttgtctgtttcaaaggagatgatctcagatttcgagggatgagtgcatttttcacaaatatttcctccccacataataaaagaggagcaagtaataatgctgagttagaacaacaactgcaaaatctttaaaagaaaggtagctacagcttgagtgctttccccagtaayagacctaaaactacagttgataatgagagctgctgggaagtgtctttcagggtcaggcaaaggcacccctgtttcaacgacctccgggctcttcctcaccctgcctgtggccagtgatgaagcctggctgggtctggtgggccagcaggtcccgctaaggaggctcatggtgcatacagtttgtccttgttaagtggcgatggggatgggggggttcattgtttttcyttaagattattaggtggctttacagaattgaagtctgtgtccgaaggctccccattccaaccccgaaatagagacagaggttgcaaagcattgatgaaggggctcatgctggcgttcatatcgattccccagtgagccaaccccactgagaagccctgttctgtaaactcttcttmaacyttccctcacctctgcttcycttcttcagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagcyccctgtgccacctccaggtgagttttccctgggggaacctcctgcttgtctccttgggcacccakgccctgtcggcaccgatgactcagaattcctctctctgctcctcctctctcacctgaggtctgatctcctcattgcttcttgaaagtccctgttggaattcaatgcagccgctgattattgggcacctcgctgtgcctgacggtatgtgaagaaggaagggacatggtgcggggctggccctgaagaagcttggaatctttggggaagaatatgggaaggagcttggcctgagaatgggaggcagtagagcctcgtggtgggcaccatggcggaggggtgggggtggagggtcagcatcctggcctgcgtccattccaattcaccgcttgctagatgctttgaatatcatcctggtgaagggcatcaggatgttagacaaactagttccaagccctgtgctggccgcactagttgccgggtgctgcctctagccagctgtgtgacgcagggtaagttaacctctctgaaacttagtgctcacctgtggtatgaggaacccaagggggccctcaccatagtgtgctgaggatgaaatgagatctacagcactcagcactgtgcccacacagaacagacacttagtccacatcagggttcatcaccatctactgagtacctgcccttgccagagctacacaggccacttgacagactttgcatctcaactgatctctgtggcggctctttgaagttcatatgattgactcatttcacagataaggaaatagaagctctaataggattatgacttcccccagcctgaatgaccggtaattacagagtttacagagttggaacttgagcccagatttggattcttcatgtccctcctccccgggcccatccttcctcccagggcagaaccaagagaatgagtcagttaatgaacaagtcaagggacaggcttgaggctcgctcaggtggaaagacaaagcaatctgcaataacgcaatagtgcaactgaaaccaaagcccccrtctacacaagaccaccacatagccacacaaccccaccgccccagaggagcctttcccatggactacaaagggtagggcgccccctggatgtgtrragcatgacggccctgagtgtatctgtcagaggcggcaaaaaatgccagtggctaagaggatgggcttggggatgagcaagtggctttgccactcagtagccctgtaacctttggcaagtcccctagcctctgagcctcaatttcctcctctataagaagagggtaacaatggtgatttcctggagttggaggaaggagtaaatgagctttcccatgtgagcaacttagcacagggcctggcctggagtaagtgctcagcaaatggcactgttggcattgctatcattagcggtggtgttggcagttaggaggtgatggagcaaaattgaacagagttccctctaggggcttcacagaagtcaggtggactctgtggcctttgaagtatgggtagaatgtagacaggtgcagaggagtagcaaggacattcaggaagaggggagaggtgagcagaggctcagaggcagaaatgagcctgactgtgcttggccaggagtgggctgggggctgggataggcaaagccaggccagagcacaagggcttgaatgcagggtaggagatttggactcgctctccctggcagtagggagccattgtaggttcttgagcaggacagtctagctgtggtgtggtaggtgaattggaggagaggactttgaaaccaggcagtctgggctatggcaactgaggtggctaagagaccaagaggtgagaacacagagttgatggcctctagatgtccagattctaagggctgtagaggggcagtggcttcgccccttccttctcttcatctcatcattgcagccgctgccagctgacctccctgactccagctccccacactggctctgagctctctcttgccaactggacttctagcaagtcacgcccctattctagagcctgcagtggctccccattgcctgtcaccacattaaagcttccacagagttctgagcgagcaccctacccaaatggagagcccatcccacctgcccatcccagccttcctcagctccccagtgcctgtgcatagcacattcctccctcagctcatccagacccaactcatcccctatttttttcttttctatttttattttttattattattatttttagacagggtctcactctgttgcccagacttcagtgtagtggctccatttcagctcactgcactgcaacctccacctgccaggttcaagcgattctcccacctcagcctcctgagtagctgggactacaggcatgtgccaccacgcctggttaatttttgtatttttagtagagacggtgtttcaccatattggccaggctggtctcgaacccctgacctcaagcaattctcctgccttggcctcccaaagtgctattacaggtgtgagccaccgcacctaggcttcttttttctttccttttcttttctctctttctctctctcttttaaagctgagaatcttgctctgttgtccaggctgccctcgaactctgggccctagtgatctatctgctgtctttccggatcaccctgaatctcccaaaacccttacggtgttggctgcagcctttaaccctcatccccacaccctctaatagcattgccagttatccctatgtctttgggggctgacttgtgtctttggaccattcaggaaatatgagttcagactccagggagggccctgagctgcagtggacatgtgacaaaccagctaacttgaccatgtttttccccctcctcttcatgctggggtgggctggcggaaaggatccagtcagatagaagaggggatgaagaaaaaaatatcacacatcaattcattcaactctcccaacgatccacaaggaaggaattttagytatcccattttaaagatgaggaccctgaagcccagaaagttaaagtaattttcaagatctcataattagcaaatgacagagctgggattcagatccaggcagtccagagggacccctgcatggggctgccacctttgtgtcctgggcatgtcacattccattgacgagtacatgcagatgcccactcccctggctctgtgctgggagttaagatatcaatgaaacccttctgctcatcagtgaattgtttgagccacttattacttacatacaccactgctaaaaacaatagataacatttataaggtccttagtactgtgtcaataatgagacaggaactattatccttgttttacaagattgagtgacttactggaggtcaattcctggaaaatagtggagctaaggtttgagtcaagtccaaactcataacatctacactatctgtgctctcccagagggcctactgtgtgctgcactgttcaagagacagagaaaaatgacccagttcctgctgtcaggaaggaaacggggaaacggatgtcttcctcgctggtttgggagacgtacatgaagaatgcgagttggagaaattgtgtcaggagtaggtgggatggagtgtagacaggaggtcgtagttgtgggtgtactgggaccgtgctagaggcctctgctggggagactgcagaggtgcctgggcaggctgtagtgtggggaggagttggggggaggaggtgggtycacccagagtgcaacatccactcaggtgagggaggggtgatgttactggaagaggaagcagccgtgcaaagggratttcatcctgaaagcaatgagagccaatgaatatattttgattttaaaaagtaattttctaatctgttcaggtgtcatgaaaccaagagcctattctaagtgactggtgattctataccttcgtaaacaattaggaaatgagcatggtgtgtgtgtgtgtgtgtgtgtgtgtgtgtgygcgcgtgtgtgtgtacgcatgtgtgtattttagggacaaaggcaaatgtgggagcatctaggtgaagacacatggaattcagaaccaagtcgagctatgtgttgcttgctgggctgcagttggctagaaataaatatgtgccctctttcattctgctttaactggggttcgggatttaatgtgcttgcatactgccagaagggccccctgcatgttgaggtccagggctgctgccccatctgggtctggaccctacctgttatcttgcttgagataaggagcaccttacaggcggagcaaagtcaggaggctctgcgcagtccaggtagcaaggacaaggggcctgcaaggcaccggaaggggcttacgatccctcctgcaatattcctactagaagtcacccctaacccagtgctttctttggtttcttttctggaatcgcacagaacatgctgtatgtaacaagtaatataacacttcccgggacagccttgtgaggtggtgtgagcttaggctgggctgtggtcctggggctgctgtgtggccctggacaagatccttaatctctctggccccagctaatgcctcaataaagtggagatgacaacgtagagctgtctgcttaacgagactggacgaaatgacagaaaggaaatttgctctgtaaactagaaagcaccgcgcaatggtggtaattatcataagctttattgcgattttatggggaataaacaaacacgaggcccaacacgacccgggcatcttagcccagacacagtccagtgccatccaaactccgcggcagacgccggctgcgggcccctgggtgcttgggtcccgggatcgccggggaaggcagggaaggaggggcagctcggcccgggacatcgcgtgggtgaagagcccccgccgctgctcggctcgccccgcccccggggcgggggctgcaggctccgagcgataaagcgcgggcgctgggaggcgcgtggagccagcggagctgcgcctaaggagccgggccatgcgcgaggggctgggcgcggcgtgcgaggccgccgggccccggctgtgcaggctgctctgcaggatcctccggccgaagcctgactgctgcccgcgcagagccaggtaccccgcgggccgaagtccgccctgggagggaagcggtgggctccgagcccgggcggggccccatctctctctgggagaaatcsgagggcggggatgtgcgctctgtgggattcctgagggtttactaaaagcgttttcctcttttagaacgcttgagaggtcgcaattcaggagcccaggcggcccagagaaaccccccatgcactatgagaggcgtctatgcgggttcagttgcgctgcgaatgtttcagcacttgggagcttttgaaatttttcagcactggggttgaaagttgctacactctttggatcaaatatggttaagagagcaaggaggttcttgtttcacaaatgagatccatttcccagggcgccatcccccccaccctccccatctgtccccaccaccactcttggtgtaaggcgaggtaaacaggcagggaggcgtcggaaccgcaggggaatctggcccccaggtcagcccaggcaagccacagtctgcagctgtgaccggctcggctggtcaagggcttgtagaaagttctgggtctaagcaagccaccacactcacagcactccccacgcccccgacccctttttttgatagggtctcactctgtcacccaggcgacagtggcgccgtctcggttcaccgtagcctccacctccagggctcaggtgatcctcccaccttagcctcctgagtagctgggactacaggcgcgcatcaccacacacttggcaccttttttttttttttttttttttttgtagagatagggtttcaccatgttgcccaggctggtcttgaactcctgggctcgagtgatccgcccacctcggccttccaaagtgctgagatgacaggtgtcagccaccgcgcccagctgccagcactctctttgaatgcaggtccttgagggtcctcaggaccccgcacagctgtgggtttagtcaaattgcacgagcgtctgcggggtcagaatcaacaatgtgataatttggaaagaagtgtccagattctgaaggtgctcacctggagtctggtcaccctgtcaccctgtctcccagcagccagccagaagaaatggtgtgggaggggacttgggcaaaactttgtttattcatttttcaaatttaaagaattgtccaattatgaaaggaattcattgtcactgtaaaaagttggaagatgtggaaaagtataagaaaagttaaattgcctatgatcttatcacttaatgctagtcactgttaacatttactaacattccctcgaggtgtttttctgtgcttgtacgmacacacacacacacagccagcatcagactgtgtatacagtttaaggcattatttatatgagggcaaaactagacacagtctaacatccagccatggacaatgggaccaggctaatcgtggcccatctgtagagtggatttttagccaacttttaaaagtgatactttttaatatatggggtaaaatgattatgttaaatgtacaaagacattgcttctcaatctaaacagtactgtagatgtttctggtctgaagcttctgaaattgtccaactctacttccagaagtaagtgagaggaagcaagaatgggtgcagggtgggtgctggggtgagggggaatggcaaaagagcaagaggggcagttgtcccctggggaccccatcccccatacatcttcctattgaagcagccccatggtgactgctcagccatggcttatctgttctgaatatccagattgccatatatatatatatttttgttttgttttgttttgttttgttttgtttttttctggcaggccacaccagtctagaccaggtgtgttaaagaaaaaagtattcaatgatacttgttaaagaacagtatggaagtctttatttaggaccatctcaataggtacagggacctactgcagtggggtctggcagtggaggagagagattgggcccaaatccaaatacagcaggagcaagtgggaatttatagccaaggatcagggtggggtctgtggatggaaaattaccaagaaaaacttcaggcatagggggaattctgcctcacccaayctaacaggattcttgcttaggacaggctaaggtgatcagacatcgcctgggggaggatggaggatgaggaccctgatcagatggggaggacgacaagctatcaaggatggagggttcttgttaaactgactaagtagggattcttttgctaaaactgcatttttacaaggaaatgcttggatgggccccgcagaagattcagaagtctgagtaaagtttggctaagcaaagcatctttgccagttggcaatggttggtcacatggaaggccctttacagggttgtggaatcccttgattcagatataagttgctttctgatacatacttacatcctcttttaagacagtatctctttatagtaaaaaatcacttactgctactatgtaatgtatataattaatgatataatggtaacatatagtcatttttttctataataaaagcaatacatggtcatttatcgcatttcaacatcatagatacatatcaagtagaaaatgtgagaccctcataatagtctctaaccacctctccctcagatgcacaagcatgcataccctggaaaatactgccaagaacatggaacacaatatgctttcaaaccaaggtgccctggtgggatgattcttcctaggggaggcatgtgtgagtggtgactattcagttcgccggaatgaacctgaaatcccaaaccaggacaaacggtttctgaccggtttcagaatactgaatttttaagtaatctttaatttaaaaaattactttaagtaatgtttaatttaatttgtaagtaatctgtaatttaatgctaatttttacaatacttgtttttaccttggtgaaggtaagttgacatcttagatttgttttaaaataatgatgggggcagggaaggtataggtgaaacaagatcggccgtggattgatcactgttgaattgggttgaatctgggtgaagggcccatggaaggttattagactattctctctacttttgtacacttaacattttctgtaatagaaatgtagaataagtaaataaaccaagataaatcacgtgttttaaataaagcttaagtcatgaaaaacaagtggctggggctgggcgcggyggctcctgcctgtaatcccagcactttgggaggctaaggtgggaggatcacttgaggccaggagtttgaggccagcctgggcaacatggtgaaaccccatctctaccaaaaatacagaaattagccaggtgtggtggtgtgcgcctgtagtcccagctacccaagaggctgaggtgggaggttcacttgaacctgagaagtggaggttgcagagagctgagatcatgccactgcactccagcctggatgacagtgcaaggctctgtttcaaaaaatataaatcaatcagtcaatcagtcaaccaatccaagtggctgctgggcagtgctgctagtctgggaggcagagttgttggagccattctctgcccacccagcccctgtgccacgtttgtacttggcttttccagagggtgaaggagcattttccagatcctctatgggctgctgtttgggccagtagctttggctcagctctgctcatgcccttttggctctgcgggaggaagaakataagaggaagagggaagatggggatggggaggcagttggtcagaccraccatgaacaattcactcccaccctctggactcagtttccctatttgtcaaatgaggttactggcagagggaactccaagatgcccctccacccttggataccgcatctcatgctagctgtttcctttcacagtccagtgacacaggatgaccttcagtatcacaacctcagcaagcagcagaatgagtccccgcagcccctcgtggagacgggaaaggtcagtgagtcacatgggtgtgggaagccccttcctccctggtccaggcagatgcagacatagcagcctgttagagctgggctggagagggcaggaagccagggtttggatggagagtggagagtcccagacccggggtgttggggggaacaggtgggaatgaggaagggctttgggagagtgagacaacccccagtggtcgggagtggtggcccccaaggtgcactgacagctagcttctatctcctgggttccataccattctagagaggtgggcagagaaatgggtaggagtgggagagagggtggcttatatgtccttacatgctcccagggaaggaatgcagtggtgcctttctgttctcagtagtattggctctgacagtcatccttctcacctccaacttagtctttagtccctcctacagcagttcctctgaggaagcatttggcaaggccctgggtgaggagaggaccctggccagtggcccaggcacctggagctcttagcaggcactggcccaggtcgcccgggggctggaaacagaggagggacgtggagggacaccctgccctgtgtggccacccatagatccttccccactctaagacaaggcagggcctggggtctaggagagacctgagagaaaaccctgttttttccccttgcagaagtctccrgaatctctggtcaagctggatgcaaccccattgtcctccccacggcatgtgaggatcaaaaactggggcagcgggatgactttccaagacacacttcaccataaggccaaaggggtaagtctggggcttcagggagaaccacctttgtcccaagctggtgaagctgccagggctttgtggatcaaacaggtgtccccctgggcaaaccaaacaatcatctgcttgggcaaaggggtctaggaacagagacattcctcacagattacagtaggaagtaaatgatgccaactccctgttaaccaccccagtaaataatggataatccagaaggtcaaataaatgattgcagaaacaaattcatatctttcttagccggatttcaggataatgtcagggagaattttctaacagaactgctcagagctggactgtattacatcaggaggtagtgagctccctgtcactggaaggatttaaatgcaatttgatagattgcagaggggttcaagtatcctgtgagtggttggactaaatgtcttttcaggcttctttctgtcatgtaagtttttaattctaacttcaggatacattctatggttgtaaagtgggaaagaatggacaatttcaggaccatgaaagcaaaattatttcccacatgcccccaaaccaccacagttaacattcgggtgtacttcattcgtgtgtgtgtgtgtgtgtgtgtgtgtgtgtgtgcacgcgtgtgccttcctatgtctcatttcagtttgttttggccaaataccaatatcatgttcccataggagccatattggattgactttgctctggatctggagctggctggggagcagggccagagactgagtccggagtagggagaaaaacctgactcacacccactggggttcagccagtggaagagaggagatctaggtgggagaaagccaggtggwccccaaggaggaggtgccacaggggtggagaagaggtgcagggagccggagcagccagagaggagccaggtggccaggagagctggccccagaggagggtggcaagaggccgaatggcccaccctcaccacctgcctctctctttccagattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagagtaaggcttgcctcctgcagggtcgctgcctcctgcccttcctcctgctctcctgtctctacccatcaccctctgatcctagctagatcccttttctttccagatttgtggtgttaaatcactatgattttgcagagcgaaaatcacggttttctaggggagaagaccctggagcaggttctcataattgtgggataacgttgtacatagcaataccagttaaaagtgactgaattcgaaccctggctcccgcattgtgtctgaacgtcctcatcatattaatggcaaaaactgcaactacttttgcaccaacctaatataaaatggggataataacagaaggtggctcatgagatttttgtgaggattcagtaagttcagaacagtgtcctggcatccagagaccttgattgtgaattaatatggaccctttaattatgaaatgtttgagacagaaaggatctctgagaccacctagtcaggcccctactcctacaggtgtgaacatggaagcyggtgacatacctgaagtcacctcattccagctagaagccaggccacctgactaggagagggcaggccattgctctttgccctgaccctggtggggttctacatttctggagttctcttcttttttctacccagtgaggcttccctgaggaccatgctagacatccttcatttctatggccaattggtcatttggttgacagacacacatcaggcactgagtatgcctcagccttgtgtcagacactggaatacaaagatttttaattgtcatttgccaattttattgccaacgtatacaattttaatcatccaaagagaggttgtatagcattgtggccttcccaggttcaaatcctagctgtgccccttacgagctgagtaaccctgggcaagttactttgtctctctatgccttgattttcttaccgaaaatggtgataataatagtacccaccttgcaggaggagggtagttggcgggagtttataaagatgaaaggagttaaagaatatagagctaggaacaatgcctgggccacagtaagcacgacataagtattagccattttcatgtttttagaacactgcgttgtccaaataaaatatgtggctatgtaatttaggcccctttaaaacttttaaaacaaaaatgcatgaagagattgtaagaaagaatgtctgaaagaaatggattgttttctttttgtttgtttgtttgtttttatttttgttttttgagatggagttttgctcttgttgcccaggctggagtgcagtggcacgatcttggctcacttcaacctctgcctcccgggtttaagcgattctcctgcctcggcctcctgagtagctgggactataggtgtgtgccactacacctggctaattttttttttttatttttagttgagatggggtttcatcatgttggccaggctgatctcaatcccctgaccttgtgatccacccacctcagcctcccaaagtgctgggattacaggcgtgagccaccgagcccggcccagaaatggattgttttctaggctggaaggggagtgttgctattaggggagagcctcacacagcactgcaccacacaaagtgagccacagacatgtacctgggactccctggcggaaagagtggcttctggtggtaccacctccacttttctttgkcttttttttttttttttttttttttttgagactcggtcttgctctgtctcccaggctggagtgcagtggcacaatctctgctcactgcagcctcgatctcctggatcaagtaatcctcccaccacagcttcctgaggagctgggaccacaggtgtgcaccactatgcttagctaattttttaaatttttagtaragacagggtctcactatgttgcccaggctggtcttgaactcctgagctcaagcgatcctcctgccttggcctcccaaagtgctgggattacaggtgtgtgccgctgcacctggcccacctccagttttctacaaccctagaatgtctgagctgggagggaccgtgagtcttcagaagaggccctcatcttccagggtcggtggtcctcaaccctggctgcacagtagacttacctggaaagcctgcaaaattctgatggcagggtcccttgagccaagggcagcagaatctggggagatggggatgaggcagacatgtgtgtgcttcaaaagctccccaggtgattctaatgcacagcctggattgagcagcctgttaggggctgcctgcttcctgactgcaaacttcacaagatccttggcctttcagctcggttgttaattaatgagcctttcggggtccagggattttcctggatgggtttcattgggccacagtacttatgttatttatttatttatttagcataaagcacgtgtgcaccatgacactatgagattggtattattgttatcctcatcttacagacaaggcaactgaaatccacagaagagatgtaccttgctcaaagtcacacccttcgaagccccagagtggggattcgaacctaggcagctggtgcctgagcccttgcttttcccatcaatgctctagtacctagctgtgtggccttgcaggttcccaactctattctggacgtgggaggccttgctgttgtgtggaaggcaattgggcgggtgttcagaagcccagcagggctacagggccatgcttggtggtgttggaacccatttgcttctcccagaggaaaattgtatttttccaagtcacaagtacataccttgaacccctgcttccctgagcaagagawcctgggggtgtgaacggggaatggcagcctctcctcacagggaccctggcaatctaagacatgaccagctgagcaggttcagtggccttttgtatctgaagaatcatagcatatttagagattgtgacttgctgcatgttacatttaaatctgttcactgatgatgaaagccactcctttttttcagagctcatagacatcatagcatttctaatgccttagaaaatgactatatgaaaatggctatcacatctaaaactctgaaggaattggatgtgaatgtaaaaaataatcctttcttgcatatgcacgtgctgaccaccatgtgtgttggtggtgtgggtgttatggtgatcattactgttgtcatgctcaggtgcagaggggggaatattgctggaagctttgtttggggagggaggtctcccagcagtggggtggttcccacctcacccagyagctccttatggcaggggtgtccttggggataaatatcatcagtgttttgtctttgtgctttttttctctaatcaaggaaaagttgtcgagacactcttcatccacagaaaggccattttgttcagagttacccactctccttaatcaggagttcattctttaaatagttttgatgctgtttcaaaaggctttggtgctgaytggaaatctcaaggttgttgttgttgktgktggtggtrgtgtgtgtgtgtgtgtgtgtgtgtgtgtttcaaagcctttctgactgagtccctccctccctttgggatatttttgaagtctgggaggggaggagagaagcaagtttagaattgcatatggagtgactgaatgagcaattctgaggctgaggaacagcacggtttagagagactatgacgtgggcagctcttttctggccaggccctgggaccctgcagactgagctccgatagccaggtcccagtcctggcttgaccaggctcctgagaagggtgggcaggccctcaacatctttgggcttactgtccccgtagggtggaagatggaaggtcacgttgctgacagttaagaacctgggcttggcatcagggcracctgggtctgagtcctgactttgctctttcctgtacttatgttcctgggcctggtrcttaacctcctagagccttgagatccttggctataaaatagatgcaaaaatacctccctcccagactcagtgagaccctgcctgtgggttgcttcacccagtgcctggctcatgtgggtacccagtacaccggagctgccacggagggactggctcatctctcagtcatggcaaggaaggagggcactctactaactaatggagaggcaggacattgctatggctggatgggacactcctcccaggcttgcaagtgtctgagaaggattgcaccccttactgagatgaatatgattaaagaaaaagcacctgaaaataagcagtgttcccatgggctcaggactggctaggtagtatttataggactcaatgtaaaaatgaaaatgtgggctctttattttaaaatgattaagaatttcaagatggggacagcagagcattgagcgtggggtgcttctaggctaagtgtgaggtccccaaagccagccctggagggagctgtctctggtgagaggcatcttgcccttctgatgtcctatttcagttcctgcttctgtggattgaattaatccccrtgtaaggccatctcattgttgatcttcctgctgtcttcctgtcccccagggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtgaacttccttagacttgagcgggagagagctggaggcggccaggccctgagcagatggcttggaacagccacacagagctgtgcccaggcctcctgggactgaagccatggccctggatcctctcttacattcccaaatgttgagatggggcacctagggtccctctctagaagccttgaatcctgtttcagcaccagggtttctagctgcccattctctattgtgttaaattcaggagactaaatgccatcattagagtaaaccacgaccttgtttttattacacttgaggccgtggtgctgcaagatgtgttgttttcctccaatgcttgaattcttggctccaagagaacattttatttagcctagcctcctaggccatctttttgttggggartcatttgttgcaggataatatcaaaagcacttggacagagaaatcgattagaactgccagtgaaaccaactctggctgtgtagtatgtgctggtgtgggaaaggacctagcctggggctgtggcaatcccgattcatggtgctttcaagtcagrttttcttggaattctgggtttgctggggtcttctgagtggggttgcctgtgctcccctagagggcagccatgaaatgggagcggtggtgcagatgggaggctgaattcttctgcatggtgttgagtggcaggtgcagattggaggctgcactcttcggcatggtgttgagtgtttgtgtgttgagtgtttcggctgcactattgattcccagtgacttctgatcagcctcaaagcctctgtctacccagtctttgatgggcatggtctggatgggctgttgcaggtcttcgatgcccgcagctgttccactgccygggaaatgtttgaacacatctgcagacacgtgcgttactccaccaacaatggcaacatcaggtyggtgcacrtttcccagggctgcagaggggcttgccttgcctgagaatcttagccaaaagatgcagcacttgggtctaggggaggcatctccagctccaggagaaaccagggagaaagaaaaaagagaaagactcaggcttcttcggggacttccagtagtgagcccagcccctgtgagctcagctcccatcggcaacccatgcccttggtttccttctgatgtggagccacttggaggggatggaggatctttaagaagtaactgcttcactattcagggttggggctcccattttttagaaggcatgggacattaagaggttaccttcctctcccaaccaacgaggtcaaagctaataggactgaacagctcatttggtcattcattcatctttttgttcagcaaacactcagtgcctacctaatgcaactcaacacaggacaaggctgggagagcagggggaagatggggtatgggggggtaggaggaagagtgactaggaccctaagatgctgctccagctggtgtgagcctatgacctgcactagacaggcaaccagctaactcaactgcaaggacggagacataggcagtgagggaaagactggcagatcagctaaccctgcctgatggatgggaaggcccccttgagggggtggaccctgggtcttgagggagggcagcaggagaaggcatgtcaggaggctggctcagtcagcttgggatcaggggctgcagagcaggtagggtggagagggaggtagggccagtgcaggatggctgggcccccaccagggctaggtggtaaacagtactgttcctgtcctgggaaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcaggtacccggcccagcctcagccrcyggccattggggcggggagccccrtggtgagcgagtgacagagtggagcccagaggagacacgcagcccgggcttacagactcacagggcccgtcttgttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaagtaagtaggctgagggtgctgggggcaagggcgagtcaacacacagcccttctcctttcctaagtgcggctccagccttccccataccttccctaaagcccagccagcagcaggtgacactcagggggctggccttcaaggactcttttgtcactgttgcattctgcagccattctgcactggcacctcgggcctcagacaggtggatgtgttgatgctgaggggaagcagaggcttaggcggatggggccccaggagcttgagaagcagtgactgcaggagaggaatgcattgagattctagaaaggagcagcccaggcctcttctgccctcctgccaatgctcttagctgtccctctcctgtcgggatcatatagggctgcagtgacttcaaragtcctactggcccagcccctgctctaggcagttctcataattgcaaaaatacctctgcgtattgagatttactctgtagcagacattgggctgggctcttcttsctggccgttgaatgaaccaaattcagtcctgactcacagcctttgtaytccctgttccctttgcatgacatgccttttcctcagaatttttctaggctcatttcttcttgtcaaaaggtatttcctataatgtcacctcctctgagaaggctctctgaccactcaagctagaggaggcccccttaccctcagtctaacacatcatcttgtttttatttcttatatatttgtttacccatttataatctagaktctagacattagactacaagttccttgagggtggagatcttttcttttctgttcacaatgtatacccaacagctagcagagtgcctggcacatagtaggtgctcagttataaatatttgtggaataactgaatatacaagtgaatgatattactagctttataataattccatgaatttgatgctatgtttctattctgataatggggatgttgaggctcagagaggctaaaaaacatcccaagttcacactgctagtcagaggcagaacttgaaccccagctttctgacactggagtccttaattgctctgttgtgttgcattctcagcatttagcacagagcctggcacatacttgaagcttaayataggtttgcatgaatgaatgagtgcatgaatgcataatttaataaatggcatcctatgtgtccaatacgtctctctggctgggattaactcagaatcaactcttggaaaggagttttcttgtttgactctttctgaagcttttttcttggtgggcaggtggggggtcagtgggaggccaaaggtgcaaaagtgaagcccccagcgccagacaaggtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgaggcaggaggatcgcttgggcccaggagttaaaggctgcagtgagttatgattgtgccactgcactgcactccagcatgagcaacagagcaagaccaagtcactaaaaaaaaaataataataaaataaaaataaggaaggccccagttaaattgtgtctacctttttgccagatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgaygtccagcgctacaacatcctggaggtaacccagccagcccagctggccagatgaaggtgtgggcctgggggtggcttcagggaccgactygccgctatcactctgcctctgtaggaagtgggcaggagaatgggcctggaaacgcacaagctggcctcgctctggaaagaccaggctgtcgttgagatcaacattgctgtgctccatagtttccaggtatgtctggagttttgtgagtctgaagactttttggtgagaagcttaactgatccagtgacttatgtgatgcttaatttataagtaagcccccttgctcactctagaggtccagcaacaggcagctcctcacctcccaagactgttcaatccctgtacttgagcactgaattctgtcctctctcaatcgctcaaggactttactcccaaaaattttcctcttctctctctgtatcatcaatgtctctctctctgctgagtcattcccagcagtgtacagacaggctctcttagccccatttcaaagaaagaaatgaatagctaaccacataactcctgccaaacctcaggctccctccagccactgcctcacccttctgctcctttctacagcaaaactatggagagatctcattgtgcttcctcatcccccaactgcttcagcctggctgggcgacagagcaagactccgctcaaaaaaaaaagaaggcctccctgaccgtgccatgtaaaatgacgccctcaccccactgccaacctgtctctctgtgttagtcctttaaccattttatttttcttcaaaatacttcctcatacagttcctggcattatataggacatcgactttcttctttcttttcctttttttttttttgagacatcatctcactcggtcacccaggctggaatgcagtggcatgatcactgcagccttgacctcctgggctcaagtgatcctcccaccttagcctgccgagtagctgggactacaggtgcataccacgcttgcctaatttttatatttttagtagagatggtgtttttccatgttgcccaggttggttccgaactcctggcctcaagtgatccgcttgcctcagcctcccaaagcrctgggattataggcataagccacggtgccgggccagctttctttattgtttggtttccyccactagaatgtaagctccatggggcagggaccttgtctgtctgtttgctgctgcacctctggcctagaagagtgtctggcacatggtagatgctaaaataatttgtctttgaagaatgaatgatgagggccacatccgcgatctggcctggcacaaactgggtcttcagtccttgtctgacgtgtgcatgaatgagtgatgctgggaggggacctrtgagctgtggctgctcttgcttgctgtgcgaggatracaacctccacctcctcttaagcccacacacagccgctgggctcctgtgtagggctaagccctcaggcccatccgctgctcttactcatagaaacacttcccttccctgtgggaaggaggcctgagatgtaggaagatactactttagaagccacagccattgccacaaagctgacagatgccctggagaccccaccactggtcagtcattcattcattcagcagtgttttactcagcatttgcctggtgctgggcactaggctgggccaaggatgtgagtggtgaacagagtacagatgagcacacactgttccccatgactgggtcaccccataggcagatcaggcctgtgcttgacgggggaggggaagatggaacaggaagagccccccggtgtttsgggaagggctggctttgcaccacacatcctgactcctggggactcccagcaccagccctgatgctggcaggatgtggatacgtcccagaaaatctgtgagcctytgctgtctcctcaccrtggctgactgtgtccttccactgcctgagcgtctccaggacttcctcaccaccctccttcagggtaaacttcaaaagatgggcccttgtttcctcctctgtaaaatggggataatagtgcctccctcatctgaggattataagagttaagtaaaaatgcatgcaaaatgtttagctgcactgcctggcccatagacaacactcagtaagcaatgattttcttactgtttattatgttgtcatcatgatcgtggctaccactgagtttttttttttttttttttcctttggagatgaactctccctccattgcctaggctggagtgcatggtgtgatctcggctcactgcaacctccgcctcctgggttcaagcaattctcctgcctcagcctcccaagtagctgggattacaggattgcaccaccatacccggctaatttttgtaattttagtagagatagggtttcaccatgttggccaggctggtctcaaactcctggcctcaagtgatccacctgtctctgcctcccaaagtgctgggattacaggtgtgagccactgcacccatcctgtagctaccactgagcttaraactgatctggctcccaggagttgctgtgtcttggaagaataagtgaatgagagcccacgtccacaagagtggtggccggacttttatatacacatatataacttatgtatgtctattgaatttacaaggcatggctggccttcccaggcctgacaccagctggatcctctcatgcctccctgccttgactcatgcagtgccccactcaactaacttgcacccctctcacaagtctcccttcctctcaggagctgctcccgaaattcgccaactcaccctgggcctctgtctggcgttgtatcctctcytctgcccttccccagcacctttgcctgcctccatcagagtttctatcaggccrtgtgaaaatgactgattttccttggcttccccacccagttagactagactctaatgcagagaaagggctgtgtctttcccttctataacgccgatgccttatgcagtgcctggcagatggagattataagagcagctaatatttattaagcacttactatgctttgcttattccagcttattgcatcctttcaacaacctcatgatgtaagaactttttttttggagacaaggtcttgttttgtcacccagactggagtgcagtggcccaatcatggctcactgcagccttgacctcctgggctcaagcaatgctcttaccacatcagcctcccacatatctgagaacactggcatgtgccaccaaacctggctaatttttaaatttttttgtttttgttttttttaagacagagtctcgctctgtcacccaggctggagtgcagtggtgcgatctcggctcactgcaacctccgcctcccgggttcaagcgattgtccttctttagccttctgagtagctgggattacaggtgtgtgcctccaccatgcctggctaattattatattttttagtagagacggggtttcaccatgttggtcaggctggtctcaaactcccgacctcaggtgatctccccgtctcgccctcccaaagtgctgggattataggtgtaagccccgacagctggcctactaatttttaaatttttatagagacagggtctcaccatgtttcctaggctgatttcaaactcctgggctcaagcagtcctcccacctcggcctcccaaagtgctaggattacaggcatgagccactgcacctggccattataggaattcatatcactcccatttcacagatgagaaaacttaaagaactaattgctcaaggtcacatggcaaataaaaagccagagtttgaaccactgtgttaaacaaatgtctcttgactgaatgggttgccacagacatagaggccagtggctgccttgctggaccattccatggggtcagaccccacagcccgtaatttcagactgtgagtgattcgtctcccatacactacagttctcccaatgcttcagacctccccacggaggggtctggctccttcttggctgaggaggctacaaccccatggaagtgactcttagaactctccaccataaatggctgggatggtatttcctttacctgccaaaaggtgctgtggtttaagttatgcagatccagagagagccatttgctgggagtctggggagacctgtgggcatgagaggctggatattgccctcaaagacttaagggaggcccccatgggacctgtgggctgaccctgactaatgtgctttcttgggctctgtcagaggctccacaagcgccttccatttgggtgtttattttcagcaggcaaggagagggccaggagttgctctcccgtgttacagattgccaggccttcccaggcactctctgggagccctgcggccaaccggcccctctcctgattcccccacccttatctccactccctatcttgccttctgatacagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggttaggggccttcctcttctctccttcctgggggctcagatgtggytgtatgtgtgtgtgtgtgtgtgcacctcattgttacacatgtagggcacgacgggaagcaggagtatgttgttagagctttccaggccccactcaaggatgctgagcagcctttgtgcatttccacggagagtggcactgaaggaagtggcttccactgcaccgctagtggcctgtggctcagatggggggtctgtcattacacctgcttccacgggagggcccggcaacagtcactcagcagagtgttgaggggattggcccctgagtcagacgctattgattctgccacttcctagcaatagggtcttgggtgggtcctttcacctttctgagccctgatcttctcatctctaaaagggatgggcttcactccacgacggggggttgtgtggatcacaaagctggtgtatggaacagctcagcccagtgcccaatgcagaatgcattcagtaaccatgagctattgagaagagttcattttgtgccaaaaaggacttgggttggattttaagagcttccttcatctaaaggaagagcttcctccatctacaggacctcacatgcagggtgacggcatgtcctggagtcttgcctgttgtagtagcagctcttcttgctctcaaaggtgtctcggttgggactgtacattatgtcatctgcctgctgataagatgctaaaagcaaaaggagtgcagcctgttccttccaggaggacactaatgagaataagggttagccgccccccctcgatgtgcaggctccatgccgggcagtggagaggcaactctgggggagaggcagccacggccctcccttgtgggagttcagtgacaggggtggggcgcaggccagccttctctcccaggctcatgatgggtgtgaagggtcctctaccactccagcatcygcgagcygagccaagccaggaccccgccctgccctcacatctcctttcttttctgaaggtagaggcctggaaaacccatgtctggcaggacgagaagcrgagacccaagagaagagagattccattgaaagtcttggtcaagtgagtggcagtggcagtggctagtagtgatgtgtgaactatmtctctcccttctagtcagcctctgcctccagtccttgaagggcaagaacacarggaatggttatgctttttgcttttgtttttgagacagggtcttactctgtcacccaggctggggtgtagtggtgccatcacagctcactgcagcctctgcttcccgagctcaagtgatcctcccacctgagcctcccaagtagctgggaccacaggtacaaacccacgcctgactaattttgtttgttttttttgtagagacggggtctcgcagtgttgcccaggttggtcttgaactcctgggctcaagcgatcttcctgctcagcctcccaaagtgctgggattacagatgtgagccacggcacccagcctgggaatgtatattcttcgtggaatttggctcccagaggtccagtcgccaattccaagggtcccctgctgccattgttccaaccttctctctcctcccttttcccaaaggggcctatagtagtgggtgaggggaggaaaagggtgagttgtcacggtacatggctggtgagaaacgtagcttgcttttccctcaacctgccccacattaaacgctgtcccctcccattcccctggtcccccattttcttctggaaggctgactcagcacacagcgcctgcctgtctgtctgtccccacagagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggtactggctyagtgggatggctgttgttttttctgcttgtgtgcaggggagtctaggaaaagttaaaacggtttccccactcctggatgtctcagagtcttggatgtggtaatgtgcatcattaatctggaagagaaggaaagacttgtgtgcagggattccmaaacttacacagtagatgagtttttcatggtgttctggagaacacagtttgagaaacactttcacaatgaatccaggcctcaacatacatcagctgctctggctgaactttattcaggctcactgaacacctgctctgcaggatgcagtgctgcatgtgaaagggggaagagatgagtaagcttcagataaacaaaaaaaggccgcagagggtctgtctaagctctatcccctgccttcagcactgatggataaaatccaactcttagggaatggtggccacgtgctggaccagccccgggctctgaggatctgacagtgggtggcgcagagccaggccttgcccttggggagctctccagcatacaccccaccctcccctcccagcgcyctgcaaagcaggcgtcaatgccattgttaatgcacagaggaggaacctgactgttagacaggttgatgggttttccagggtcgcacggcttctgggagatggatgtgactctgaggacagggcacaggccagtgtaatgccacgatgggatgagctgtggtctgtgccacgtagaggcttaggccaagggggcactgactgatgaccaggtcggccaggttgctgaaaacacctcttgggtccaagcctcacctgctggctcccaggagtctggaactgccaggagagtggtggcaggtcccccatcctccgctgggtgggcctggatagaacagcaagatgagggcacatttccccggccattccctccaggcacagctgtgacctgctcattccaattttgtggaaatatttccacacacacaaaattgcaaatagtagtggacatggtgagaggcatttagacatgggaaaggcagtatttttgggacagatcttccagggcttgccaatgtgttaaccatagggcttaagcggggaaggagaacagaggatgatgtgttcaaattggttcattcacgtcctctgtgccacgcctgtgccgggccctgggagagacagatgagcacaggagccgcagcctgggggcagtgtgggaggaagcccagggtgtctgcgcagggtagggagggccctactgggagccgagggctgatgtccacttgggtgccatccaggttgtctgcatggataagtacaggctgagctgcctggaggaggaacggctgctgttggtggtgaccagtacgtttggcaatggagactgccctggcaatggagaggtgggtggcttgaggtctggctggtctagggggtggtagggcacgggaggacccaggaaagggtctgggggatgcggcaggtcctacggaggacatttgggagtcagtgctcaggccactccgggtcactcaggtcatttgccggcctccattgtaattattgccatatgggagtgccacctttcctatgacatatttaatatatttctgtgaatggcctacctgtttgtatttacaaattcatatttaaaggaaacttgtatcactctcacaaatggaargcagcaaaacataaattcaatgaaaacaaaatgaagttaatgaattttagctagatactattccctggccaaggcctgctctttgtttgttttgtttgttttttggtttttggtgtktgtttgtttatttatttatttatttacttaggtggagttttgcttttgttgcccagggtasagtgcaatggtgcgatctcagctcactgcaaactctgcctccctggttcaagtgattcttctgcctcagcctcccgagtagctgcgattacaggcacgcgccaccatgcctggccaattttgtattcttttttttaagtagagatggggtttctccatgttggtcaggctggtcttgaactcccaacctcaggtgatccgcccgcctcagcctcccaaagtgctgggattataggcgtgagccaccgtgctcagctatctttgtttttaaaaaagactaataggcaatgagagaggtattaaaggtctattagcaccaatatgagactgtctctccagtgctccgaagratgaaaatgtaattgaaggggaataactaaaaaataaattatgaaaagggagtaaatactcaccatgggatttgacgctagttctgctgggtcacatacctcctggaatcatcttggcttcctggaaagccagccttatttcagagactgtaggaccaattgttgttgcttctaccgggttccaaacagaatcacggcgcattcggagcccctctggagaaggcatgctaccaggcaggcccctctgccagggctggatgggtgggggcccagctgttccaggtcccccattaagaggcagggcctacacaagttgctacagtttagttggagtgagagacaagctaaacttgtcagctgacaaccaggtccttggccaggtagccccatatgtaaaccaacttccrtggtgggctgtgagccttctcctgcaagctgtggccaggtttccagaagaaaggaaaaaacagtgtttttattcatcctggcttgagaactctgtcattccctctctttctagaaactgaagaaatygctcttcatgctgaaagagctcaacaacaaattcaggtaaagctttttccgttgtcctactcctagccctgccctgtggacccaaagtctgggttcaggggatggaactgggtgtgcacagggkgtcttctcagaaccgtgcaggcacagagacctgggtctaaggtctgtactcagaatgtgtcgaggrtcaaaccacagaaaccaagtccctctcacaggtctgcaggccaagcatggggtggtcatgggagttggtgacaaggctgggggatgragaggaccagaagggggtccagctccattctccagctggagggggagagtctggggctggctctccaggctgttggtgctgggtgctgggtgccaggtgctgcttgcatgggacatgtgtctctgtgtgtgtcctcgggcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggtcakttcccagccagagctgccccacagcagggacatgacagggtgcattcatgcctaggacatctgtgctgggcgtcccaggtggcatgacctctgcctgtggtcctgtagatgtggtcccaggcatgggccagggccacaaacctgagggcttaggtcactgctgctctccctcagccccctagaagagctccaccttgtgcacacaactctgggggagaaggtggcacagatacccccctgcccttagggagcttctagtttaaggtckttcctccagtgactacctaggtcacctcttaactactgtgtctgtttcagtctcacagccatagagagcctggggacaggcaccacacaatggcggatccactttggatccactcagtatctccatagctctttattgctgtgattgccccagtcatttagggaactygtcactcatgcagagcgtcactcagcggtggtgcttaggagcatcagcttgcatcggggcaggcttggttccaaagcccaggcctcctccatgtggctccacaccaggaacataagagcaatcagacctcttccagtgtgggcatgaggatacaacaagatcatgtcaatattggcattcatartggtcgggcacagtggagcatgcctgcaatccaagcactttaggaggctgaggtgggcagattgcttgagcccaggagcttgaaactagcctgagtaacatgtgaaacctgcctctaccgaaaatacagaaaattggctgggcttggttgtgcgtacctgtagtctcagctacaggtacgggactgaggcgggaggattgcttgagcccaggtggttggggcttcagtgagctatgatggcaccactgtactccagcctgggygactgagtgagaccctgtctcaaaacaaaaacaaagcaatatttataatagtagcaatagctactatgtgccaagcccagacacctctttgagtccttgctgtcaccctatcaggtaagtgtgcttcgaagttacacgaaacmcacggctcagtgtttggcccatggtaagggcytaaaaagkggtagccccagtggtggggatgctgctgctgctgaccrttaaccgcagtctgmtccaccttcttccaggcagcctgtgagacgtttsatgtccgaggcaaacagcacattcagatccccaagctctacacctccaatgtgacctgggacccgcaccactacaggctcgtgcaggactcacagcctttggacctcagcaaaggtacctgcttctctgyagcacatggggcttgtttgtgttggggtctgagccctaagcccatggtcaaggagamccccaggtctttctgaacagagacagctggcctcggggcctccctctcactgcatgcaagagcctgttagggcataatactcaaggtgctgagggaggctgtttcaggagggagccccaggagggtggtggagacagaagggatcagcatccgccaagggcctactgtgtgtcagacactgtgcggggctcctggcccacatgggctaagtgagcctggacactcctcctgggagaaaggcacagatggagaaattgcagttcaaggaggtgaagcaagctgctagcctgtggccatgttggggtctgagccccagccttccagctgcgaaggcagccaagtgtcgtagagaaggtgtcacagaggcgattccaggctktagtggtgaactctccactctgcacccccaggtgctgtgccctgtgccctgtctaagatagtcctgaaggtttctgcatatttaagatatccccaatgtcaacaatgctctcctgtggatcccaagccatggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctggcttcaagtgattctcgtgtagctgggactattggcactaccaccatgcctggtttcagtatgttggccagtctggtctcaaactcytgacctccagtaatccacccaccgcggcctccaaaagtgctgggattacaggcatgagccaccatgcccggyctggaccaaggatctttatttgtggaataaaaggaagaaaaagaaaaacccaacggccacctcagcaggatgccccaagggtggtgttcagatgtcactgactcagacatctgggggcttcccctacctacgctcaagaaccactttgccatttcaccgtctctgtgtcctccacagccctcagcagcatgcatgccaagaacgtgttcaccatgaggctcaaatctcggcagaatctacaaagtccgacatccaggtaagggaaagtgcagggcttcgtgggtgatactctgtcgattttattttaacgaatgaaagatcagaagaagtcagtctttgaagggagaggagaagagcatatgctggcattagcagccacactgtcggtaggaccggcccacctggtaacctgcggccacctgtgcttttacgtctactcttggttaaccacgagccacktttccagcttggactctragcatctgctccacttcctctccttcctcattgaactctttcactaaaaggagagtgcaagagagacttaaactgtttgattcattcttaagaactttcaggaaaagtgttggcagggaaggaaatttcccagctctgggaaagagccttgtggattatctgcaggtttcattgatctgtgctgtcctccccgcatgcattaggaaaactggccttggttctaataagaacagggtttgtcctggcaacaaggaaaggtttcttctgatatccatgtatgtccaaggcggatgctttctttaggcagaggctgtagccaagccctcggggrgctccaagggctgctggraaggggtgggcccccctcctccccagagggaagctcctggggccctcttaagcacccctgcctgtggggatgcctcatcccaagctcagggtggtggcctagcttgtggaaccagccaggaaaatgaaaggagggcacatttcctggggaatctcgcctgcccatcaaggagccctggaggaaatcctgcaatgtcacctgaggcttcattttccttccccagccgtgccaccatcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggtgagycccgggctagaaagccagtgctgcctggcaccctctggccgccccacctggctgaggggctgagcctgggcctgccggtgacagccatccctgtccttcctgctgagagggygggccaccaaagcttatgtgaaagcagctgtggaaacagtcccagcccataaggcatggccccctggccttagtttccctaatgataacatccccctcaatgcagtggccaaagtcagaaagtgggatgagctgggtgtggtggctcacgcctgtaatctcagcactttgggaggccgtggygggtggatcacttgaggtcaggagtctgagacaatcctggccaacatggcaaaaccccgtctctactaaaaatacaaaaataattagacaggaatggtggtacatgcctgttatcccaatcccagccactcgggaggctgaggcacaagaatcgcttgaagccaggaggtggaggttgcagtgatatgagatctcgccactacactccagcctgggtgacagaractccatctcaaaaaaataaaaaagaaagtgggatcagagaaacagagcctggcagtgaccyccactgtccaggagaaagtgagagaacctgagacgtggggaygacaagacagttgcccttgtgactgtagggtgaaggatgtggttcatcaggactctgttccagaggagagaatgtcaggctcttatttttacccagtgtttacaaagcatctgtgtaccaggcacggcaccaactattatggcacaatttcattcagtgctcatgccaacccagcaagataggttgtgctatcagatctgtttcacagggagggaagccaaggcccagaggcttcagtcacctcagaagtggggagccagggtttgaacccgtgtcttctggcaccagggtctgtgctgtgactgccctgcatgctgctccctgggacttccctttgggctcatctgctcacccagcacatcttggtacagcacccaggggactgcagtcatgggcttctctctaagtgaacaactggcctgtgaggtatccattagtctttggtggatttagtcattgtgagtctgtagatcaccagtgagtgtcttgctaaagttcaggtctgggccagagaaggacgtggttagtttatcaggaccacgccaacttactgcccctttgggggctggtgatcagccttccctggcagtcctttctccatgcgccaccttcttcctgccttttgctcttagagccaggtctttagagcctcctttcccctgcagctggagaatagagggtgtctgcctgggggcctcgctacctactgagaatcctgaatggggcctcttttccatcctgacaccttccttccccatccaggcagctactgggtcagtgacaagaggctgcccccctgctcactcagccaggccctcacctacttcctggacatcaccacacccccacccagctgctgctccaaaagctggcccaggtggccacagaaragcctgagagacgaggctggaggccctgtgccaggtgaagatcagggctggtgggcagtgggggtatgtggggggtcccagcatgtggggagccagagtccagagctggttttaactttcaagagggatccacaccaggttcccaaagtgagacttgtcaaaggctggtgggaagccaggcatcgtccgctggcccatgtctaggacacagttgtgttgagtgaactgaatttttccaagtgtctgcaggatgcaaccagagtgcactgccttgaacattagctaggaaggggagccgcccttatccgtctttgctttccccaaaactggaataaacttgtcacttaagatgtattgggggatggatgatgtggatgaatggataaatgggcataatgggcagagtgacagatggagagctgaattaataagttaatgagagaatgcgttaactcacctgcaactgtctggttccaagtctttgcaaaaggcactggttgtcattattatcatcatcattatagctaattatctcaatttaagctacctccaccgccattattttgtggctgcaatgtactaacttggcacatgctttctcatttaattcccataacatccccacaagacaggcaatactgtccttgtttcacaaagggtaattgggacaagattccacagctagtgaggacacccagccaagatttgaacccaggtctgattggttccaaagccttgccccaaataaattacaataaagatttgacccctgcccatgagttgccgacagtggaggtaacacaagttagataaatgtactggactgagttcctccaggacaggcacttattttgtctcaagtttggtcgtctcagcaccatggacagtgcctggcacatggacttgtttgttgagtgagtgaatgaatgaatgaatactgggttgtgacagtcttttccccaaagcrggacaggcgccctgagtcactgacatcacccttggcttttagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccgggatcacacgcccacrgagatccacctgactgtggccgtggtcacctaccacacccgaggtgagccaggggcagaggctctggaacagccccgctccgcccattattggacatctgttcatcaactcagattcagctccctcatcagttcaaggagggagggaacacccacagcccagagttgttaacagtattaggaggtgtgtgggagagatctstaggaaccaggcactaaaccaagccttctgtatgtatatgatcagttacattgtggggtaggcactgtgtgcattttacaggtggcacagaaagtcacactgttagtaagtggagagctgagattcagacctggatagtctaactgctgagtccaagtcctccacyactccactgtcccactactcttgggacaatttaatgagatcagatgtgaagagcactcaacccttggtaggaggccagtggttcttagtsttcccaatcatgcagcctgaacgcaggggagattcygcattgattattcattcactcactcagctattcagtgggtgcctggcactggggtgggtrtggaaatacaacagagatcagccctgccctcagggagcatctagaggcrgcagtggagagataggcatagaaataattagatgattytcattgtgctgaagccaagaaggaaaggtcagggtcactgagggaagcagagcagggggtgacgctgccatagagcgggaggccaacatctcgtccaggtggtctcggctccaccactggccgctgccccctgccctgccctctgtaactgagcattgcctgggtkggcaaagctgggagctgcccayacttccgagccctctgtcctcaagaagcaaaaacacagtttctaaaaccttggcagagactctatttgccctgctagagaacagccacccagaccaggagaggagaggcagacgtgtcctgtgagatcaaagtttaatcccgaggaaaaccagggggacctctgcagttggttggaggccttcytcaagtgctgggccattgtaaagggaacacaacccagagagacctcctgggtttctacaagcccaggagggcccactgaggaggaaagcaaggtgccagagcaggctgaaatgcgcggarctcatccaccacccagggttgctaccagcaagggccacgctcatgagcacgcacagcagtagccaccctgaggggccacttcatgctgctgtcagtggagctcagtggtgagctgggagtgttcccggagaaagtctttggaaggagcactggagtaggagtcagggaagctgagctgtccacctgattccaccacgacctgagtgacctttttcaartcacttttcctctccccgtctcagtttctgcttgggcagaaggagcaacttgcagcctctctaagtccctttcaacgttcctcasctccgcgcttacagagggtggatctcagaaccaggagracaaacagctgctcattgagtcctgagagtgcctgagtgggggcgtccaaggaggccgtggtgtgggcggagcagctggtacagtttgcgcatgggcagtggggggacgttggtcactttgtggtatcgttgcagatggccagggtcccctgcaccacggcgtctgcagcacatggctcaacagcctgaagccccaagacccagtgccctgctttgtgcggaagtaagcaccccttccactctgtcccctgtggggccgccgacccctgggagttccgggaggaaagggagggatctggggtttaggagacgctcggagccccttggcccataaagaaggcactgrggtcacactggtgtggctgcctgtagcagggacagcgatgacaggtgggtctcaagagtccagtgagcwtggcccttttwcagaaggacctgggggaggtgctggtgcctggacagaagtgaagcagcctgcaggacgtgggaaatcaaataggagcttcttgtcctctccaccccctcacgaccgcctcccacaggcccagctccccagccatcctgtgtgtgcgtgggcctggggtgtctgaggactggccccctcttctcctgtcctcttcagygccagcggcttccacctccccgaggatccctcccatcctygcatcctcatcgggcctggcacaggcatcgcgcccttccgcagtttctggcagcaacggctccatgactcccagcacaagggtaaggctggaggcttcccaggtgggaggggcaccagggggccagcrcctgcctaggagcagaactgcagccccacaaacggttcctgacctctctcgagggaaggcctcccaagtttgcttccctgtgcgggcctctgcgggttagaatggctgcctttccgtctcccgcatagtagccagggctccctctcctgggagtggrggtaacaggaaagtccctgcttttgatctccgattggctgagggaattctgcatccgcactttcagttctgtgactatggatgagtgatctgaatgcgctgggcctcagtttcctcatctgtaaagtgrggataatgctattaaatagctagtgggagtgaagtgagaattccagttgggcttggagccctggcgccctctggtggccaacatggtaacaacagcccgggactcctgcaggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtaaatgcagcctcaaagcaggtgaagcattacacacacaagctccactgtgagccctgggtccccacaggcccctcgcctccccgagccttcacctcctgagctcgaaaatgctggtaattcacaaccatcagagtgatgctgtgaagagcattacaccctctcatacagcagaagcgacagacctggagaggttcaggactaacctaggtcacacgcgggttaaccccagagcccagcctgctgaaggtccccagcaggccccctgggacacgcgactgcccggggagaggtggtccaggctggctacgctcaagccttgcaaggctggagggcggccgatgcttccaccacggccatcagaggggctcttctgtccccagggccgcgttaccccctgagcctggggtgtcagaatagactctcrgccttcacacatttgtcccatcagggcacctcttgggcccagtgctctgtgcccagtgctggggccactgggcatcctgtgtggagcaggagcagagagtccctgactgactcctggaccttgtatctggggagcccgggatccataccctgcagagacctaatgggtagactgcattgagaggctcccttttctggggtgtaggcagagccctgggcagggggactgccttcattgatgcctttttgaagcatggcaaattcagagacagtctgggatccccactggatggtcagcccctcgagggcaggactgtgtccagcatttatctctctaatcccagccgagccccaggggcatccatgcacctcatcctgagcctggccccttgcaaggtcctggctggaaggggactcactcctcaccccttagtgcccctctccccgcctccttgaggccagcaggcctgcctgcaagccttgtcctgagcagctgaggactgaacccactgtttcctctggtttcaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaaggtatagtagtgggtgtgtgggctgaaggtgccggccaagggcacaggccgttggagccaggaccaggggtggcaggtagacccaggggaatcaggcccagaaaggttctggaccccaagagaatcttagcagtggctgagatctgagctgggtgggctgtcagatggccytactgcacatcctggaccagttggcagctttgagaagtcgggtgaatgtgttccatttttccatctgtagaatgggggcaggagagtctccctggcctctccccaaacccccctttcagaaagtatctgtgtggccaaagcaaggctgtgaacacaggggagagcaaggctgccccccgtcagcctcgtgtgaacctcacacttcttatttacacccaggctggtgtctgctcaccctcatccccccagcaggaagggcttgcattttattgatgaagataatagtgatatttatcaagggcttacactgggcatactgcttgccaaggattctcatgtgacatttcattcagtcctgccgaggactttatgagggaggcacccccttttacagagggaagggggcctacggggaccacagcagtaaatgtgagagcctagagttcagtctgcctctctctggttccaaagcctgtgattgtcacttccatactctccctaagacacattcatacgttcaactgaacatttattgagcacctactatgtgctagggatagagcagtaaatgaatcaggcaaaaattctttacattctactggggctgacaaacccagacaagaaagaggtgtagtgcttcagagaaaaacagcaggaaacagcccagggaacgctggggagtgtaattttaaatagggtggccagggaaggcagagctggaaggtggcatctgagaataaacctgagatgrtgaggaggagccctgtggatactgaaggaaacactctgggctgttctggaggggcagcaggtacaaaggccccgggggtgggagttaagctggcgtgtttgaagaacagtgaggagataacaggcatttccccaaatgtgttcagtgggtcggtagacagttggcatcaaaaagattccaaggtcgaatagcctgggacatgcttagttaaggcaaggcaaacacgttgctttactacaagacttctgggagccttcagtatgctgctgttcatcaggacccttcaaggctggaaggaaagaaaggacgtagcatttcccaaacatatttatctcagagctcacacttcctggagtatcttgggtgggggatgaacgctgggcaggaaatgggtatgctaagtaaagctttggagatggttagagggcccgcaccagagcaggtgctgagcagsgttagggtctaaaccagattcaagcacaatctaagtataacagttgggaagacagatggctcatgaaggtccatgtgatarggaagctgggcaaccccaggggctcatcccagcctggacttgacacgttgctctctgtttttacctaaaagagccagaagcgctatcacgaagatatctttggtgctgtatttccttacgaggcraagaaggacagggtggcggtgcagcccagcagcctggagatgtcagcrctctgagggcctacaggaggggttaaagctgccggcacagaacttaaggatggagccagctctgcattatcygaggtcacagggcctggggagatggaggaaagtgatatcccccagcctcaaktcttatttcctcaacgttgctccccatcaagccctttacttgacctcctaacaagtagcaccctggattgatcggagcctcctctctcaaactggggcctccctggtcccttggagacraaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacactgtatgcgtgtgtgggtgttttgtagggaaagctcttctcagagtggggagctggtgggtgtcacagcctggacagatccccgacagagggacaccccagscagtccatggctcctctgaaatggctgccaggtgtgccagcagcagatggagcttcgtgctggtccaaagacctgtggtagggcagggggcgcaggcctgcctcccacacaaagtatctgaaacggggtctggtgagggtgggattgtcgcataaggccagtgtttcgaggaaggccttgagcttcttcttggacactgtcttagaaagcgttttgctctggggccaccagtctcatgcgagactgtgccttggccagtacggatgtggtccctgggaaggcagcgtgtcgaggcgaktgtgggccacagcatcctcgcctgagggactggggaccctcttgggtttggagcaggccaaggaagccttcttaggagagtgggccccgtttccttctcctggtcagaaccaaaaaaggagctcagcggcggccactggggtcctggcaacacacggctcccagcttaggtttggcctctgcctcctgggtgccctggccgacttcacccccttgcccgccaccttccccttctagcagtagcatctcaggggcaggagaaggggcagtgccaacctcaggctccaggaaagctccatgccctgcgcgacagccgtgcatctcagcaacaaggccaggagtccgctcccggaccagggctttccagctttaatgtgcgcacctcgtctggggtcctgtgaaaacagagactctgacctcgcaggtcgggtggggcgcgggatgctgcgtttccaacaaactcccggatgcagctggtgccactgctctgaggactactatggggcctgaggaactggattcttactgggctgagcaggatgtgttggcatcacctggatgcagagtcgggcttcctggcagtggcccagtggctggcagaacccmacacatgaacactgagccacttttcctatgcaagccctaacccctaatgccggagagacccacaatggaacacacacccagacggtgcttcgggttggcttctcctgacccccctccccaagccacctcctcccactgggacgccaggtctgaggaggcagctctgaccctgctgtggccctcacaggctctgccccagcccctctcccatctcggaggcatggggctgtttcctggggtaccccattaccaccttcctgtgtccgagactcctgcccaaaaggctagagccccagcctgctttctccaacaccctcgtgggatttgtgagggaccctctgggaggaggtgtgaggtcaggaccccctgcccaaagggagtccatgctttcccatcccactcctctcagcagcaccgccgcccgattccacagactccaaaatgtctccaaatgaattaaagaagccacggtcaacccacatgaatgtgccaacaagcattttcatttctttattttaaggacactgggaaaggagccagtcccctgaagagaacactctggtcagttggtggaggccagtgggatgccatcaggctggctttccaggagggggtgaagggttgatgcagggtgcaaggtgagagttaggttaaaggtcagaggggagggactgaggacgtcacctcccaccaggagtggacagctggtggcttgagactggggtggagctgcgtgggggatgggaggggactgagcatggggcttcatcttcactgcccactccccacctctccccagctgtgcccctctcatcagaccccyaagagttgttgatctgggtgttgtggaccacagcgttctcatcaaaacggggattgaggtggaaggcgatgtggttcccagagtgcgggttgatgtggaacctggggtgggcagcccacctggacctttgtccactgagttctgggccttatttcctccccgtcatccacagcctgcccaaagccaggggaatggctggaatkaccttgaagggctctctcttcccagaggtcaactggagcccttagcttacctctgagcactgggcaggacagtgcccaacaggatgatggacttggatgggtacagccctcccggaatgatggtgacaaaaggcgtcggctttcagaaggagaggcatgggtcagccagtggcagccagggcagcccaccacacaaaagggaagattgtaccaggtcccatgaatttgggctgtcagctaagaagaaaccaacgatatctgtacttggttccataaaagccaaaggaaaactttccagtgctcctcatattaatgggcttagattagtgtcatgaaaggaactttggccaaacacaaaaagactcatctcgtggggtgaaaagggagagccatgcaatgcgctcgtattgacacgacagttttaaggttgaaagctcctctccacagtcttctaattcgctgggaagctttgaagcccttcagcttaccattttgaaagcccttcgcttttcattttgcaaggctagtggatacccccgaagtggcccttcacccccagcctgcccaccacaaacagaacctccgccctccctgagaaaycacttacataggtggggtgggggtacatcataggtgggttggcgggagtctgctgaaaagaaaccaggaaattcaatgggagagcgcatgtgtgcgcgagcactcacccacgcgcacccatgcattctagasgggctccactgtgaggctgacctcatgagcctttggcccttggactcccccatccacctcccttttcatgttagccttcctggaacttcctgccgtgttcccggactccaccacggtcacctgyccctcaacccctctgcaggcagccccactaacgctaaacttccggcctgatttgcaccagcaggagaagagcttaagcctatgatcggtagtgacatcctggggacccaggatgcagggccaggaacctcacatccgggtgctggggccactgcactccccacttggtgacagacagaccagtttccctcccggtctctagggggcttgcctcttccaccactggataaatcctgcttcttccagaatctctgctgtcccaaggacagctttagccacatgtcacctgagccaagcactcagcccctagtgtccccatcctccttgctaaaccgctttcttcccaactctagcgctctagggaatttagttcttggtgaaggaggacactgtgcagctgtgaactgaccagaacttgtagacttacagagaacatctgtccaggggcgctctgcactgtgtggatgactgtctgggtctggaagaaagaaaccaggtctcacccaggctctcacgtgtgaaaaccaccagctcccaccagagggcgccacacggcaggcaccctccagggggcgtaacaagcccaatggccccacagaccccacagagggtgggcccaggtgtctcttctctcaaggggatgagcgaggggcaaaggttagaaccctggagaagacagatggggacgctggtggctctggcccatctttcctctcggggaaacgtctctcagcctagcctccctttgcaggtgacagaagtgaatgtggggcatggtcttccgtggctgcccacggggtggcaactcagrttgtttcatcacggccagccaaccacatccaacccccaacctcaccaggccgggcagatggtcaagggcctggcctgtgccctcccyactcccaatgggagaggcccaatgcctggccctgcctcctccatgagcccagaaaagccaaaatgaggacgatccaaaaagaaagcaagagacttacaatgggagccgggttggcaggccacacgccgggaggctggaggggtgaggagagtcagaatggtggttatcgcgggcaccacagaatgggaggagatggtggcaaaactccagggaggctcttgtgctcagaaatgcctccccggacacacccacctccctcttgctcccaagcaagccttcctgagcccgtggcacccagatttttacccccaggtgcacagggctttggggttggggggtagggtatccccattggttcctctygagagagaggaggctgggtttgatagagacctcattgctctctgtagctcccacagccaagagcattacttccagtgccatattttaccactaaggtgagaagtggtatttgttgaaggcctactgtgggctgattcctgggtttcastgctttccaatgagggaagcagcctcagctcctgtgtccctggtgaggtaatgaggcttagaaagattaagcaacttgcccaagctcgcccaggtggaaggcatcaaatccaaartggcagccagttctgtctgactgtatccagcacactttctatcctccccagggccagggccaaatttgggctgcgctgcaaatgttccctggggctcgaccagtcctgaagtcagcgtggcaggaggcaggtgccctgtctgtaccgtgatgagccgtaagaagactgcatagacaaagcgcccctcctcccagtccccactactggagtggccagaggaagggctgctcacctccttgtcctggatcctgccccacccagtagactgttcttgccctggctggtatcccattctccctggctgtgtgaaccacattccacattcattcactgagtgcaaatgaacaaggcacagtcccggccctctgaagcctcatgggcatagggagatgggggtggagtgacggggacagacaacgcaaacacagttacaatggrgtgctttgaactggcatggcacagatacgtacagactcygtggggtcatgggggagcgtccaacaatattccaggcggggaggactcccagaggagcgacatttaggcagagcatggaagggcaattaggcgtgtgctgrgggcaggctggcagaggatgcttccgggaccagggacagcatatgcaaaaacatggtggcccgagagggccttgagtgagctgcagaggctgcgtgagctttgtggtttrggggtgaggcagcgaggttgattggggtcagactgggaggaatttgtatgccctgctggggaatttgggctttatttgaagggctgggggctgtgaagatttttaagcagggagagggtgtgatcagatttgcttataagaagcacttataagaacttaagtgcttataagaaccactgtgacagtggttgggtgtggggggtggggaactggacccctgtcgtcatggtgaggaatcccggaggcctgggccatgtcggtggcttcgggcctcttggtgccttggagagacgtaaagaagggggaatgaagaattcagggagacccccaggtccccagctctgggtgcccggcagacagacagggaactcttgagtgggcaagatggggcctgtaggccctgagtggcctgctggctggggccagcctctcagaccctcggtccttcctactgtctgctcggccacccagggcctctgtgttgaactcactttttgtctgcgccccctgggcctgggtgggaaacagacagactgggagaatggcaccgtggagaaggcaggctgaacagggactgtgcgggggttctgttaaaacaaaaggcaccgggcagtgaggagaagcattaatagagccaaggagaagccgaaaggcagaggcaagggcaagagggagagaccaggcaggcagggggatgaggcaagggggttagggccatgccaagatgggatgggaaagagccaggctctggtgagcagtgcaggggtgcggtctccctccagctcttccctccccattcacccacaggggagggagtcagggaaagagggaccaaagtcagagatgaggaccaaagggcgagaagcccagatttgctgagggcctactgtgtgcttcgct

SEQ ID NO: 13319 - DNA, 27509 bp, Homo sapiens
ccagcactttgggaggccgaggcaggtggaacacgaggtcaggagattgagaccatcctggctaacacggtgaaaccccgtctctactaaaaaatacaaaaaattagccgggcgcggtggtgggtgcctgtagtcccagctactcaggaggctgaagcaggagaatggcaggaaccggggaggcagaggttgtagtgagctgagatcgcgccattgcactccagcctgggcgacagagcgagaatccgtctcgaaaaaaaaaaaaaaatacacacacacacacaaaaactgtgttaatgcttaactacacaaaaatgataatcagataaatatgcatttatttagagaactgcatgttggtcagtccagtccctgcagagggaattcccagcatgacctcattcacttgtgaagacagagcaatccttgtgttttatttttttaagatgkatctcactctgttgcccagactggagtgcagtggcatgatctcagccctctgccacctccaccttccgggttcaagagattctcatgcctcagcctcctgagtagctgagattacaggcttgtgcctccrtgcccagctaatttttttatttttactagagatgaggtttcaccagtttgggcaggccggtctcaaactcctgacctcaagtgatccacccacctcggcctcccgaagtgctgggatgacaggtgcctggtcagcaactgttgtttagacatacacattttatctgctcgtccagcatggtcagccctccactttttaaattttattttatttatttttttgagacagagtctcactctgttgtccaggttggagtccagtggcgtgatttcggctcactgcaacctctacttcccaggttcgascaattctcctgcctcagcttcccgagtagctgggattacaggcccgcgtccccacacctagctaatttttgtatttttagtagagacagggtttcaccatgttggccaggctggtctcgaactsctgacctcaggtgatyctcctgccttggcctcccaaagtgctgagattacaggtgtgagccactgcacacggccttaaattttatttattatttatttatttatttatttagagacttagtctcactctgttgcccmsgctggagtgcagtggcatgrtctcggctcactgcactccacctcctgggttcacgccattctcctgcctcagcctcccgagtagctgggactacaggcgcccaccaccactcccggctaatttttgtatttttagtagagatggggtttcactgtgttagccaggatagtctcgatctcctgacctygtgatccgcctgcctcggcctcccaaagtgctgggattacttattttgttttttgtagagacaggttctcactgtgttgcccaggctggtcttgaactcctgatctcaagtgatcttcccacctcagtctctcaaagggctgggattacaggggtgagccactgcaccccaccttccctctactttttgacggtttccttctgctatgaatgtgcatgtccagttgtctgcttcttagaactgatatttaccttcctcatccatcagccattggaggaggactgggaccgctcagattattgatctgacccattctttcggcagggtttcctggtggctgtcttccatcaccaaaactggaatcagaagagtttccatagccctttttttttccccacatctttgctgaagcagagttttgaaaaacaaaaccacaaactaagctattccccagaagaaatctgtaatcaaagataagctctgccgggcacagtggctcacgccttttggaggccaaggcgggcggatcacctgaggtcaggagttctagacctgccaggccaacatggtaaaacctcatctctactaaaaatacaaaaattagctagatgtggtggtgggtacctgtagtctcagctacctgggaggctgaggcaagagaatcgcttgaacctgggaagtagaggttgcagtgagccgagattgcaccactgcactccagcctgggcgacggagtgagacgacctcacaaaaatttacataaataaaatraaaagtaaaataaaaatacaaaagttggccgggtgcgtttgctcacgcctgtaatcccagcactttgggagggtgaggcaggcagataatgaggtaagaagatcgagaccatcctggctaacacggtgaaaccctgtctctactaaaaatacaaaaaattagctgtgcgtggtgacacgcacctgtagtcccagctatttgggaggctgaggcaggagaatcmcttgaacctgggaggtggaggttgcagtgagccgagatsgcwccactgcamtccagcctgggccacagagtgagactccatcttgaaaaaaaaaaaaaatacaaaagttagccaggggtgttggtgggtgcctgtaatcccagctatttgggaggctaaggcagaagaatttcttgaacctaggaaacggaggttgcagtgagccgagatcacacctctgtactccagcctggacaacagagcgagactttgtctcaaaaaaaaaaaaaaaaaaaaaaactaaataggccgggagcagtggctcatgcctataatcccagccctttgggaggccaaggcaggtggatcacttgaggtcaggagtttgagaccaggctggccaacatggtgtaaccccgtctctactaaaaacacaaaaattagccgggtctggtggcgtatgtctgtaatcccagctactcgggaggctgaggcaggagaatcacttaaacctgggaggcaggggttgcagtgagctgagatcgtgccactgcactctagccagggtgacagagtgaaactctgtctcawaaaattaaaaaagaaattcagcaagtaatgagttaaggaattygaatattaaggcgagtgacaaggaacgcccaggatgtggcccaggatggagtaggggggacactcatttaggagaaagctcaggccacaagacaggaggagccagccttgttggggttgaagggaagagcattccaggctgagggaactgcaaggcgtttgcatgggacactatgggatggcttctgcccttggtgggcagcctctggtctgaggccattctttggcctgcctgactgtctggcaaccgggaggaagccctgcccttcctggagacagaaacaaaggtctaggaaatatctgcttcccttttccttgaaaaacgcttaagggaacggaggactgggaggtgccgtctctctctgccagcctgccccctaccatagccatcccactcccatctcagaaagtgacccgccatcctccaaaaggctcggaccctgatcaaggagtcatcccccttgtcccagcacctccagttggcccagcctccaaaacggatgtcaaattcagccctttctccaaggacactgcccagtccaggccccactatcattcatctggactagaacagtcacctcctctcccatctcctggctgcagctcttgaagcctcaactgggcccctgtgaacacttgagttagggcaaggtccttcctctgctcagaaccctctatacctcccacctcgctgggcataaaagccaaagtcctggccaggcacggtggctcacatctgttatcccagcactttgggaggccaaggggggcggatcactagaggtcaggagttagagaccaacatggtgaaaccccatctctactaaaaatacaaaaattagctaggcgtggtgacgcacccctgtagtaccagctactcggtaggctgaggtgggagaatcgcttgaacctgggaggcagagtttgcagtgagccgagatcacaccactgtgctccagcctgggtgacagaacgagactggggttcagaaacaaacaaacaaaacaacaaagtcctcctcaggtgacaggaacttgcacctatctgccctgtcatctccctgcccgctcctctcctcgaatctctcctttgctaagcctgctccagccacactgttctcctggctgttcctttttttttttttttttttttttttttgagtctcactctcacccaggctggagtgcagtgcctctatcttggctcactgcaacctccgcctgccgggttcaagagattctcctgcatcagcctcccaagtaggtggaattacaggtgtgcaccaccacacccggctaatttttgtattttgcatagagatgggggtctccctatgttgcccaggctggtcttgaactcctgggctcaagtgatcctcccatctcggcctcccaaaatgctgggattacaggtgggagccgcgcccaggtggatttttgtctgactctgttcattcctgtgtccccagtacctggaaggacgccaagcacacagtaggcgcttaaaaaacattgagccacatgttgagaaaagaacggcaccattgtggctgcaagtgggacttgggccgcgcgggggagctcgcgcacctcgggccggggcaagagctcagtggaacccgcccgaggaagaacccgtggcgcaggattttcccaggccttctgaggaccaggggcgtcccccgtcccaccctgtgactttgctcaggccgttccggggcgggaattcagaactcctcagccccccaagaaaaaaatatccccgtggaaattccttgggaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaaccgcttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcycccaggtggctagcgctataaaggatcacgcgccccagtcgaygctgagctcctctgctactcagagttgcaacctcmgcctmgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgastagctgggatgagaggtgtgaaccaccgccttgcttggctagattgcgtctcttacagtttctcagytgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacrccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcscagctgctcgggaggctgagggaggaaaatcccttaagcccacsaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatytgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatmacttgaacccgggaggcaraggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacraaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccascactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtrggccaggygcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaattgattgatgggaggaagggtgaggttggcagagccttgaatgccaggtggaggagctgggactttccttcttggggtgatagggagtcatggagggtttstgagcaggccagggattagatagctgaaggctggatttactggaagccaawgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatrttggccaggctggtcttsaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggattacagcctgagccatcacacctggccaacaggtttttttttttkttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcgsscccaagggctggagctgtttgagaacacctcggccccctaccagctccagacctttggtgaggattgaagaagccagcagggagaaggtgggggtggggtatcctgcaatgyggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaaygggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcrtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcraggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccrgctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctragggcacctgaggtttcctcactcagggcccacctggggtcccgaagccccagactctgtgtakccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccscaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggccyccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagcyccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacgractggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcasgacgcgggacgcctgggttctttccctggctgsagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggrkgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggctt

SEQ ID NO: 13320 - DNA, 23894 bp, Homo sapiens
caggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccraaggtgttcggcatgaccccaacatgaaatatgagctacagctggcgaacmccaaagagttstaccacgaggtgcmcrrgccctctcacttmctcaactttgctctcctgcaggagggggaggtttactctgcggatcgggaggacctgtatgccygaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagragttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagcmggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctcyacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcargatcccctttcccgcttctctgcccrtcaccctgctgtgcttggctctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggkggcttcttgyagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctcyggcctggtttcctcaggaaaagccctgagaggaagcagkgagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgawaccaggagtcagggtttctcctgtgacgcacycccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagtggccagttgggtccttgagtccaggagcgtggggcggaggggtggggccccacagtgggggccaggcctgccttggtctccccttccccgagtcttgcctcaccccaggtgtgaagacccctgccccactggtacctttggggaagactgtggctctacctgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctcccccacttcacccagccctcagcctgcctctccatgtcactccatagctgcaacgcctcctgcccagccggtttccatggaaacaactgctcagttccttgtgaatgcccagagggactctgccaccctgtctctgggtcctgccagccaggtaaggtggaagaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccaggttcaagccattctcccatctcagcctctcgagtagctgggattacaggcgcacgcctccatgcctggctaatttttatattttagtagagacagggtttcaccatgttggccaggctggtctcaagctcctgacctcaggtgatctgcccacctcggcctcccaaagtgctgggattacagacgtgagccactgtgcccggcccagagacattctttatacctgagctctgtgtggatgctctggggccccctgaagatgtgacagagcccccgcccctgcgaaaccaggctagagccgtgaaatgggcagcggggtggctggacactgacatggcctcaggggcaagaacctgtggaggggacacgccagcagaggggctgcccggaggcagggagtgacccccaggaagaagcttctgggtagcaggcaactcagagcaaagacaggatgtgtaggagacaggaaggcctgaatatcccccgtttctggctcccccaggctctggcagtcgggacactgccctcatcgygggcagccttgtgcctctgctgctgctcttcctgggycttgcctgctgtgcctgctgctgctgggccccccgatcagacctcaaggacaggtgaacgccagcccgtcccttccccacacagctcaggccacagggtgggagcaggggggcatctggtttccttgtggggtggggagggctggccttgttgcccacgtgggtcagaggtgatgggggtggggagggctggccttgtcgcccccgtgggtcagaggtgatgggggtggggagggctggccttgtcgcccacgtaggtcagaggtgatggaggtagttggcagtgcccgtggcctggagacactggagacaccgggtcagctgcctgccctcctcggaagccttcaatgaggaagtttctgagttgcatgggcaccaggctggcgaaccggagcctgcagcgggaggcagaaagctgacaccggcggggaccagaggaggagggctgggaccacggaaggagcagcccggctctgggccaggagggaaagagaccaggcctcagatggcccacgaaggaaagagacatcaatgtctgtgcagtggtttagcagagagtgtagctgcctgagagacggagaggggaggaagggttgggctggtggggcccgcgcagggggcttacgcagagctttgttcctttatgaaacctcgtcacattccaggctcctttgagactcacagcagcgtggaggtttggaacagggagtgtggggccgggaggataaatgtcctcaattcccagaggacattgaggcccaaggtgatctagttggtactggcacacaggaagcccctctccacctttttggactctttgtctggtgctctcttactagttcctgccctagtccaatagcacatcctcctctgtgcttgtgcggcattcacagaggagcagatacagttgcccctggcccagggcatagagcccagggtgggaagaagcccctcgcagggacacgaggacaggtgcaaaggctgttggaggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtggtgcacgcctgtaatcccagctactcaggaggctgaggcaggagaatcacttgaatccaggaggcgaaggttgcggtgagccaagatcgtaccactgcactccagcctgggcaacaaaagcgagactctgtcccaaaaatagagagagagagagagagagaaacgtgagctgaggctcagctaggatgataataacaaagacctgccaggtcctgcaaaaagctcagatagatgatagatagatggdtagatakatagatagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagccactgaagtagaggcagtcaccctgtcacaccctgccaaggtgacccaggtcaccgtgggtctcatgtaytgaccartgtccctaccctcctccctcaggccagcgagagatggagctaccgtgtccaggatgaagctgcaggtctgggggacactgaccagcttgggctccacgctgccctgccgttccctcagctcccacaagctaccctgggtgacaggtcagtgggcgctgggggccggggtctgggattggacagggctttgcatcaggtyctgcaggcgcytgatctggagtctctacagtctcacatcacgacccggaggtccccttcaaccacagcttcatygagccgccctctgccggctgggccactgatgactccttctcatccgatcctgagtctggagaggcagatgaggttcctrcytactgtgtgccaccccaagaaggtagccccccaacagcccacatagcccctgagcagccctgcccaccacgaccccctctttagtcctccagcaaagttatttatttttatttttttttgagactgggtcttgctctgtcgccaggctggagtgcagtggtgcgatctcagctcactgcaacctctgcctcccgggttcaagtgattcccctgcctcagcctcccaaatagctgggattacaggcgtgcaccaccacacacggctaatttttatattttagtagagaccgggtttcwccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtcagggacgatgtgtgtggcatcccagtcgagtctagcagaatcagtaggagttggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcrgaaggtaccaagtttgcaccacagagtcgccgaagctcaggggagctctccmgcccgctccgaaagcccaagargctctcccggggggcgcagtcgrgtcctgagggccgggaagccgaagagtccacaggcccagasgaagcagaagcccccgagtcctttccggcggctgccagtcccggggattcagccactggccaccggyggcccccacttggtrgccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggggctggcaccgagagttcaaggagagcccaggagccagtmtctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccytggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgyctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttcttttttttyttttttttttctttttgagacgaagttttgctctgttgcccaggctggagtgcagtggtgcaatctcagctcactgcaacctctgcctcccgggttcaagcgattctcctgcctcagcctsctgagtagctgcaattacaggtgtgtgccaccacacccagctaatttttgtattagtagagatggggtttcaccatgttggccaggctgttctcsaactcctgacccgcctyggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatstagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgcygtccaamatgaggctatgtcgygagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaacygaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaaraaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcrggctgacagctccaagcgttgtctgggggaggttgccctcgccaggtggcccgggcggattstagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtcccygggagaggcagccctcggatctgccsctgcccacctcacgctgcgttccatgctggccccakgcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagccgcgccgcgccgcaccatggcgcccacc

SEQ ID NO: 13321 - DNA, 14670 bp, Homo sapiens
ggaccaagcggacctaatagacacctacagaactctccaccccagatcaacagaatatgcattcttctcagcacctcatagcacttattctaaaattgaacacacaattggaagtaaaacacgccttagcaaatgcaaaagaacggaaatcataacaaacagtctctcagaccacagtgcaatgaaattagaactcaggattaagaaactcactcaaaacagcacaactacatggaaactgaacaacctgctcctgaatgactcctgggtaaataacaaaattaaggcagatataaataagttatctgaaaccaatgagaacaaagacaaaatgtacctgaattcctgagacacagctaaagctttagagggaaatttgtagcactaaatacccacatgagagagcaggaaagaactaaaatcaacaacctaacatcacagttaaaagagctggagaagcaagagcaaacaaattcacaagctagcagaagacaagaaataactaagataagagcagaactgaaggagatagagacatgaaaaacccttcaacaaatcaatgaatccaggagctggtttttttgaaaaaattaacaaaatagatagactgctaaccagactaataaagaagaaaagtgaaaagaatcaaatagagacaataaaaaatgataaaggggagatcaccactgatcccacagaaatacaaactaccatcagagaataccataaacacctctacacaaataaactagaaaatctagaagaaaaggaaaaattcctggacacatacacactcccaagactaaaccaggaagaagtcaaatccctgaacagaccaataacaagttctgaaatggaggcagtaattaatagcctaccaaccaaaaaaaggccaggatcagacgaattcacagccgaaatctaccagagatataaagaggagatggtaccattccttctgaaactattccaaacaatagaaaaagagagactcctccctaactcattttatgaggccagcatcatcctcataccaaaacctggcaaagacacaacaaaaaaagaaaatttcaggccaatatccttgatgaacattgatgcaaaaatcctcaataaaatactggcaaagcgaatccagcagcacaacaaaaagcttatccaccacaatcgagtccgcttcatccctgggatgcaagtctctttcaacatatgcaaatcaataaacataatccatcacataaacagaaccaatgacaaaaaaaccacatgattatctsaatagatgcagaaaaggccttcaataaaattcaacacctcttcatgttaaaaacactcaataaactargtattgatgcaacatatctcaaaattgtaagagctatttatgacaaactcacagccaatatcatactgaatgggcaaaagctggaagcattccctttgaaaaccagcagaagacaaggatgctctctctcaccattcctgttcaacatcgtattggaagttctggccagggcaatcaagcaagagagagaaataaagtgtattcaaataggaagagaggaagtcaaattgtctctgtttgcagatgacatgattatatatttagaaaaccctgtagtctcagcccaaaaactccttaagctcataagcaacttcagcaaagtctcaggatacaacatcaatgtgcaaaagtcacaagcattcctatacaccaataatagacaaacagagagccaagtcatgagtgaactcccgttcacaattgctacaacgagaatagaatacctaggaacacaaattgcaagggatctgaaggacctcttcaaggagaactacaaaccactgctcaacaaaatgaaagaacacaaacaaatggaaaaacattccatgctcatggatagggagaatcaatattgtaaaaatggccatactgcccaaagtaatttatagattcagtgctattcccatcaagctaccattgactttctttgcagaattagaaaaaactactttaaatttcatatgaaaccaaaaaagaccccatatagccaagacattcctaagcaaaaagatcaaagctggaggcatcatgctacctgacttcaaactatgcaacaagcctacaataacaaaaacagcaaggtactggtaccaaaacagacatatagaccaatggaacagaacagagcctcagaaataacaccacaaatctacaaccatgtgatctttgacaaatctgacaagaacaagcaatgcggaaagggctccctatttaataaatagtgttgggaaaactggctagccatatacagaaaactgaaactggaccccttccttacaccttatacaaaaattaactcaagatggattaaagacttaaaggcaagacataaaaccataaaaaccctagaagaaaacccaggcaataccattcaggagataagcatgagcaaagtcttcatgactaaaacaccaaaagcaatggcaacaaaagccaaaattgacaagcgggatctaattaaactaaagagcttcttcacagcaaaagaaactatcgtcagagtgaacaggcaacctacagaatgggacaaaatttttgcaatctatccacccaacaaagggctaatatccagaatctacaaggaccttaaaaacatttacaagaaaaaaaaatcccatcaaaaagtgagtgaaggatatgaacagacacttctcaaaagaagacatttatgtgatcaacaaacatatgaaaaaaagctcatcatcactggtcattagagaaatgcaaatcataaccacaatgagataccatcacatgccagttagaatgtcaatcattaaaaagtcaggaaacaacagatgctggaaaggatgtagagaaataggaacacttttacactgttggtgggaggagtataaattagttcaaccgttgtggaagacagtgtggtgattcctcaaggatctagaatcagaaataccatttgacccarcaatcccattaccgggtatataaggattataaatcattctattgtaaagaaacatgtacacgttatgtttactgcagcactatttgcaatagcaaagacttcaaccaacccaaatgcccatcaataatagactggataaagaaaacgtggcatatatacaccatggaatactatgcagccataaaaaggaatgagttcatgtccgttgcagggacgtggatgaagctggaagccatcactctcagcaaactaacacaggaacagaaaaccaaacactgcatgctctcactcrtaagtgggagttgaacaatgagtacacatggaaacagggaggggaacatcacacactggggcctgtyggtggatggcaggcaaggggagggagagcattaggacaaatacctaatgtagatgacgagttgatgggtgcagcaaaccaccatggcacatgtatacctatgtaacaaacctgcacgytctgcacatgtatctcagaacttaaagaataataataaaaataaaagataccttttccaattaaaaaaaagaaaaaaaactctttagaagtcaatattttgttttcacaaggggggatccatttcctgcccatcactcaggatcattcctgatcaaggcccctcattcatcaggcaccaaatcacaggcaagaaattggtctactctacttcattgctgaaaagaaagcctccaagaaagaaagagaaaaagcccttgaagctgcccctgcttgctagggatggccagtgagctggatgaaacagctgcagagcttggatatctaaagattgattttatttatttccactgagccactgaggtttttcaggtgtagagtaaatccaaagcccattaactccaaagccatttttcaaggaaaacacaaaaatgaataatcgcttgctgataattcctttaaattcccgccagagttatgaaattattcttactacagaaacaatcattaaaccacgtcagacaaacacctctgaggtcaataatattccaaatttattctgccgagaattttttaaaacttcgtatctgccacatgtgcaactcaggcattcttggaaaccatccctgcggtagcatatctttacttggaagcagtgggaaaacttggaagaatatttggagaaatatccagactctgaggtctttccarcattcccaatctgcccttcttttttttttttttttgagacacagtctcactctgttgcccaggttggagtgcagtggcatgatctctgcccattgcaacctttgtctcctgtgttcaagcaattctcatgcctcagcttcctgagtagctgagactacaaacaccatccaccatggctggctaattttttgtatttttagtaaagacaggttttcaccatgttggccaggctggtcttgaactcctgacctcaagtgatctgcctgcctcagtctcccaaagtgctgggattacaagtgtgagccactgtacccggccctatttcctaataataaaaaacagtaacttctactcactgagtacctacagtgatttagtcattcttctaagcagtttagatacatgaactcatttaattcacacgacaattccctaaagtacacatgattagtatcctgctcttaccctagcagagagtggttaagtaagttgtccatggtatcacagctagtcagtcacagagccatcatccaaatgcagatatcctgaattcaggttctacattagactaacccaccrggaatggagcaggaaagaacagggaagactccacatttttggcctctatttggtaattatagttaactttttaggtaattatagaccaattatcctagatgggcacttagagactttgcaggacagcaagagctgtctctaatcctgtgcccatgacagacatcaccagtcaaccacaacacagtatttaactaacgcaagtcaactcctcagaatctttaacattcttgtttgtgctactgtaccaatcaatcaatttgatatgagagtgtgcaggaaaaaacaggaaacaggtttgcagtacctccacaccagtattcaatgctgtaatccgctgcagtgactccattaaagactttgcctcccttataccctctccaactagggtgcctagtgttatgaacaaagggatatgtataggttcttgtgttgcctctctctttgatatttttagccatcagataccttgtctgcaatgtgtgctcagagagtgaggggggaactagatgattgattttccaaatgtgttccctaaatgtgttccctggggaataagggcacgagaggctgcctattctatttcaaacaaatccccttcactacagtgtatttgatgagttggggtttgttttaattccatttggaaaagggctttagcagctaagcaaatggttttaaagtgcctcagaagtcaagattaatagaaactatccagttctgatgtcctatcatgctaaaatttcagggactaagattctgtgatcattacattgaaacacagcagcaaagctgtggtgtgttgtccytcctggttcagagatgcaactatgtgcagggctgctgagctctctctgcatctgggtgggagcctaatggaagttttggggctccttmctggtctccaaaatcctcaagaccaccatgtgaacacaggaatcaaggaaggttcttagatygactcatcccccaggcctttggtttccttgctcctttccccractacaggtgtttcatttcaactcatcccctagggccttggttttcttgctctcttcccccactacagatgtttaacttcatttcataaccacatattcccctccttttccaaggcaagatccagatggattaaaaaatgtaccaagtccctcctactagcttgcctctcttctgttctgcttgacttcctaggatctggaatctggtcagcaatcaggaatcccttcatcgtgacccccgcatgggcaaaggcttccctggaatctcccacactgtctgctccctataaaaggcaggcagatgggccagaggagcagagaggytgagaccaacccagaaaccaccacctctcacgccaaagctcacaccttcagcctccaacatgaaggtctccgcagcacttctgtggctgctgctcatagcagctgccttcagcccccaggggctcrctgggccaggtaagccccccaactccttacaggaaaggtaaggtaaccacctccagagctactaggtcagcaagaatctttacagactcactgcaaattctccatttgaaaaatagggaaacaggttttgtgggtggacaagaaatgcctcaacctcacatccagtcactggaagagccagaactagaaagctcccgagtcttttccccacattcaagagggttgctgggtgcatccwtacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccagggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgcccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgtcacagttgctgggagtcatagactctgatagtttgacctctatggtccaattcattaattttcacaagtgagtgttcactcccagctccctgcctgggagattgctgtagtcatatcaatttcttcaartcaagagcaaagatggytttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgtatctcccacagcttcaagaccaaactggccaaggatatctgtgccgaccccaagaagaagtgggtgcaggattccatgamgtatctggaccaraaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttwwaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggratacataaagtatgtgcatattttattatagtcactagttgtaatttttttgtgggaaatccacactgagctgagggggacaaagatggctgtggccaagaggggcttggttaagggggtgggaactatgtccctgggaaatgagtttttggcttagctggtcttcattgaaatgcagggtgaaactgacaaacccattccagccctctattcccattttcaacagtatttcccagaccccaaacttcagccacgaaaatatctggagctttgccaccattcctttcctccccacctcatacttgcctctcctgggacctattttaacagccctgtggtatctccctctacccgaccctgctcctcggwcttccaacccagactaggcagacatgacagacactggaaatcagaggaaggctaggtgacctttgaccagaggtttaggtgcaggttttacaggtgtggtggagcttaaagtgggtcttgtgcatgcacaaagtggagaggctctgctggaggtatttcagtctaggtagaggagaaggggtgttgcttgggcaaaatccaagaagtaggaatgatcatgctgcatttacccagttgggtgggagcccatcaaaagatgtcagtgttggagtrtgtgtgaaatggtggggaaatttggaaagaagtttragaccaggctgtctaggtggggagtttgtgctccatgtaaggtgaacatatggttcttcccagcccagttaggatgcttttgagagcagaaaagtggtattattcataattattctggaacaacggatataaattaacactgtcctaagcaaactggagcatgtggtcactctaggaatagaatgcattgcaagttttgattcagtggagagaagtgccatgaccacactatgaggggcttcaggaagggcagccaggtggccatgggctgaattgggaggagaagggagaagcacttagctcactattgcagtgtatggaagatatggaactggggcattggtagttgggaggggagaagataattggaagaatggctgaggcagggtggaatgccaaatgttgtggttgaagaagtagaaccaatgacatggaaactttctaaatgccaaagctgcaattaaaggttagcttcttagacccagaaaattaatttctctctgtcactgtttactcrcaccttaactttactagcttgagagctttcaatcaaatggacaggacctcatcttcctgtataagcaacttaaatcaggattccctttcagcatacaaaatcagcttgcgtttccattggtcacattacctatgtacctgaacgcagagaccaactatgtccccaagggtagaaaagggtcacaggtgmcctgctggtataactctgcatggtctaaggccattgatctggagggccaatggcctactgtgtcatgcatgcccagcagggtcgctgcatgcaaagctcccagaggcaccattcataaggctgtcccccttggactgtgtggtggcaatggcacaaggcaatataaagaacagaatgagacattaggaagggcactgatctaggaggcagatgacctcagtttcatcacagacagagaactggtctctgtcactgtgttacttttggctttagttaccccatccataataggggtatattaatatcttttaagggatctgaccaatgacccaccaagatctcctgttctgagagcactacctcttggaaagcatcaytacctccacccattgagggagggaatgttgtcagagggttccacactcacaagcccaagtcggacaggggccaggataactggcacacttactctatttctagaagatttctctgtgagagccgcaagtagaagcatggatccctagaaccatcagagagctttttgtatctactacagaagggctcccactcagagcaatcactggccctcactctgagtacaaaaaacctctctgcctctcctatagcctagcagactttagccctaaacatcaatcaggatgtayctccagaggtcagcmtgtccaggaggcatgggatggccacagaatagctcactgggatcagtagaccctcaggtttcaggtcagtcttcacgaggmgatcaagaaggggagtagagggaagaggtgccctctgtttgtgaaggactgaacagaatttgctcatatcccctattcctctctcaaggaatcctgaacctaattaccctacaattgggaatagcatcaccagggccttgagtataaaactgtgggcacaaagcattggagrtgtttaagttttctgatggcacacagatctcaaccaggaatcagggatgtcaccaactcatttctctggaaagcatactattagatgaagatgttcatgcagggttcactgagagtatggggaagctgaactaaggagagggagaattgrtattgtggtgcaattgcagcccaggtctcagcaatcccatagggagctttagaactgggatagcacaaatgaggtcgaggggccagrcttttatacccccatctgaaccagccctggctgcaggatgctcctggaagaggacacaactctgggcaaggcagctgtttttagctgacggcgggcmtcatagaggaaattccgctgagaagcattggctgccaacacttctagcagctggggaagaagcactttagacctgggagggaaaaacttgggcagcacactatgaactccaccatgacccaccccttgtgccattcaaatccacttgcttatatacaaagttctggaaaactcatccagaaatctgttgagcctcattttttaaggaaacttgcaagaggaaggttggtggagtgaacagtagccacctmcaacagctgcaactggtcttgaggttataaatgatgcttatcaccccactcctagaacactcattctagattttcctcaacctcagcccatgcctctgctggcctaagtggcttgccttcaggattcacccagaccctcatccctgaggggttcagcccctggtcttcacactcctctcaggacaaggatatggctgctactgttgtccatttgccattaaaattgggtcaagagacatccaaatgggtcacccagatgccaaacatattcttatctaaccccattgagtaaaagcagctccactcacttctgatgaccagggcccattaccctggcccggatagtgacctcttcctctccttgcctgttagtttcttggcctgcaagtctaaagagatagagtgcagccacagctgaggattaatgagactccctctaggaaccaaggggtaagcattcttcctctgggaaacaggatttctaaatccgtacagccctgatgtgcacaaatcccccaaagtggatcactaggagtaatggtaagtagggcaattttacttccacctttgacatgaatctatgaattttacctattgggaatacagcttcacttattatttgatttaaggtctatattgaatcctagaggatagtatttcttccttgtaggatactcttyccaagctggtgccttaactgtgccttcagcaggccattccattactgtatcagcctggaaacctgyggataacacaggtatatagtgggatcagtggatccgatgaccatacacccagtgctgcacctcatttgctgtagtgtgtcttccagtctatagtgatgttatgtggcatgttgcgccagtgaacaaacacttgtaagctctcagataatggtgctgtctaaggtactggagacagaaatggcaaactcatacctggaaagtgtttctactccarttaagatgagtcattgctcttttcagagtagaataggtgcaatgtaatcaaacatgtactttccaccaaacggctggttagtctccctgatggatggatgatgccatagcyggggatcaacaatgggcyatgttactggcaggttggacattcagctacagggccacgtgtcatctgaactcctgctaccataatgactttgttcatattcttactgtcccattactgtggtgacaaataacagaagctggctgatgccaactggctgagtcatcttgttaccttagtcattctgtatgtccaaattcctgatgggattagtaccacatctttacatactgtgtcctgtctcataggttcgtccacttgcctctctgccagaacccctttcccccaaaatttttacctttgtctttccaggcccctgcccaatgatgcagaccattcaacactatctatctacgagtccatatatatatatatatwttttttwtttttttattatactttaagttttagcgtacatgtgcacattgtgcaggttagttacatatgtatacatgtgccgtgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgtggtgtttggttttttgttcttgcgacagtttgctgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatcaccacactgacttccacgatggttgaactagtttacagtcccatcaacagtgtaaaagtgttcctgtttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggtaatgcctaggttttcttctagggtttttatggttttacgtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcatgtcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagct

SEQ ID NO: 13322 - DNA, 76589 bp, Homo sapiens
  misc_feature (1)...(76589): n = A,T,C or G, or insertion/deletion polymorphism (see Tables 1-2)
acattagcttgtgcacgatttcccacataatgaaatgctcttcaagtatatgaatcttagcagcttcactgtatttcattcggtcgctctcctcctcgaaatattttcttatcttggctcctagaacaccacattcttcacttttcctccttcctcaccaaccccacggtctcctctgccacgtctttcttatcycccttacctctaactgttgaagaagctccagattcagtctttaaactgcttcttcctctactcggatatttagggaatcacattctacctcacagctttcaacaccacgtatatactgacagtttccaaatttatatctgcatcctggacctctgtactctatttcagactcttatgctcagtgtcttatagacatagttatttgtcttacacagacctcaagttagcatatccaagactgatctgataatcaccccaagtaagctcccactgaagccttgactatttctgttaaggacgatgccccattcttctagttgctcagatctaaaaccttcagagtgacgcagstctcttctttctctcacgtcccatatcctatcattatctgtcatcaagttctgttggctctacctttaaaacatacgcagaatctgaccatttctcacaaacccactagcactaccctagtgaaagccacaccatctctcacctgaaactgatgttcttgcttccctccccctcccctcttgaacccattccattgggctgttattccaactactccactggaacagttcttatcaaggccaccaaagactaccattttgacaaattttacggtgatttctcagtccttattatactcagctggtcagaaggcatttcacccagttgcatactcattcttcttggccatctttcttttcttttactttaggattacactttctctttgtgtctctcctaactcactgggtgccccttttcattctacttggcaggttcctccacactctctgacctaaactattgcagtaatccatggctgagttctcagacctcttcccttctttatctccactcactctcttagatgatttcacctagtagcataccttaaataccaayatgccattggctatttgatgtctcttccctaaactctgtactcatccatgctactgccaactatttcttgaatgaatgaaggcaggaactatgctcatcttcatggttatactcagcacctataatagtgcttgacacagcagtcaattatcaactgttaaattaatgaatattgttcaactcggtgccactgtgagaaaattaaaaagatagatgacagtcattagctaatttcaagtagtttttttttttagatacaagccagtgccataatagaaggcagttcatgatattgttttctaaatatacattggtccgatggtctggcttgttccaaacctaagtatcagagcaccaaaaggaagtgatagataaaatgtcagtcagtaaaccctctgttaatatttttttcctcattctcaggccattagtaatgtttgagcagcagaaatcttagagacatattcttaaatatcatagagtaaaagaattctatgctgccaattcataacaaaatcaggcataatcaattgagtgaaggttaaggttggcactgtcttgmaaaattaagcagcttaaaaaggacaaacgtaacaaagaaaagggacctattctatgttcctttgaacaagaaaaaaaataaatgttgaaaccccaaatgtccaggccatttcagtttctcagactacaatccattaaataatcatttaatcacagtgacatggatgaacacacagatacactgttgagtraaagaagcgtgacatagaagactgcagaagatgctacagtctttgcctccactaggaaggagggccacatgtgtccatttaagttaaagtcaaaaaaggataggagagtactttcaaaaatgatgaaaatggtggatatcttaatttgggtgatggttacatgggtgtacatatttgtcaaaactcagtgaattgtatacttaagagcattatgttttaataaatttaaaatataactcaatttagacaaaattaaagtgtctttcaatgagtgttctggatgaagaggaatgaaataaatataaacaaatttccttactgcaggatctcttacagcttttaatatgcaattatgcactgtattatttctaagaggagactataagatacagtaatgttccagacttaattggtcaaggaacctttttttctcatatacattgacatatgtaagacactacagtttcagaaacccaataactttagcctggaaaaaaattcaaacaaaggctacaaataccactgaagtcattgagaaaatattaacatctaattttaagcaatcactttctagtgaatcttccaaaatgaactagttataaaatgtattcctatatatggtccaattaagaactagagaaattctgcccaagataataaatatagttctggtattgttaaccttaaattccttctggcagtaattagatagcaaagccagatgtatattgaagaattctaagcttatggcaaggaagcatcattcatcatcacatagacaacacttatctgttttgtgtaagacatccaactcacccagagatgttattcaaggcattaatacacagctaaagatgataggtcataggttgagctccccaggaagctgactctgtgactgatgtgtgtgcaagagatttgtgtggggcgagctctcagatcaacaccggcaggggagcaagagaagccagactggacaaggggagatatttaacttggatttgacacaacaaaggcctcagtgaatcccatagaagcactggaaccaaagttcttcagccatcaggcaagagggccagccctttatatcctcacaatggaccagtctttgcatgctggctgccacagagaaggggcatgaccactggcaagctggcytccttggctgaggggagtgttcacagaaagagtggagagccagccaccaatccttccagcagcagggagcccgagtctcagccctgaagcagaagctgggcgaggcatcacggtgcgcactacagcagccaacacacactcgtctcaccaaactcacaggggcatctgcccagcaagaaactattcctacctaatctaaccctcatgctattaacckagaagctctgtttaagaatcaggagcctagattatgcccctactgctttgtccataacaagtattcataaaattgcaataaaaactagaaataatcttagatggtagccaaaaaaatatttcccagtgtaaaccacataataagaaacactgattagttttggcatgactagaagcctagctgttcttcatgagaaataatggactgagatcatcagaattctctaagagctataacaagaacatcyataaaatttaacctcagaaaacttttgaataacttcctgacactggagtattttttatattacatttccctctgctatctttaataaaattaaattggtatcccaataaacaaagtaacaagamaaaatgagaggttctaagtttctccctggttctcctttttaataatcaattcatcttaatttatgctaataacaattcagtcagaacacatctgttgaggaccttccattatgagataccatgcttagataccacatgtgaggtttatgaattgcatctgggtggataatataatagtataagatagatgtaatatagattacatctatattaagggtatggaaatgaagttcaacatctaataragaagacagacatttacacagatgtcatgcattcattcaacaaacatacttaagcactatgcgcccagctgttaacaagatagayacagttcctgcctttatgaggcttacatgagacatgatgtgttaaaaatagaaggctgcagaaggtgctatagtctttgcctccactgggaaggagggctacagaaagcttaggaacagtaaacttagtaagaataatagcaactaacctttattgagtgcttaaaatgtgccaggcaaatatgtaaatttatttggctttcacgtcaatcctgaggtctttttattattaatgttccctacttgcggatgaggagactaaaacacagagattaggtagcttaatcacgcttacagatgtggtgagtggtaggcctgggatccagagctgctctggaactragcacgaatttgccagatggacacacacaaaaaaggaatggtaagagcactccgggcacagggaagtacaagtacagagacataaaaatggtcagaaacatgtaagttcagtctgcatacaggctgactgggagagtaaccagagtccaggcctgcaaagtggggcaagcagggtacaggtagatgaagaaaagtgttatgtgccccacaaggaagggactgcaggagtgtaggcatgggagtgatgccaattgtgtcattaatatcagtaagaatatcaataggaatgaaagtggctgacattacttgagaacctcctataagccagacatgggccaaatacttacacacattatctcagtttagcttcactacaatcttatgaggaaggtattatcccattttacaagtgagaagactgagctttaaagggagcaactagatgaggcgaggttctactgtttatgagtgatagagctaggatccaaaaccaaggaactctaaggtctgtgttctccgctgcctgctcgccagcgtgcatatttaacgtggaggggtaggagggtggcaggcakggcagtgaggggggcactaaggcacccacccaggaaayaggtggctagatctcgaccacagggtgccagctgcaggctgcaggagaggacatgtgagaaacacgcatacagaggtagcaccggagacgaagtgggatctggcagcgagaatgaaggaagagtcgcggataacagcagctgtctgaagaggtggtgattccatcatgcaagccaatgggtaggaacaagcactgagagccgggcagggggatgcggagtgagggaagatgctgaggtcaaggtctcccaggctaccatggaaggagccaatgggcagctagagatttaggtctggaactgagagaaataatcagctatgaaggtacagacttggccacaaacatattgaaggcatgagagtggttgaatttgtcyagggagaatgtgaagaacagaaggtgatagaactgtagcaaaacccaactattgaggaaaatattttcatgcctgcaaaaagagagagatcgaactgcctcctttagaaacctacttgggaaagggctttctttacaagtaaggcaagttgtcattactggtgggggaaaaaaattggtactgcgaaaccaacttatttcctaccacatgtgaggttttgaataatatctgggtggcatatttctgctgmagaaaataagccagttcaatggtgtatctattaaataaaaatagtgctaatagtttatcagagttatcaccacagacgtgcctagccaccctgagcctatgtggccaatgtcagtaattccactctggacacaaacactgttggctttggatggaagtgccngacactcacagcactcygaggacatactgttttctagccttatttatgttctctcttcacccttcagcctaaaaaattaccacagtgccacttacctaccttaatgggaatctgcacaaaaggccatttctccagtttctctcaaaagcaaaggaaaacttcccratattaatatgtagcaaaaagagggagaagaaaaagcctgtttggtccgccctcctggctgttgctaccttgcagcttatgacatacacrtagagggaggtctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtgraccctgaagacaaatgtaagttctcatgccgctatattttattgctgtgtaattttctttccggtttgaaatcatgcttggccaacatgtaatcatttcaatgagaatttccagggaggaaagttgtctgctaatctttacttaagacttttttgttttccttttattagctaagcaacattataggagctgaaattcctgacagcagctgtggcaattcarcytaagaatggctgagaactgtaacccaaagtacatccaattactatgggattaacactggatgtatttttaattgactttcttaatgtagaatgtgtacatccccactgtttctgattgcatgctattttaataatactgttgctaaactagtaccatcrgcataaccaacaaaatgagatatagttaaacaagagtcccagtagttataaaacttttcttctttgtccaggacatttatcttyccgarcgctcaaaaaaarccctgcaacctctatgctaaaagttcattctgcttttttgtcctckstttggtgagaaaataataaaaccaarcagtggactctcctaaaattgtgaatgaagaaaacttacagccaccacagttcagttctttaactatcattgtaataatggaagacaaaaatccagccccgggagaacagcatgtacaccagcctcagtgttacagagtgtgggtacatcaaggtgaatrgtgagcagaaactataacctgttagtccttctacacctcatctgctacaagttctggcttagacatggatattctttgtgaagaaaatacttctttgagctcaactacgaactccctaatgcaattaaatgatgacamcaggctctacagtaatgactttaactcyggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatggtgagtggcattagtttcccagctatattcgcactggtaataaagagcatgtgcatgccaccagcagatgagatggggctcagggggcaaacaaactataaatagaagtctttgtttatagactagagcctactatgttacttatattttactcttaaaatgggatttcacataaaaatcagacagtctatgacctgtgatcactggagagttttgtgcttcaaaacgcgtacatcctgtgtaaaaatgatcattggagagttttgtgcttcaaaacatgtacatttaatgtagraatttttataaattaccccatacagtcataaaccaataacttacccatcattctgaatctacttgatttttgcttctttatattcccaaccaatattccagccttcaggacagaacagttttaatctttgtcacacagttttcagcacttttaatggagtgataaagccttcccaattactttggaacatttgcagagagaacattagtggtgcaataggttttatgttaaaatatgcagaacctcaattagaataaatgaattactccagttttaattgttccctgcccagagaagctaatttggaaatgtgcctttgaattatatcctcaactctttgaaaatgcatatgcataaactcctccagtctggtttggaggagggtgggaaacaaatgggaagggattaatcttgctttcttctcaacagagtttgaaacagtcagacctctcagcaagggaccagaatgtgatattctttccaaattatgagtaatacagccagatacctccttaaaggagagactattgtgactgctgacacaggcacaagcagcagtcactcagagcttagagacaggttatgatagctatctttaaagggaaattttctggtcaagtcttaggggctaagattaaaaaacatcaacccagccctagagaatgtgaaggaggaaggcggtacgcaagggcgagcaggcgccagtttgcacaaagctagtaacactcattccaagtccagccttcacttgaccrtttaaatgccacaccggaatgatttcatttaatttgcctgccctttccccggcatcccggggaagattctcgcttcccaaaccccctcccctagggggcaaactccagtgggggtaggaggagtgacagagcgggacccaaaacagaggctggagggtggggtgacccccggcgtcacccgcttggggagcaagggcgccccctggcggccgccgctctgagagcagcccgttccctccggagccccgcccctccctaggctgctcctccmgcctcccccagcccacggggcgtggggcatggggcttctcccacaaggaaatgccccctccttatcccgcatcagaaacacggactgaggcctgggccgcctcctggcagagaaacccctccgagggccgacatctgttccgaacagacagagcgtggcttcccccataaggcgctgcaaaggaaaaggctttcctttcggctcaagctctttgcaaataatacatgtgaatggctgtaaattaggcttgtacctacgccctttacttgtctaaatatcccttgtggcattttggtagagagtgtacgtttgcgttggagtttgttcggctttgtgggtctgtaataagaaaagtggactttaaaattttccttcttacatgcaggcagatctaactccgctgcttatactgtgatcaaaactaattaaggtttacataactgcttaatccccctccaaaacacaaaaccaggacactttgtttatgtccataaagcacactctaaccttcctcatatagcaggtgacctgcagtatctcttacattggaattgtctggggagcttggaaaaagctttgcaaacgctttgacatttgatgtccacctcagcccaccctccaaacatgatttaattgggctgggtttggcatgggcatcaggaccttctctaaagctctccagytgatactgatgtgcagccaggggtgagagccactaccctaaagcagctattcacaaagcgtggtccctggaccagcagcatcagcatcacccgggagcttgctaattcagatgcaaattctacagcctgctccctactaactgcatcagaacctctggacggagktccagcagtgtgtgttttaagaggtgtggcagagtctgatgctcactaaagtttgagaaatgcctccctaaaacaaagctcagagcaaggacaccttyctttatttttcttcacccttgtcttcagctctccctacacataccccaaatttgagtttggcacccaaagcattattagatcattatttttcatttttacaaacagacatattcacaatctgaatttttagtcatttagtcatttgcastaatgcaatttattgccawcactgtatgggactggatggttataataatgactaagaggtgagactaaccttagggaaatacartccagagaaatatgtgactaaatcctgacagtacagtgtgagaggtgctccagaagaggrgccaaaacacaaattttgacataagccattaacaaaagaaatgttttgccaggcgtaagggggaagaaagagaacccccaaatagagaccatccaagcttaccgtgccacactcacatamctccagacactagaaattttcaaaccctgcattcatcagccagtgctagcttatcatagttaagtacagttgccagtgggcttttttcaaatactaaaaatatattgtgttgccctttgccaccacctgtgcctgtcccagagctggaaattgtcataggatagggatmcatgtgctccaggaggcacagggttgctcactgacaccaaccttctgcctcatagggtaccggtggcctctgccgagcaagctttgtgcagtctggatttacctggacgtgctcttctccacggcctccatcatgcacctctgcgccatctcgctggaycgctacgtcgccatccagaatcccatccaccacagccgcttcaactccagaactaaggcatttctgaaaatcrttgctgtttggaccatatcagtaggtaagtggcaacatatttcagagtctcatttgaaatgacagttcgtgctttctgaaaagacttgttccattttgtkgtactgaaacctgacatcctcaatctactgttttgggtggtgcaagatatgttacaacatcatarttatcagattcgcttcaggaaagaaaaatctgtttatgtcactggctgacaacatgaatttgtattgctttgcacaggcaaaactataaacagtagagccaaaaagtcagaaataactgtgctgttttccctatttcttactttcaagtccacractctaattcttgggtttcccaaagacctcaacttttataatcactgaacttatgatcaacgtaaggatgcagaccactttgctagagaacataaagcctctgggctctagagaaaggtaccatgtgctgtagcttggagggaaaaggtgggccagaggaaagtgccaggatttgctttggggcaaggctgcttttcagtccgacccagtgtccctattgaccttcctccttttatgataccacacaccaaaggatttcaacttgcttctgttaggttgattacatatattcatctctcgccagtattgatcttctgtcacacacctaatagtcagaaaagcccaggtaatggaagctaagggggcgggtctcaggcagtgaagtgaattgtacctgtcaacctcagcagcttggttggtaaccaaagattctctgacattcattttaaaatccaaaagcttagcaggcaggagtgttgcacctgtttatggccacgccagtgccagcatccgctaatatgagagactatgagattccaccgcttgaaatcaagggcttgagtgagcttatccacagcattggaataatagtaccaataataagagccaacacaataatactatatcttgtgtattttagttcccattgttttctttgctgctagcaatgggaactattatgcaatttgaagagtaagtagctccatcttatagaygaggaaaaactgggattcaaaaagcaaaatgagctgtgcaaagccccacagccagtaagtagcacaacaaggattttattgaattctgatgggaacatctgatggaaacactaacaaatcacacttgtgtcactttcaaatgtttaaaaagtcttacctacttcctattttaaatttcccattaccgtttgagatagaagattctatggtgcttatttgataaatgaggaaaccagaatacagaggtattgtggcttactggatcatgtctccaacttgcagcaggactaggactctaaacttccagcaccatgccctgttctttctgtaccttccttaggaaacagtttttgctcctagaaaatgcttgtagtttctgggactgtgcaagttggactcattctactaagagcaagaaagtgaagggccagtaaccactmaatcccaattacacataaaatgcccctgggaacattmtgatttaattgcctagggtgaggccaggtgattctaaggggcagtcagagttgaagaccactgagacaggttttcagggtggtcagcgtgataagtaggagaatcaagattaatgcagagggagcaaatgaagctatttatttttaccctgatacactgtccatagttttaccccaatayactgtgccattggtgagacaaatgctgggaaggtcaaccatcttttcctcagccacactgactcccccatctcattcaggcttcatgataacaccagtagtaaggtaacagtttctgagcactgagtacggacccagtagtatacaaagccccttaaagaaaatcagcttcagagaactcagttgcacaggatgatatcacttataatcaggagtcaatatgggtcaatctgagtccaaagcccatgctctttccactgcacaaaagatagccagaaagagccagaggcagactatcaccacaggaggcaggcaggctggaatgattgtggtggtgccaggcagggatcattcatccatccacttggccagtctttttgagatgaagtttcgctcttgttgcccaggctggagtgcaatggtgctatcttggctcaccgcaacctccgcctcccgcattcaagctattctcctgcctcagcctcctgagtagctgggattacaggcatgtgccaccacgcccggctaattttgcatttttagyagagacaaggtttctccatgttggtcaggctagtctcgaactcccracctcaggtgatccccctaccttggcctcccaaagtgctgggattacagtcatgagccactgcccccacatttgaccagtcttgtaatgtgcatctactatgtgtttggcactgtatagaccaagatgaaaaagatatgcattcaaagatctctcacagtaaggtaggagaagacaaggaaacaaaagaataaaaaaaagttacatagaatctatactagaagtctgaggtgtgtgccctgaggagggggcaagcggaaaatgtaaaaaggaaaaagrcagatctaatgaaggacctacagagactcagcacaaatattctcttgagttttcttctagtgtttctgttttgattattttgctttgggtttagttttttgtttgctttgtgtgtggtttcttttaatttagatccttagtctagctggaattttaaaatatgatctaacytgtttgcttctactagtaactaaagctttttttagactcaattgatattttctcttcaagctattgatatgttcactctcttggtaaatttctaaatgtaatactgtcttacattcctggaatattgagtttgtatgacaaagttggttggtttatgattcttacaagttttctttttctagctttattaaatgayagagaagtttccactttccctaagtcttgaagtctttaagtagaaattacatgtttttgagaggttatgtagaacttggttccaaatctcttcatcctggctcctttttaaatagtattttaagttacatttctaacttctatagttattgcatttacattttctataccttcatgggttattagctgcatacaaattttaacctttacattgattcttttatcattaactgtcccactttatatctagtgatgcttcttgatttaaaatctatttgatcttagtatagctacgttaattttcttttgattatcatttttggatatatcttatttcatcctgttactttcaaaccttttgtgactttaaagtgttagcctgtaagcagcatataaagttttgtttttaaccccatctttgtcttttagttggagtatttagtccttttacatataatgttaactcatatttgggtttaaatctgttatcttacaatttgctattttcttatttgttctatattctagtttcttttcattcttaccttcttttggactaatcaagaattgtcaattcatcattcccctttatgagcttgttatccattgttttaaattacttcaatgattacaacattccttattgaccttagagtctaaaacaaattattacttgtaacacttctcggatagtgcaaaaactttagaaccttttagctccatctatccctgttgtcttttgggtttttccctatttactaaatgtcttttttaaacccataagacatcattatagccattctattcactatttctcacatatyaacccctgttgctgtttattgctttcttcattttcatgattttgcctgggttcctcattcctgaagaatttcctctagaatatcatgtcgtttgttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcaccttgtgccacgccctgctgcttcagaatgttttgtctctattttagcaactttatcatgatgtacttagttgtgaattagtttctgtttttatcctgcatggtgtatgtactgattcttaaacttgtgactttggccactttgacaaaactcttggtcaccatcttttcaaatattgcttctgccccattctctctcttcctcatgtctgggactccaatctcatgtatgctaaaccttttacctaagttctttataactcaagcacttctacattttttttttttgctttgttcttcaacttttaagttcaggggtacatgtgcaggatgtgcaggtttgttacatgggtaaacgtgtgccatggtggtttgctgcacagatcatcccattacccaggtattaagcccagcatccattagttattcttcctgatgctctccctcccacctccccccaccaacaggccccagtgtgtgttgatccccaccatgtgtccacgtgttctcaygattcagctcccacatattagtgagaacatgcagtgttaaacacttctacattttgtacatttttctcctyttatttcttgagatagctttactgacttttcttcttctgttactagtcctctcatcagctacttctaatctgcctaagacccatctcttgttttcttaattttaattcctacacttttagttctagattttttcatttaattctttataaattccaggtttttagaataattctccatgttttcatctatttycttaaatattaatcacaagttatctggatctctcttttctgggttgtgggattacctagggatttctcttttctgagttttggggttgtttttctcttcattctgtctgttgatatgtytggtaatttttttaattgagtactgtgtatgcctgataattttttttttttttttttgagacagagtctcactctgtcgcccccgctggagtgcagtggcgcgatctcggctcactgcaagctccacctcctgggttcacgccattctcctgcctcagcctcccaagtagctgggactacaggcgcccgccaccacacccggctaaatttttttttgtatttttagtagagatggggtttcaccatgttagccaggatggtctcgatctactgacctcatgatccgcccgcctcggcatcccaaagtgccgggattacaggcatgagccactgcgcctggccgcctggtaattctttttaattgaatactggacactgaaataaaatgtttgggtgttttgttgatactgcctttctccagagtggagtcttttagcattaacagcagttaaagtaagcacagttccccttaatccaataagggattgagtttatttaaggcaaggttcttataaaagccagtctatttctagtttgcctttatacctaggatgtattttttcatgatcccagatgaaagcctgacgtgttctccattttgaggagctctgagcttcaagtttcatatcctcaacatcgtaagactactgctaactctctttagctattcggtctctcaatctgttcctttaacaaactggcaactgcctgagtagaaaggtagctcatagtattaccttgctttcttgctcttcccttcactccagaatcttaacttcttaacatcctggctaccttggtaccctctcaccaattgctttttctctccctgaccccaaggacaggtttgggaccttgaattctgctttaygtggtactaatattactctatcttttttgtttgactctccccaggctattttctcaccttttcatttttaatatgtttttgtagctttgctttatgtgcattttcacaagtaacatatggatagatttayttaacaaaatctgttagtctttgcctttttaatattgaaatttgacctgcccacatttgtgacaatcagcatcagttttagcccttccatcttatatttatattttaatagctcatttttaaatgaactatttcatttactgacttgcacaatrtcttaatttccttcctccaacccggttagtttgaattgttatgggactcttccattgctcttatgattacagtcccatttcaaatcatcacgttatttctattaatatatctaaaataaataatctcattaagttatttcctcattaccctgagtcccaattcacaagttttccaataatttctaaataacctagtggcagaatagatctttaaaagcaagtcaaaaaatgcagatgccataaagaagaatatatacataaacagttatataagtytgatacggctaaaatcagtgtaagcaaagttaaacgaaaaatatttgcaatgtatatgattggcagaccaagggttaataaccttaaaatacaaatagcaacatatttaaaaagaggaaaaggaaacaatctaacagagagaataagcaaactaaaatttcaggcaattcacagaaacataacttgaaatggacaataaaacttatttaacatgtttagcctcttaaacagtcatggcaatataatctaaaacaatgcagtaacgtctttcacttatccaattggcaaaatgaagttagtgaagacagccagtgctgccctgaatatggcaccacttgcactctctcaaaaccctgcttgtggaaatgtgaattatttgttcttgggccatctagcaaaagctattaaaacttgacctaccaattccacttgagagaatctattctatagaaaaacaaaagcacatgtaatgatttttaatgcagcaatttcttcagaaagaaatggaaaggttggattatgtttagatatgtcacttttctctaaattgcagaatattttgaagatcttaaaaatattaagttgagactacagttgtttccattatccagtttccctttccatagttttatttacccagttaaccacagtctgaaattgttaaatggaaaattcaagaaatagacaatttgaaagttttaaatcgccctccataccaagtagagtgataaactctcccgccatcctgcctcgtattacccagaatgtgaattatccctttgtccagcatatccacactgcagatgctatccacctgtgagtcactttgtagccatctcagtcatctgatcaactgccatggcatcatagtgcttgtagtccagtcatctttattttactcaatcatttactaatactttaattcttactgctgctaatctcttactgtgctttctttataaattaagttttatcataggtacgcatatacaggaaaaaaaaacagtctatatcaagtttagtatccttggtttcaggcatctactggaggtcttggaatgtatggccctcagacaaggggggaccactgtatttgatatttaagtgaaggaatgttcataatgttaaatgcaagaagcaagttttggagtggtatgcatggtgtgagctcattctggtaaactaatgataatatagtgataatatgtggagatatatatatatatgtatacatacacacacaaatacacacacaagtgctgagaatctgtcaaaagacttcacacttatcaagatgattaaattagaaagaatrgcaggattgtcatctttttccttaagcatttctrtatagttttgtcacagttttgttttgttctgtttttatcttgagacagagtcttgctctgttgcccaggctggagtgcagtggtgcaatcatggctcactgcgagctccgcctcccaggttcacgccattctcctggctcagcctcctgagtatctgggactacaggtaygcaccaccactcccagctaattttttgtatttttagtagagatgggttttcaccgtgttagccaggatggtcttgatstcctgacctcgtgatccgcccaccttggatttgtttagatatctcacttttctctaaattgcagaatattttgaagatcttaaaaatattaagttgagactacagttgtttccatttatccacagtttccctttccattgttttatttatccagttaaccacagtctgaaattgttaaatggaaaattcaagaagtagacaatttgaaagttttaaattgccctccataccaagtagaggccttggcctcccaaagtgctgggattacaggcgtgagccacttcacccggcctgtcacaaatatttttattccaaagtgtttcagatgatccakaatgcagctgttataactgcatcatgggtcaaagacagcttcttggatgaggcggccaactttcaaagttagcaaggatctgacacattttcacctcggtaaccacatcatagattagtcaagttttcctgcactcagtactcctgaaatgtactgctgctttccccttgctcaccattatcagtgtggtcacttcactgcttgcsaaggattccatctaattctgaggaaaaggaacataattgcaaatcattgtgttttctgtgtgggagcttctgagtaaagcagcaatgacaggagattgaagcattggattaagaataatcctgcggggtggaragagagtgatcctagtattctctatggatttcattttccctttataaacctacttcccatgatcagcagtaactgtgacttcaccgcaacgtataaaatgagcaaaccctttcctcaggatggtttcttttctcatggacccttcatgatgtatcctttttccatctgccaatgccatgagaagagaaaatagaagctactttatttcctgtctttagcaaagacatatctcagaaaaggtgaaaatgactattctcacattgccgtattctgacaggcaaccaaagataccactttaaattccttttccagatgttatttcatttcagaaatatatttgcagtttatggggtaattttgaagtaccgtcagtctaaatagatttttttccctcaaggataaacataatcatgtattttctgcattattacttttgtaatgggaggaaaggcaagctgggttacatttatttggggccattcccctcaagctgtgacaccttacatagaatcctaaccttcctggacctaacctcttgccttcatgcagctcaaatagctrccttcctagacagtgcagatgtttcaggaagctttgaaggacagagaaaatgataaaatctcattgtagttttgtgttgatttagtatatgggggttttagcatcgcttcatgttatgtttttattttctataattggctgyccatggtttttgctgtaggacttggtgaatataagcaaaatgtctggagccacactatctggatttgaatactggctctgtcccttctaagctgtgtgaccttgggcaagttacttcacctctctgtgtctcaggttcctggtgataaaatggagatggtaacagaacctacattatggtttctgtttgcatggtggatctctcttggattctatttcatatactaattagccatgtgagaaaagaaaatagatgctaatttattttctgtctttatgaggttaaagattgagtaaatgtaatgtttgtcatataagtgttaattaagttttcaacataatttgaactcttgtcttggctttttcctaattggtaaattaggggattaagctctttgtgttatcacatcttacctgtatattcccagtttgttacttgtcacttgacattacttgtttttttccacatggatttatggagtctcatttattaatgttcctttctcttatggcttctgaattttgaatcattgctacaaaagccttttccactataaagttaaatgtttcctcccattacttttatggttttgttttataaatttaagtctttgggccatttagaaattaacacgtgatctaattttatctttttctgcatggcaaccyattgtcccagcatcatttgtttccccatagacttcatataccacctttgccatctactgcattccatgtgtatttaggtgtttattgactgtttctactgatctgtctagtcgttcaccacarcatacttttaattaaggatttttttattgtctctgatttagtactttctcttttttttttttaacttccctgaccattttcacttgcttgtgagtttcaaaactcagcctctaatttcccaaaaactactatacttggaattgcatgtaacttcatgtatctactttctagaccttttgactggcatactttttgcactttttttggtcttattttttacttctttttttatgarcracctcaaattctatatggaatgaagtgaatgtatacaagcaaatgtaactacataaaatctaagcacttaggttgaaaaaatagcatgctcatttaggtccaagaggaatgacagcaaaatatattttcctatgatacygtatcttctggaaaaaaaatgcttgaaaaaataaatcaactgagtaaaccagactcaaaaccagatggtgttctgtcagcctttacactggaggacattcccagccccacagcctgaaacaaactatctgaggaatccacttgagattgtctctcctgggaccctccaggtttatgcccaactccttyatacggctattagtcagcctaagaagtacatgtcagagactattcaggcaaccaggacagaaagggctttgggttacctgtcctcacttccacttctgggagatcatatggtaagttagcatctaccagaatacaaayggaaacttgaattagtccaagtctcctttggtttctctatcttttcactttctctcctagggggaagaagtgaaattgcctccatttgttgtatctttattkttgttcctgccatacttcatttccctccccagaggtccagagagagatccaggcactgccccagcctgcagctgagtggcttggcatccaggaacagagatgttcatagccatgttgagagaaagtgctactgtctctagagtatggcagtgctggagagctgtcaagtgtcaagtggccatctatgcttgtcactaccctgaaacaaaggatccgcagggccaccacttggcccaccccttctcttgtccctgagtrcagtgacccttcccctcctctgcccacagatgcaagagaatttagggacatctccttgcctggccagttgtctcatacttagaagcacaatacggtaaaatatcacgaaaacctctgctcttgaaagacatgtcctcggttgtccttcgggacattaacccatggataagaagtcatttaatgacccaggcagctgagagcctgccagagtggcagctgacttctctctgcatggcagacttcagcctcatctttgggaaaacatgctcaataaaacagcacttagcacagcatagatgatccatggccactggaaactggtgagaataattaagaaacgatcaggtcataagaaagaaagaggtgccttctttttttttcttttttatttgagacagagtctccctctgtcacccaggctggagtgcagtggcaccattttggctcaccgcaacctctgcctcccaggatcaagtgattctcctgcctcagcctcctgagtagctgggattacaggtgccygccaccacacccagctaatttttctatttttattggagacggggtttcaccatgttagtcaggctagtctcgatctcctgacctcaggagatccgcctgcctcggcctcccaaagtgcagggattataggtgtgagcyaccatgcccggtcagaagtgcttcattttttgttagtctgttgatttggcctggcttatggactatgaatttctttattcttttgctaaatattctttctaagargaagagaagggacagggtacttgtgttgcttctggctatttaaagcagaggaataacatctgcatgctgccccttcatgcccaccctctgcccttgggctgcgtcaggatcctgtatgctcttgaggcttccactctctccagatcagtcttttctgggytaagagataggaatcgtcaccatgcaaggagctaaggtggatcttctgatcagtttattgtcaccagcatcctctgtgtcctagtatcctactccttcattggcctaaccaaaacccaacctggatggctctgacaaaccagcctttacagttgctacactcaagtaactcagacctgctggagaaaattttactctgcgaattgggcacaccacctatctgtggtttttaacctcagctagatcctcttgttcattgctatcagtcctttaatttgttcttggattttttttttgtttttgatacagggtctcactctgtcacctaggctggagtgcaggggtgtgatcatggctcactgcagcctcagcctcccatgctcaagcgatcctcccacctcagccttctgagtagctgggaatataggtgcatgtcaccacacctggctaatttttgtattttttgtaaagatgggctttcaatgtgttgcccaggctgatcttgaactcctggctcaagcaatcttcccacttcagcctttcaaagtgttgggataacaggcatgagccactgtgccaggtagtggattttttcagatttttctgtttaggtcctttttacagcctttgattgccactgtctaaggcagataatcatgtcccattcttccccaagaaaagaccatcatgcacaattgtttttttctactcscatcttccaattgtacccctgatcttctgtacttcctgtctctacctcctgtccttcccaagaatttgatttctctccatctctctccaacttatgttaatttccccaagattttacccttgctttttctattttgtcacctttcattcatgtcgcaaagcaacattggctgcagcctccttcccttttattgttcttgtcaaggtcaccaagcccttctgcatttccagttgaatccgaaagactatttctatttcaacaattcattcaggtaatacacaaatacattctcaacatgaaagaaacagctcaggactatagagaatacaaagtgaagttatccttcatccctctctgcctctctggatcagcagccacagctcttgtgttaaccttgaactgtgctgttcctccccaatacagagcataggcaggagaggagcactgccaagcaaagctccctcagatttcagcccttggagaatgccccttaattcccatccatgtgtatatccttttatcctgcatttcaygcagtttcctyaaaaccctgctgacatttgctgcagtttcttatatttgtttttgtcctttcttcaagttctgtttccctctaaaccagatcccatctgctgtcttccagaaattcttccatcatttaaaaaacactaataaaatgacattttcttttcagtaattctgatttttttcttctaattcttttgtatcattaaatagaattttaggggtgaggcagtrtaaacttgtgctcagatactatcttgatccacaaaaacagaatcatatgtgtatacatacacatatatgcacatactcatctastgttactctttaatgcaattgtttgattctgtggactgatttcttcacatctgtcttcttcctcagctccttcccactccctagatcttcttcctctgtggcttttgcagactccttttctcctcttccttaaatggtaatattctccagagacccattctctaccttctcattttttattcttgcttctgctgggtccttttcttttcgtgggttcagctattagaacactgacaaactgcttaataatccacatcccagcatgaagtgcttcccagggcttcaacccccggcatccaagtaccctgtggctgcttatagccagaagtcccccacayttctcaggtgaaaagctctactcattgtctacctgtttctcctgaaggctgtcttagcatctgccatcaacatctactcagcccattagactcacagaattcctctcctcctcctaagctccacatgcaagcagttgagtggttcttttgtttttacttgctcactgtttcctagatcagttttctcctcccagtcagccctcatcatctctctctggtgctaatgcaaacatttccctgtccacagggttgttgctctcattctctaccttgccactgaagtgagccatatgaaacaggtttaactaaattgctctcctgactgaaactcttgagtgtctctcttgccccataaagtacggatccttaaatgaaaggcataaagtccccataaatatggacctggtccatacctytatttcatctcttactgtatattgcctcatcttttattctccagctgcaataaatttcccatcattctcatgtcatttcactcccacactttcaktttttaatcttctgcttgaaaagccttctcatcctcttgcctagctgccttctacttttctactttcctatgattttggcatcacctcttccaggaagccttcacatttccccttccctctataaatgaggtacttgccctgctttgattcttccaaaacccctccatatctctatattttcacatattcgattataatcattagtttattcccctactaggtcacaaattttcagagtgcaaggaatggaaagcaaarcagaaaatgtacttcatcttgagtacaaactatgtaatagaaaatgcctatccaggtacacctgcatataaaaattaatttctggagtctgactctgcaagcactttgaaaaaaatttgtttccttgtgcccttggtttcaaaagttttagattgctttccccatatagtactttaaatgaaagcctaacctttatataagaataaactacttttgtttgtctacttaatatcactgtgttgtaattatgaaggcctagttagtaaggtctgcttaaaaaaagagctgttgagctgttgagctgttgatttattttgaatttctccccaatcaagttggtgagctttcgtttcagattttgagatttctttggaaagcgtgcaagaatcgttctcatctaagccgagttctgccgtattggaatacacatatcatctcagggcagtttttttgttcttyaaattggatgcttttggaaaatatatataagaargggtacagtatagcttctagaggcctcatgggtctcatcataacagctactcattagtggagtccccacattccacagtctaggcatcaacttgtaagtttagatatactatgttttccccttcatccagagatgattgcactctgggaagttggcttatatgactcaaattccaataagctcacttatttaaaatgaatgtaataggaacccattttcctggatccattcacctgcagggacacaccttcctgataagagaatcttctcagctggtcatattaaatggcaatgcaaagttagtaagggtccacagtggataagggactatacaagcatgtgggggacacagtgaggattcagtgaacataaagcatctagcaaaagagtttgacagatatattctcacgaacttttgttaaaaatatgaatcaaggacaggcacggtggctcacgcctgtaatcccagcactttgggaggccgaggcggatggatcacaaggtcaggagatcgagaccatcctggctaacacagtgaaacccagtctctactaaaaataaaaaaaaaagaaaattagtagggcgtggtggcaggcgcttgtagtcccagctactcaggaggctgaggcagaagaatggcgtgaacccgggaggcggagcttgcagtgagctgagattgcgccactgcactccagcctgtgcgacagagcaagactctgtctcaaaaaaaaaaaaaaaaaaaaawatawatatatatatatatatgaatcaaaatacaagcacacagcaaatgccttacaattgaatgaagaaactgctaattctgagaaagcagaatctgccattataawaaaaatgcagagaactctggcaaaaattggggatcagagatggttgtgtcaagagggagatgcttgagttgaaccttgaaggatgggcagaatttcaacagtagaaatggagaataggccagaactttcaaagaagatagaataatatggaagaaagatgttatgatatggctcgataagcaacagattgagatatatgaactaagatgttctttaaaggatatttttataactctataacattgatgaatcaccattttccactgtagggatatttgtgattagataagcaagatcagttttctaaaatcagaatgtcttctcccctggaaagaatgctgaagactttttagctgttgaactcatctttttcagtatctcttgtcaatcatcaaaattgtctgttataacatatattactattacagttccaaaattagcacctgctttctctagttgtgctgtgggtatttgttttggattacttttggagagccactttggagtcctggatgaacagggagctatgtttttaatcggaaacattttcaaaacctttcttctgaagagtcayttctaggaagatttctgtaggtgaacattttcatccattttatgatgatcctccttggctctcatttcataaggcagcatttttctgacctttcctcacactctagggccctgtttaagggtctataatagcttttgttttaaccaggaggagctgagaaacatgaagtatggtggcactttaaaaagtgatgtcttcaaagtcaattatctactgtcttttaaaattaattttaattattaataactgatttcatgagttagaaccattagctatggtgagatgtaaagatgaacaaaacctttttgctcaatttatattagcctgtgtcaataagaacctttagggtaacaatcatgaatgcttgccattctccactttttaaaaggtctttaaaaatgggaattgatttttctcctaccattccctattttatgtgggggtagattcatgattccttttcacatttgaaagtttttaaaatcccagatgaacaactataaaggtttacatgactgactacatttgtaggctatattcccataattaatacattgtgcaattaattcccactcgacatattattcaaggaaaccactcaggctatacatttaataaagaacttttggacatgacccagttgctacagaaatcaaaggtctgtctactcaggggtgttctttatttttctaatagrccaattaatccatctttctatgataagggtaattttgtattaaagttgtttcatttgagagaagatgttcaatcctgtctggaataaagagagttgatcctcatttattggctgtgcttcaagcactgtggttttaagtctactatttccaccttaggcacaggcttctgaattccccaaccacacacctgtggcttcttcactcaaaggaaacgaggttccttttgtgtttctcagctacactaactctccaacacatttcctataccagtcctcaacagttctactatggctccaaccattctgttcaggcatcaggattcctaatgtttatggagccattttgtgttagatgccagtgatggcaagacaccaaccttgcccttccattgtttgcatctgtttaaacagacatgcttcctagatacaatgcaagacagtatctgtctattggtttctctctgaaaaccatgcatcagtgttcctgacttacatgggagaamacaaatatgtgtacatatatttaaccataaataggaactcaattatattgggtgaaggaatgactgaataagtgagaagagaagggagggaaaaagaaacaaaagagggatagagaaatagaaggaagaaacatggtcccctaagaggcccttgtggtttttccctgatagcaaagtcatttttacactaggatgccagcctgtgttcgcctttttacactcgggaccttacttggcgaagtatagcaaatgagtttagatgatcatccccatagtagctttttcagtattttcagatttgatgtctgtttccatggaaatagttttggcaagaccgaagctaagaataagagacataccatgagaatttcacgttccaattgtcaggcaaaagctgaaagtcacacttttgtcttttcaataacttggtgctttaaactcagcaggagagagttttattaattccagcaagaaatattttcattatattaatgaggtttcatttctgactgtttacatttctcataaaagtgaaagcaattatgggaacagtgttaatagggaattttcctcaggggaatgaacttcttttagattctgrttatggccttcagaactcctcccctctagccctttcctcactgaactgccttagccagcacttgctcacctgcctatttttgcggacatttgaatgaaagacaagaatatgactgaactgtgaaagtgaaatgtttctgaacatccagagtaaccattctcagacaagtttgaaagtaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtaggggkagggggtaggggaatagcattaggggatacaccctaatgtaaatgacgagttaatgggtgcagcacaccaacatggcacatgtatacatatgtaactaaccggcacattgtgcacatataccctaaaacttaaagtataataataataataataataataataataataataataataaattttatattacagttgggaataatgttttggatatactgtgttaaataaaatgtattatcacaattaaaaaaagaaatttgaaatttaaagattcgctttgaacctatttgatcagaaagtattaaatatcactaccacatgagttaaaacaaaaaatggaataaaaaacaaaagtggtgtctatgtaatcagtgaattacttgataggacattttaactattttacagttcttcttagcaccagaataaactggttccaaggttaaaaaaaaaaaagaaagtaaaatagatgcaaaaataatcactcataactgaagatcatttcacytttgaatgagaatttgtctctgaaggctaacttttctaggcaaagtcaggaaacaatggcagtggccrggtgcggtggctcacgcccagctactgaggcagaagaatcacttgaaccgggaggcggaggtttcagtgagctgagatcacgccattgcactccagcctgggcaacaagagcaaaactccatctcaaaataataataataataattactgggaaatacatattctcagggcccattcccagagaatctgagtaggaactaatgggaagtccaaaaattgggacactctgagaagcactgcctacactatcartttaggattggagcagacttttaacatctactcatgaattatactgcatgtacacttttttaaatttcrgggcttttgtatatagagatgcaaggtattaaactaacagagacacaaggtattaaaccaatgttttcatgtgtcctttttgcacgtacacttgttaatgttagcacttccattagtagtatacagagtggtcaaataaacagacataacaaatcataactaattgtagtccaatttagacrtaacaaatctatataataaaatagtatataattgatacaactctagaataaagagaagctagcctgaaactccaaagttattttgcataataattactaattgagatgcaaagtattaaactaatgttttcatatatcctttttgcacatacgcttgttaatattarcacttccatttgtaatatacagagtggtcaaataaaccatgcaatacagcatgctagattttataacctctcaaggacaggggctatgtcttatttgtctttgagttcctcaccactagcaaaacaggtgcttaataagtgctagaactggccattgataaccaattctgatttccttaagctggtgcatatcactttgattcttataattttctctcacattatctttgatttaaagtctacatttaagtgtagttttcattccaaattggtcagagtaaaaaagtaccttctcatatttgaaagaacaccatggtattgtaaagatatcactgtccattaataagatatttgtcggaatttaaagaggaaaaataaaagatacgactaaagtaatttccctggcactcttctgaaatagttcagaaaatcatgtcttatgcaggatatgtctagaattaaattacattttgataattctttccagctctataattccatttyctactgttgggtttcaacacctaaaaktgtcagcaagcctctgaacaaagatgcttttgttctgttggcagagattctacttctaagtttccacatgacccgcagagccatactcakccagttaggtgtcaaaaatgcagggaaagatactgaaacctcttactggcctgaccaatgcatgcagcgttatctgcaactcatgtctctgtgtgcctacctggagagtttactaacactttgtaattatttgaaattgggttggttcttggtgtaataaactaagtcatagaycctattgaaagagtaatgctaaataatgtattttctgaattgcttgtttattttctttttccactatggatgagtatagggtagaaaactgattagttagcagcctgatcagtggttcagcagcctgtaatagtttggcaataaaattagaccaaaagagaactgatggaccaaaagaggttgtttttcaatccagcctcttgcttcaagtagaattgaataatcataaaaggaggcaatattttcattactgatttcactttttcaggtcaaaactgacccactgaatttatggatttggaatagctttttcacaaggatggaataagaaatctgaatcaggttgcactgataagttgaagtaattctcacaatgtcaaagagataatgggttcagttaattcagtacaagtaaacagcaataagctagcatccttttgaagttatgtcttccagcaccaagctcatgcaggcacgtgtctatattacatggtaatgtggagtttgaggatagatgagaagttgctctggcataatggaatgagcagagtattaagacaggcaagcttggctactgtctggcttttgtcagcacatgggctgtatacctcagttttttcctttgttaaaagaacttggactactgaattcctaagctaatttcaaactatataatcttagttatatatatattgaatcttgaaatattggagttaaataagaatatttagtgagatcccaagcaaaactcattgtggaatttctttagcttttaacttcttcaaatccctggcttagctctaatgtcactaatcatagcccaatttagacataacaaatctgcatagtaaaacagtatatgatggatacaactctagagtaaagagaagctagcctgaatctccaaagttattttgcacaatagataattactaatagagatgcaaggtattaaaccaatgttttcatgtatccttttttctaaaaacctgaattaacaataaagcaacagtagtagaaatgttttaatcctagcacaactgttttcatattttgtctgccacatacaatgtatcttagcaaagttgcaataatgtaatatactgttttatattctgatcctttcacataacattgtattgtcaatttgtttttctacatgggctttataatgactttaatacctgcaagttattctctcatattggtataccacaatctgttaactattcttccaattctgtttctagtcttgaccattacaaataaagtagcatgttcaagacagtagtttagcatttgatctgatttattttattctatccctacagtagtctatatctgtccttttagtttcaattgcctgtaattatctcaggtatgtttacttagaccccaataatttcttcactttcttgttttaaaaaatccattatatatatttgaccagtttagaattcatatttttaaaagtcacaaaggcatgtactttatgcagtaaaatatataatagagaatttgccattttaaccatttctaagtgtaatgatttagtggcataaattacattcacaatcttgtgctaccatcaccactatctatttccaaattttttcgccttcacaaacaaattctgtaaccattaagcartaactccccactccttccaacccaactccctggtaacctctaatctgctgtctcytaattcatctgttccagatattttatacaagtgcaattatacaacatttattctctttctgtctggcttatttcacttagcatactgttttcagggtctgtagtatagyacatatcagaacttcattttytatggctgaataatatttcattatatatatatgtacctcattttattcattcatctgttgatggatatgtggatttctgcttttgactattctgaataatgttacaattcagagcattggcatattaataacctgtttttaattctttggggaatatacctaggagtggaattactgggtcatatgatagttctatctttaactttttgatgaactatcaaactgtcttctacagcatctgtgtgattttacacttccgccatcaacgtacaagggttctgatttctccaagtcctcaacaatattttccttgtgtttgttatagccatcatagtatgtgagaagtggttatctcattgtgattctkatttgcatttccctaatgactactgacgttgatcatttcatatgtttattggtcatttgtaatgtcttctttgaagaaatccctattcaaattctttgcccaatttttaattgggctgttttatctgtttgttgagttttagaaattctttatgttctggacattaaacccttatcaaatataggacttgcaaatattttttctcattctgtaggttgtcttttcactgtcttggtaacatactttgatgcacaaaggtttttaataatgacgaagtccggtttatctatttttctgtttttgtttgtgcttttggtgacgtatctacttcaatcactttgtatttctctaatataatttccctttttagtctcttcagattctgtaaagctactttatcaccataagtccagtcactgtttgcttgcttattatttaataatatatctgggaattttaaaagattttcatgaagttttatttttctaacacttcttaataagaatattttaatacatattgaatttgtgtgccaatagtggcagtaaataacttttttgttccacatttagaaataacattatataagcagctggtgaatatagaatatagtttatagagcacatttagatgcttcaaggatgaaaaactgccctagacttcctttgggaattgcccaaggacaaataatggaaatgctgcatacaggataaaatagaaactcagttgaacatagggaatttcatatatacccccgtgagtaggttctttcaaakaactatatttaatagtaaaaatgatatatctgtaagagtgctaattccctaattttgaagaaaaaaaatttagcaatgatattttggggaaatattagacacaagtaatacacagttccttgagttggagttttcttttggtcgtatgaatgaccccctcaaatctatgaacttctgaatagttttacttgttcttggcaattgcctttatcctcaacaaccttgtgcaaatgttaaatctcaataccaagctgtcagagcttagctttccacttcatcttaagactgcatttccagccatatagctgccttcagtaattccattcagcttgactctctgacccagctctggcagctttgcacatccagggatgctgagctttcagattatttaaatgttatgtgcttcctgaagtctgacctttctagggaaaaggtattcctatcgcttcagaaagatggaaagaaaaatgtttaaaaatagagaacttccattagtggtcaattaaattcacaatattatctagatttccagttgcctaaggaaaccagctacttaactgtctctttgcagtggtgctgggacaattgatgaaccattctattttccactttacaatgtgggtactttgtgcttcactcaggacaaaaagttcacttagttctctttaaaaaaatctctatctcaaatcatagatgtcaagacttaaaggcaggttttggattttattctagttgcaggctaacacattatcttgctgcaagacatgagactcttggatcagagattcactacaatagccagagtatcgccactttcttgcagtagttgcacaagtcccagttttcacagggtgatgtaaagagggccatatggcaactacagacacagtggattgtatacaggaaagaaaaccgagcttaacaaacccaaatcttcataatgagcaggaaacaaacctgacctttgctccagatggagacactatctccatcttgaaagattattcactattcraaaatccttcaagagatgttctggaraaattagcaactcagattcccatgcagaattggctaacagttttatatattacatacacatatgyaccaagstatctcataatattgctacaaattcatagtaaacagtggaacaagacagattcaaattgaaaatgatccctttcctgagatgcttttaacttgtcaagktatttggataaccttcattttccatgatgaaggaaatcagtcagcgtcagcctttaaatgtaagtaagtatttggcacctagcacatagtaggcattttaagggtaacttatctctaggtgagggtcatcaaccagtttttattttcaggtttctctgtcttatgtctggacttaaacttggacggttcttcacagataggtacttgccttatttcctcaagcttttgcccaaatgtctatttctcagtgaggcttatcctgattcccccacaaaaaccatgttgtctcccatctattccccatccagtttaccaagctttatctatctccctcacttatcactttttgagacagagtttcactcttgtcacccaggctggagtgcagtggcgcaatctcgactcactgcaacctctgcctcccaggtcaagcgattctcctgcctcagctgcccaagtaactgggattacaggcgcccaccaccacacccagctaatctttgtatttttagtagagaatatgtttcaccaggttggccaggctggtctcgaactcctgacctcaggtgatccacccaccttggcctcccaaagttctgggattactggcatgagccaccgtacctggcctacttattaccttctgatgtgttatgtaaagcatttattatgtttattttcmgttcctcttgctgaaaatgtaaattccrtgagggtagaagtttttagtctagttcactgatgactccccagttcctaacacagtacctaactcaatatttgttaaatgaatgggaatgagaaaagtaagtttcaaagagactaagtacctagtcagaatttcataattaacaaggcaagtctgggactcaaagccaggtcttgtgacttcaagtgcattactgtttacactgtgcaccatttacattcctcagctgctctctcccctraggcctgagttgattgcacagcccctcaggcagtacaggatagctctgcagagtggctgacagaccctaggacaggaagcaggcagagaagggaggaaccacgaggccaggctgaggctgaagggcgagtcagctttctcsgtaagcctatcaggaagctgattgcttaatctaactgagtctgtgtgggcctgcctcctgggctaatagcacagatgcattgctccgaaccctataaacaggaattgtcagaagtctaatctctccaagtcaggactgctgatagtaatagacattttaatagggaattttaatctacaaaacaatttatgaaactcacgaattaatcctcttatgattcccaggatgtgagcaagataaagatagtagaacttgaaaataatgaaatatgtgaaaaatacagcaagaagtctcatgagatggctggagagaacccagaaaagcttacctcgtctcaagcacccaaatsttcccatcactgccaacaacatctaggaccacttcaactctagtatctgtacatcttccaatcagtgataaatgctgatcagtatcctacacargagatttctctccaaatagcgcaagccttgtaatatttaagtaaatgaccccaaaaatcatcttcccttgaatcatatagttctgtgttgtccaatagaktagccactagtcatatatattgccatttcatttttattttatcaacttaaatttaacattcaactgctctgtcacaccagccrcattttcagtggtcagtacacacatggctggtggctagtacattgggcagtagatatggaacccttccgtcacagaacgttccaatggacattgctgctccaagtacagtccaggtgacccaggactggtttaggtcagcatcttcacctagtagagccagaattgttttgtattgcaggctgttgctaggactgaaggctgaaatctcttatattacttcttttctgttgatgaactttgagtcattgcttcattttgtcctgcctttctaggcatgtaatattttattttttgtcatgtactcactgaccttaaatccctaacagctcagcctctttcctccctatcacttgcagtctttctcagctagctgacacatgacttttaagacaatctacttgctgttatcacattatttgagataycataaaattaatcctctaatttaaattaaagctgcagaccattatcagtgataataccaggaagtgagtgaggaagggtggcaaaacatgttctagggtgattcaccaagatccggaggaaggagaatcagtgttgacatgaatggttaacccataggcagtaaagctaatgttaacatctgctcgggttttagggacatagtttaagagcacgtgaaatatatctaaaatcaatatgaggttaggttgggtaaatttaaagacaaaatcatcttccarcctaaaaaaaacctctttacaaatatagtagagaaagaaagcagctttattattgaataaacgctaaactagaatatgatacacatagagggaatccactgagggattgcaaagacraatctcactcttttatacagccaaacagatgcatcctattacataggcattctctagataaactagctagtcctcacataaggacttgacagcaccatgtgcctcacatagttcatcctaaatatacctggtaattggggtgaacatctgtgttagctaattagtgtcttataaagggaaaaacaaacttctcatatcttaatgacaagaagtagttttgcaagttggaggargaggatcctcggaagtttaggctcctaccttcttaccgaagccgcaagatagaagtgttgtctcctttaygtcagagagatggctccttggtcctagaaaatgacactcctggcttgtaagacctgcgagggccttttaaaatatttttcatctcaaagagccraagaaagaatttataattacaaggrttttatgaacttttaagttcaggggtacctgtgcaggtttgtcaygtaggtaaacttgtgtcatggcacaagtttgttgtacagattatttcatcacccaggtattaagcatagtacccattatttatttttcctgatcgtctaacttcctcccaggccccaccctccaacaggccctagttgtgtgttgttcccctatgtgtccatgtgttctcatcatttagctcccacttatatgtgagaacatgtgtatagtttagttttgctaaggataatggcctccaggctccatccatgtccctgcaaaggacatgatctcatttttatgactgcatagtattctatggtatatatgtaccacattttctttatccagtctatcagtgatggatatttatgttgwttccatgtctytgctattgtgaatastgctgcaatgaatatatgtgtgcatgtgtctttataacagaataatttatattcctttgggtatatattcagtaatgggattgctgggtcaaatgatatttctgcctctagatctttgaggaaccaccacactgtcttccacaatggttgaactaatttacactcccaccgacagtatataagtgttcctttttctccacaaccttgccagcgtgttatttacttcctaataatcaccattctgactggcatgagatggtatctcattgtggttttgattttcaaatgatcagtgatgttgagcttttttcatatgactgtctttttyyttttttttttcttttttttttttttttcattttgagggagtctcactctggtgcccaggctggagtgcagtggcagcttacttcatagctcacggcagccttgaactcctgggctcaagcaatcctcctgcctcagccccytaagtagctgggactacaggcacactccaccacgctcagctaatttttgtactttttgtagagatgaggcgctgctatgttgcccagagtggtcttgaactcctggrctcaagcaatccttccacctcagccttccaaagtgctgaaatttataggtatgagccaccacaccgggccaattacaagttgacaaaggaaaatgctctaagaaaagataacttttgttcttattccctttttattttttaagcatcagagctatcaaactgcattctcttatttttaaaagtgagagttaagccttttatttttcatgtataattgcccttatagtmttcataagaaattaagagttttgtataaccatttatactttcaccttatttgactaattttgactaattgttgagaaaataagtctgaattaaagagtcamaattgcagtttatttcagagaaatttttattctccratgcacatggtaactagtgttataccagaaagaatggtaactagtgttataccagaaagaatatcagcgagtggagctccttgrggtatcttgaggattaaattgaaatgttttacaattagtgatttaagtcatttacacagaaatgactgtcaagtgcctgaagagtctaagcattttaattatccccctataattttatacctttgtagaacaaataccattttataggtagtgcaaatatagtatctttctacatgttctgacaatagtggcattcaaataaggttttattatatgaaccagacatattacaagctatctattaccaactagagggcacttctagagttacctgacccaacataagttataagttgtctcaaatagttcacttagcggaagccactaacaaatgtgatctcccgagtggccagccagttttggttttcctgtttctcttttctatttctggagtttcttatgcggggcaaggggctctatgttccccaaagtcaccttttatctatcccaaaatggattatacaatacatttccccctggctaactttttctgtttttgttttattaaccttgatagcaaaatataacagattccctaatacattcatttccatagaacaggcccatatgttacacagttcttacctttgcactcctggattgtgatacctaccacacagtaggcccttagttatggatgtgatgcatataaaaacattttaaaaggaattacttgctttgagcctatctcctctaatgtacaatatacttaagctgattggttcaaaaccacatatgcatttcctatatgctgtgtactgactgttaggcttaagtacacttacagaagttacagtaacttaattataatagatctggcaaggaacttactcatatctcgttctctgttttacaaacttggacagtggttattgaggtccacagctaatttgttatgtaagaaattaacaggatcctggaccactgacccagaaagtaaaggacaggcaataatagcaagacagaatctatttctatcttatagacaaacaaggaggttatctccatgtgcatccaatattcctcattatctagggttcttttgccatatagagaggcatgaggaaaccaaaactgacttcagtttgggagtttttaatccatgaagttttggcaataaatactagttaagccacagaagggccctcctcttggaaattgtaagataggtaaaaatgatctcttccaactcttaggagtgcctttttccctctcccaaacactaattgctctgaaataatccactcctcaaaacttttgtcctgacagaatctctatttaggcaaaggtattagttgataagcctaacaggttctcagttattgcctcttcggaagtgtttgcattttaaacagaagccagtaagttcaaaatgcttgatagatccaaacagacaaatctttgatgggaaaaccaggaaggtgagggagacaatctaagaacaggcctttccaatgtctcccaaactgtatcccagaagcaactttactcctttgcccacagctggttccactcaaacgaaattgggttggtgtttcttgtagctgggtcatgtctgaaggtaatggaaattaataatggctctgaggataagggaagtaaaatgtttacaatctaaaattatgtgagaagaaagctgctaaccaatgaatttttaggaaaaaaaaagtaaatcacttcttttgcacgtcagcccaagtttacaaatatcaggaatgctaacacaatagaattgtcttatttcttctccttttcttgcctctgagcttttctcctcattcccctctgaatctagctgctttccgtttatgayttcagttcaatttcctaccagctattatgagataactaggaccttttaaagaataaatttgtattttcccacttagtcagctttccattcctgcctacaacaaaaacatctggtgagtctaattttaagtaatcaaccttttcagtttggtgattaagagatatatatstgaatttscatttcatttgtggaaattctgcctgggagccattcatttttcatcaagctccctgtgcttttcattactccctccctctcattttccctgtggtcagcctgcctgagtaagcagctctgtttcactggtctcaagcyctgcaatgtaaaaccattagcaaatcttaataatagtaacccatcaaatttcattatttcagtaatggaatctgtcaaggtcagccactgatggctgttaatggccactttgttgataaatcgggggtaactgcaataatattcattttaagcaaataaaatatgttctgattamgaattcattctgcccagttggagtccaattaagccagcttctggatggagtctcacccargatctctccacttaaggaatatattcgcagttgaagtttgacttttttcaataaagctcttctctctccttgaaagagatgaaactttgtcttcaatccaaaagaacataaaggtgattgttctgcaatcctcccttgccacagacctccctaactcctaaccctgacacaaacacgttcacacagacctgcccatctgtttaccctatctgaggctatggttttgctttaatatgaatttaacttgttcatcattagcaatagggatcttttcctatgttactctatgtcattattatggaagtttctatgtattatatagcaacagaaagtagattctgggtttggattagaagtctaggcaggtatgaccttcaaaacattyaccaacctgtrcagcacagayaccaaccaacacacacagtcctcagcaccagaactagggcacactgggccaggtattaggccttaagttgtgggttgaggagaattctgagaattcctcgaaaarggcaaatagaagaatgagtaagggctgggggacttccagggctctgagcagaggttattaagtacagaaggactttgaattttaacaaccgacatggccataaaaatgatactggctaaaaagagccttgagaacaggaatcgtgactgttctttagccgtgaacttaattagtatttataggatggtgatgataggccagggcataaagctgccactggctatactcaggtaaaagaagcaggcacaatctttaccttgtatcagtccactcttgcattgccgtaaagaaatacctgaggctgggtaatttataaagaaaagcggtttaatcggctcacggttctgcaggctgtacaggaagcatggtggcttctgsggaggcctcgggaaactttcaatcatggcagaaggggaagcaggcacaaattacatggcccagagcaggaggaaggtgagggaggtgctacacacttgcaaacaaccagatctcctgagaactctctcatgaaacagcactagggggatggtggtaaaccatcagaaaccacccccatgatccagtcacctcccaccagccccacctccacattggagattataatttcacaggagatttgagcagggacacagatccaaaccctatcaaccctgaaggaccttataatcatagtgggaagagagtaatatgtaaataaaaatatacttttaagctgatgaaatggyatggatgacaggacgtagagccatgatagtaataacaggacctgtttggagaaggtgttcagaaaatgcttttctgaccattttcatctcagctgaaacttgaagaatgagaggaatcagccatgtgatagcatcttgaagscttgggcaaattataggtacttctcttcaacacaagattttagatatctgattatttgggaaagagagatccctgcaaataccaagttatattttggccatttttaacatgttgagtatctgtttctttcaaaagataaagtagttttgcaaacagaactgatttccaagccttaatattgacaaaaakggcaaagtgatgccaaattcttcactgcagatgaaagtaattaaaattgctgttccttgcagggatcaagaattcgaacgtcttagtgactcatgatttttcagtcaattgtgagatcagggtttatggcgcatctgccctgcttttctcagacctgtaccttgccattccacctctgagatgggtagtgcccatctcaccaaatggtccaccatcagccaagccagaactctgaatmtcattcttgccatcttcctcacctcccacatttagtccatggctatagctgtcatttctgccacctcggtatccctaaaattcattccttcttcctcaccctctctgttcagccttagtttaggacttgatcttttgacaggcataaaactagattattttaactggtctgatttatttccatttccagttcacactcatgccagtgccagtctaattcctaaaacccaaatatgatcaggtttctcgcctgtctaaaatattatattagctctatctcattccttaggcataaaacatgacaggcaaaacccatcamgaattattccctgccttccatccacagccctctgtactacctgcaattcctcatggcatgtaagtctcatcatcattccccagcttccaagcatttcctgccacaccccctcccactactcttcatccttcaaggcagctcagtactccttcctggaatcccttgccctgagagctgcctgagwgaggggtcgtcagattcaggtacctgttttccaagcagctctgcttggctatactttatgtatatccaaatcagtatgtctaaaactgaatcgtccccttcccaccaaagctttcttctctccaagttctcaagctccacagagaggtaccactctacaaagctaaactcttaaccttcattttcttacttgcacctccacccaatcactaaatcctgctgatgctccctgccactgtcttaggagtcccccacttttgtccccagtggcamtgtttctcatttcccaccttgcttactgcagcagcctctttactggtctagtttccctctaatccacccaccaaacagccaggctgtcatctgaatatttccattctctgcttaaagtcatttagtagcttcttattgccctcagggtagaggtgaatcttctccatatggcttgcaaggcccttcgagatgtggcttctccccacctccccaggttcctctctctggaggatccttacctcatatcaaattactttcagctcttatatgctgtgctttcttgcctccagggcatttatttcatttgtctgaataagcccttcttgtttttgaggcctcactatcactttctacagaaagcctttttgatcagttctcaaattcaagtcaaatgcccctccctacttactatggtctgaatgcatctccccaaaattcacaggtagaaatgtaatcatcaatgtgattatgtatttggaggtgagtcctttgagaggtggttaaatcatgaaggcagagctctcaggaatgagattagagcccttatcaaaggggccctagagagctgccttggcccttccatcctgtgaggatgcagtgagcaggtgccatttatgaaatgggcaaaccgaccctcattagacactgaatctgctggtgctttcatcttggacattccagcyttgagatctgtgggcaatgattttttttttttttttttaagatggagtcttgctctgtcaccaggctggagtgcagtggtatgatctcagctcactgaaacctccgcytctcaggttcaagtgattcttctgcctagcctcctgagtagctgggactgcaggggagcacaatcacccccagctaatttttgtgtttttagtagagacaggatttcaccaagttggccaggatggtctctatctcttgacctcatgatccacccacctcagcctcccaaagtgctgagattacagtcgtgagccaccgcgcccagccagcaatgaatttctattgtttacaagccacctaggctgtggcagttsgttctagcagcctgaatggatgaagatgctagggctccccccagcaccttgcactgccctcatcctcacatggaattatagatgcctcctactcaactgagctgcacaacagggactgttatcgtgcccctgctatcatgtggctgttttggacaagtttgtttagcattctgcctggcacttagtagatattcactaagtatttgccagatgaatggatttgttgtgtaattagataacgataaccctcttaacctaatctgcaaatccttcattaaggactttcatcccaggatagaagtacatacataagagtcatcgtactacatgatacaaatggcccattcagcctagtgtttttttgtattttttttttttaactaagagagttaaagcctactggggaaggatttgctgactttcactgtcatcgtctttaaggtatacccaagacttacatccatttagaagacctgcatcccaagtgtagggatagccaagcctcacattcatttaaaaggctcttcttcaaaaccctgctgcattttctacctcttgaatttcataaacttgcagtgtatgaagaaacactttacatttttctccccacttgctttgttcagaaaaayaaaagtaattaggtttattgaagtgtcattaaaaagataaaacattgtacctaggtatttgcatttatttcaaatcttttctaagtggcatattagtttgattataaatctaygagggattgttttgctttgtattgtaatgaatttttagaaatttaaattgygtactcttacaaaagataggagagcatattgtcagcaasgaagatgtacttsaatcttctccacccactgtccagagcactcttcgttttctaagatcaacatataaccagggatgaagcagggtaagggattgctttattctacctgttctgtcccaaacccacactaggtctctaatcttactattttggaatgtcaaagaacacagcagtcaggaagaaggtgtaagtacaagacaatagtagccagaggagaaagaccatttgctccaacgcccagagctgtttcagacctttggcacccttacttttgcggaccccacccacatcatatgttatacacaatacaccacattaaacataactttatatgccctactatcagctgatctggctagtggacatgttatattttagatatttaagttaaatattaattttgagattgaatttttgggggagcagtacttacttttctcggtcctaaaatttttgtagcaaggtcctcacctgccctgctggccatcccaccttaggccttttttagggagggaaagcttttgggttctgtctccagtttacatgttccctggccacacagaatgaagaatgtcccggaagcataagggaaagccaatgagaaaagcagcctgtgtacccccccagttgagagcaccttccccatccacccacactgaactgggaaagtggaaattgagacagctacccagtgagattgatttatgtctcacacaaagctccacccaccagaaaatatatttgactacatcctgtgaaactgccccttctgaaggtcatagtggttacatatcagccttttcacatgtttcaaccgaaaaactgaaggrgttcccttgagtttgagcaatctatagtatcacttctcctggaaggcagagtgagagaaaagggggtgtactggtttcctagggctactgtaacaaagaacctcaaacttattggcttaaactgacagatttcttgtgtcacagttccggaggtcagaattctgggaatcaaggtattggcaggattggttccttctgacctgtgaaggagaggctgytccatggcctcttcttagctctggggggacattagtcaatttggtgttccctgacttatagttccgtctcccaatctctgccttcatcttcacataatgttatctcagcgtacacatgtccacgtccaaattttttctctttttataagttcagtcgtagtggattagggcccaccctaatgaccttacttaaccttaacttgatcatctacaaaagaatctatttccaaataagatcacattcacagctactggggatcatttgaggggacacagttccaccataacagggtgggtagggatctgtgatttcctggccaaaggcattattctgttgctgtttggaatgctatcaaaatattaattatggtatcacatctctgtgcctaggagtctctgctgacttctgttattggtcgtgtaagatcttacaaccccagggcaactttcagcctcaaaagaactgatgtcagagccagggctggggataatgatattttgttctgatataggctcaaagtcactatttgaagtcctggctataaaaattagttccagcagctttcacctaaagctggcccaagtctgaaatgaaccaaattgcatgagctctattrtgtgcccctcttgtaatataaaaatctaataaaagtaaatagcaaagtctaatagataatcctaacagaggagcaagcactaaggtgtggtagctgaggaacacctaagcttgtgctatttgtaatgctgcttattagakacatcgctgatcctcctgtcaactccagttaatgtttctgtcccattcaagttgaaaatgttcaaattcagctaatgtctatggcatctcctgaaagcccatcactgctgggcacttttccattttattgcatttaatcgtcacaactcagagaggaaacttgttttgttagctaagaatcaaatcctagacttgacactaagtccactgtgctggtcccccygctatttgataatattccaaagcaaaatacccatgctaccgatgactrggaccccccagctcagtcrcttgggctagtttttcctgtagtctttcaggattggaagtagagtggagttgtcaggtcctgttacaaaagtagactaactggaactgtagacttttttctttaaacctaacagaaggaaaagattggtgaatcaaaaactagcataaaaactgcaaaaaacctctgggaaaatagacggtcatgaagtccatatatgggaaagaaatgtagcccagaaatttctaggcatatgaaaagcacaactgtaaaactaagatgttttagatggaggagagctgagagtgacagctgagagtcgtagatgctgccttggaagagtgtccacgctaccctggacaggggcctgcctgcccacccagtgaccatggcagggcagagaaaaagcaaygtcagcccagtatcttctccagccagtggggtggcttcaggagagggctgggactggggatctcaaccttagcagcacattagaatcatctggggaggtttaaaacagcctgatrcacttggcctcacctggaatgcacaaaatcagaatctctatggattcaaytcactatcagtatttaaggctgccaggtgattccagtgtgctgccaacaaccactgagagcacacagcaagggaagagagcaacctgctggcttctgagctctttctcctcccmgcccaagggttaggggattgggagtcagagaagtggcccaggcagatgagtatggaggtgtccagcaagatgtggacagatggaggatctgggagcccacatttcaatgctagaggccatctgccctaaggtccaccttccccttcttcctaatcaagatcaccaggwggcgcacaggctgtaaccccttctcctggtgtacgatattaatcacggcatcttatatcccctgaaggggatataaagtcacaagaaaaaatttctaggcatatgagaagcacaaactctataagatactgacaacaagcagaccaacttttacctaacaattcagaataatgcactatattaaggagaaaaagaaaaatcagataagaattaccaggaactttataggaaaaaaaaaaraccctagaactattataggacagacaagacctaagtagataaaaatataacatgttcaarttattgagataacttacctttgttaactgtagaactaaggtgttcrttttccaccagattatctacagtttcaacagttttaatccaaaagttaaaattttttgaggagcatgactaagtgattttaaaatgtttatgggaaaacaaaagttcattacacccatagcttgtatgtggacaggccaaggaaagaaatcagggcttctgtctcccagtctggtgctaatttcaccccacctgtctacagccgtgaactgcattttaacagcacataaagaaatatactgcatgcaatgccgctcctcatatcatagaacaattaycttaatcataggaaagcttagaagttaacacatcagtctgaatggcatcatagctcatcgtttgtccctttgacaaagaacttttgtagcgaatgccactccaaacacacaggggctaaggcaaggctgttaccgcagtgggaagagggtagcactctgtgtaagcagacgtggccagcccagccgagagagcccccctttgctgactacctccaagaacgtggacacctacagtgccgcccaagcgccagagcgagtcccggcaatgtgtgccagctccttagtgctgctgtagcaatgactacaaactgaaatgacacctctgctgttggcttaaaacaacacaaatttattacttacagttttggaagtgaaaagtccaaagttggtctcaccaggccaaaaccaaggtgtcagtagggctgcgttctttctggaggcactagggaaaaaataygtcactggcccctccagcttctagaaaccacctacactccttggcccacggtccttttcctgttatcttccaaggtagccagtacagattgaatcctgctcttattgaatcactttgacccaacacaccttcctccctcttccacttttaaggaaatctgtgattacattgggcccacctggataatccagggcactctaattatttccagctcagctgattgacatctttaattcccatctgcaactttagtttatccttgccatataacacaacatattcacagcatccaggagttaggcgtaggcatctttggggaccattattctgctgattacaaaatgcatcagattcaaacatttagcaggctagagctaacaccttccttattactatcacaaaatgtagaaaagcggtgaatatatcatcgggaagtttgcagcttatttggctggatccacaactgcctttcatgcccagaatgttgctaaaaggagagtctctctcccagttactctacatccatcctgcccttgtaaagccacctggaaaactgaagcaatttttcagaaatccctgtttccattatataaatattccgtgcgaaagtgttcttttggtctgacttattctaataaatgctcccatttaacatgcatatgtgtaatccagcaaattaacttctccacaggatattaaagttagtgtgttttgtgctgtatgtatctgtgcatgtactatgtttgaaccagaatatacaatgtatcaaggagctcattctttatctttttcctgcattttcttataaactatttggctgattagatttttactgtgacttttgtttcttatgtcttttaaaattagaaattactgccatattctctagaaaagtactatccagaagaaatagaactatgaagatatgaaaytggttttactaggaaacacacatatacacagacacatacacacaagacatagtgtttgtacacccaggctcagtgattcagaatcttttttgtgttgcagagtattgggataattacctctttcctgaaaaatgtacgtagtcacatgaacatgaacttttgcactccttttcaaagggtttctgccccatcctcacccccaccccagaaatcatctataggttaatttggaggaaaaacattcaacatcagcacaggtacgggacaccaattagctgggaaccatggaaagaaaataagcattgtaagaaatagcagagaaaattgtaatttcaaaaaatgttgatcttggcattgtgcattaaagacttgcagtaaaacataactgstccttagcattaagttcttaaaagatggtttctatagccagtcttccyatagatagcatgtaaatggctctaaatgagaaacgtatagcccctgcaacacaagcacagataaaaggaggcctgtccccacaraaagatttcataggtaggacactgcatgaattccaggctccggatctaagagccagccttgagcagcaatgaagcagcaactcttcaagcagcaacttttctgaagtgaggaagtttgatccccaagcctgcatacctgatggcgaaagtgtgctgaggctacagagcatagaaaaatacagactacagagccaggctgtggctcaaaattctagtttcagcacttactgtgtgacatttggcaacttgcctaacttctctgtgcttccactttctcatcagcaaacagtgataataatagcacaaactcatagggtgactgtgaggagtaagtgagctcatctgtataaagcacttargatagtgcctggagcacagtaagcaccatgtaagtatttgattgtgttattttttatcattattattyactaccaccaccatgacatagtcctccctgatgcactgttagcatgtaaagatggatgattattattaactaggatattagagaaagggctstgtctagggaaagtcctcaaattaactagctttaccttcaacttctataaagccctactttgtcagaattgttagcccccaaatgatctatatttgggcaatttcttgcccttgccaagataactaaggtaataaggaagtctactaggtagtcataattgttctctcytcttctttttatgttgtatgtgttcccaaaggcctctgcatttgcttcttcatttattccagaaatctttatttcatgcttaatatttaaatactatgtgccatgcactgtcttaggaaaagtatctgcttttatggagctcacattcacgtaaacagagagatgacaagcaaataaatagaccaaacaagataatctcatacagtggcaactgctaaaggaaaaaaacaaatcagagaaatccgctacagagtgactcaggcagggtgaggaaggctgactggggagagggcatttacatggacaccaaataagaagaagccagccatggtaatatcagtagagagtggygtgttcctggcagtgggaacagcaagtcccaaggccctgatgaagtaaccagcttacggggttgaaggagcagaaagcagccagtccagctcaagtgtagtaagaaaggaagggagtgagaagagagggggaaggagaggtcagcagagccacatctctgagggcctgcagccaaagtaargagtttggatggtattctcagtgcagwgcggggtctctgagggtcttaggctcagaggtacacaggtaaggatgggagccccttgagggcagtggggaaggtcttgtggtaattcaggcaggagtcctagtggcttagagtacagagatggcagtggagaaagagaagtaggcagattaggtcaaaaagtatattttgcaggtaaaattaggatagattattaggtagacttattagaatgctggtgagtcttttgcaaaggcaggataatggaaagagactcctaagtttttaagctgtrtatctggatagatggtaggaccatttactgggataaggaaaggtggggggtgagcgagtgcaacccagagtcctagtgtgacggtgtaaggttagggatgcccatcggagacatccaaattgagaggccaaggaggcagctaaatgtctcagttgttcattacttattatgacaatgcttagcccttggggtggaggttttgttrttttcagtttcctatctcctgtttctattcctgcttcccacgtataagtaatatcagatagcagtaatttccatatgcatctcaaagttctttacgagtaaacactcttaatccttaaaacccaaaaagtatgaactacaaaatgaaacaatgaaaaagctaactaaactcttctgatgtcatgaaaagaacactagattagggttcataaggtccagattctaacaaaaaatggaagtacagaagaaaacaaatcagatgtagatttgagtcttagcttgtgcatttattaagtataaggcctagaccaagttatagagtatattttcttcatctgtaaaatgggaataataattccttccttgtgagttcctcgtgaggatgaaatgtgctgacatctgtgaagacctacatagtgtctgttgcattgtggacacctgtaaatgtggggttttcccccactttttacctattaaacttacacagagagcttaacagttctaccttgactcattaactgtgaaagaaagctgcttccttagataatcgctaagctctatttcatctcttcaagaaaaatctgtacaagatcttgaaaacaaccagataaacttcttgattaaagctgcttttaacctgaactcagtgcatctttctgcaaactaaaggcatacttaagactggggaagacagggccttcacaagcagaaattaaaccatagaaatgactctacaatgttgcaaaacgaacaaaaaattctccctccaaatcactaatgtttcagggtatgtacaactttttaggagatggagtaaatgaaatctcagagagtagaggctttcatatcactcactgaaagacagtaaaaccaaaaggtcttcatcttgggctttcctgagctggatgggaagtttggaggtctcagccaaccagactgttgagtgataaaaagtgaaactgtgaagaagcttctagaatcctagaagctctaggaaacagtgggtaagacaagagggagatacagaagtttagcttgggttacaagaagaagttgctagttagggactttctgtgccccaaatagtgcccaggggcactaatctatctgcatgataacaatttttatccgaatcccagaggcgtgcatctgaaacccaaactaagaaagatcctgcctaatcttaggatttaggacccaaaacaaaaagttgtttgggcctcgtggtacaaatagtgtcagctgatcagracgagaacagtgaccacaagagcaaggccaagatgagaagtccataagagatggaaataaagaagaacccaaaagaaatttgtaaagctctaaacctgtgccaagctaattgaataatgaaaaatgtgtytagcccacagatctgttttgtttggcttgcacaatgtgttttgtttcttattatattgaacttgattgccctcaggcactatccagtttaccaagcaacacccttcctaccatcttatctgccaacaggtagctcaattacattacttcactggccctgtaagcatttgagatgatagctattggtatatagtttatgtttacagatggattcatttttaactgttaaacacttgaacttatgttgactgcagagatgccagaaaaagagaggaagatcataggggaaaaaagtgggaaattgaaaaagggtagaaatcctagcagaactatctttgaaagaggcacccccgctcactgccccaattacagcagctacaaatcatgccgtaggtcaagtgaagtgggtgcctgccatatttctttcaactagcctttcartattttgggaaattcccaagaatcgaaactcaaattcccaccyttctttgtagctaggacattggcttatagcctcagttccaccaaagagcagcatgctggcaaaactgcaatttggaaaagagcaaaatgaacaaacaggaggagtcagccacccccatttttgccagcacagctgaggtgtcaggtttccagggcttgcatgactgaattccctggacagaaatgacactagtgacactgtggcaggtccttctgttgtcttgggtgagaaactgattcygtattaacatagacctctgtgcaaagaactgattccttgtcaacacaacacctgtgaaaaaagtcccagatttcatatgaccacccttcttcccacagagaaaggacacagtggaagtctctcttttgtccttgttctgtgaatcccaatgtgtacttttaaggcaatatgacattgcacacccattactcagcacccttggcacttgacttcattgtcaccatccacagtcaagaggtcattcaattttcactgaggagaccattatcagccattctgggaaacattcttgctctgcaggacccctatcttgggtgatgaactggttccatattaacagagacctatgtgcaaagtggcaagcaatgtacagatttttaaactaaatataaagatgatattaaactggttttcatttctgttagcaccaaacaagagtggttggaggtttcagctacagcagagatttttaatgaagaactctgggcattaaggatggctgtagaacattcttctctataattgccagctgttagacaatactatatttactatatagtatttactttakatttactatataagggtagcaattctcatttatatttctcatgatcatctcttgaagggtacactgttaatccccattttatgggagaaaaaaaactccrattaaatgacttgcttaaaaccagaggggatccaaatttgggttttctcattgcaaactaatggctttttttctcctgtatcagtggctttccaaacatattctgcaggttccctacctaggctgtgtgggacagcctaatgctcctaggctacaaatctgtacagagtgttactgtactgaaccccatagacaattataacaatggtagttgtgtatttaaacatatcagaaaaggtatagtaaaaatacagtgttataatcttattctaatcttatgggaccactgttgtgtgcgcagtctgatgttgactgaaacattgttatgggtgcatgactatgataagatattattttcctttctcccattcacccttttaagagggtagagagttttccagaggatacatgctatgtaacttcacaacagactgaagcagaagcagatatatttccctgtaagatcctagttttctgcttatatctctgtatmctctgcctccctagtctttttttcttttttttttttttttttggagtgatgaattaatgaatggtagtgaaggtgttagattgtaaagtaactgattatagactcaaccaccttcccctcaaattcctcaagtacctagctcagtgtaggctcaattactacttgattgatggatgaaggaacaaaactgattgctatcatagatagaggacctgctcaatgcttctggtaagtgataagcaaygtgtgcacttgctcctgagttcacagttgcataccagacaacagactgcctcagccccagcaagtccaggctcacctgggcccagggtggagagatcactcctgtctccttgcctcatccctgtccagattctattcattcacaggcccagctcagctcctgtgcctttcccagggatgccaaccaacaatgagcctcgcactgtgacatcacataggaatttatctatgtcatctattttgcctctcgatctcattctgtcctgcactgctgccttcctaaatcaattgtgtatattttgttttccctataagatcttagacatcatgattatattgaacttgggtgatgtgtacatagggttcacagtacyattttctgtagtttcgtgtgtttaaaattttccataataaaaagcttaaaaaaaaaagatcttagacatcatgaaatgtctcaaaggtcttttgctttacccagagtctcacatagtgctaagtaaattataatcactctcatctaaataaatcttaaaactttacaaaatgattcagactcatcatctcactgctttttcaccaaagccttgcatgaaaattagaggaggcctctttatattatctccaccttacagatggaagcttgaaagttaagcagcytaaggtcacccagctagtgattaacagagtctggaggcaaacctgtgtcttgtgattccaaattctgtgattttcccactatattcatgctccagtttgctgatacatactwgtttaatttacctgaaagacactttgtgaaaaataacgggcctagatccaggatatgagtcagaacagacaggaataaacgcaagtctcctgattctcactaggcaccatgttctacagcgatcttttcccttgtgattttagctgttaaggtggtcagctcatgtgctggttaatcctatatgtgcctcccttaaaagagtgtacgaattatgtagtatacaaattttgtatcatacaaatgtccattttcttttttccaccctrtgtggctaattggcagcctcattactgtgttttcccaacaaaaatgaagggaagcattacgaaattattcagtaacttcaagctgtgtctataaagtgtattataattcccaactctctcttttattttcctctctctcatttgtttacccatcaatccyacaagcatttactaagctctaagtataagcagaagcacattcgatgctgggatgtcttacaatacacaaagaaaaagatatccctgctattaatgagattgtcatctcatgaatataatgacatgtctagagaaaaattctaagatattgaaagtgtgaactagcacagtataatttatttatggaggtgttgaaggaatattgagtaagaaaaatagttcttattatagagagaattaatttggggaaggtttcatatagcggatgtgccttgagatacgttttgaaaaaaattgtagggtgtggtttggaaacatgatctccatctgcagattcccaaagcactcccaaataattgtacagttaaagtacaataatgtgttttgtatgcaaatgtagcctcaagacaggttgcctcattcccccatgccctccagccgccactcctaagcccctgctacatagaaatcctggagcccctactcattggtgtagcatttcagggaaaggaaagtcatcaaaattggtccagggcaaaaatgaaaagtaagtctctgtacctcccagtagccgtttagattgccccttccccatggtgctctgggctttaacgaacagcccagcatggcacagccaccatacctccctcagacctgcatccctgagcaatcttgtatgtcttccctcctagggcaaccttcctttccaaggcctatgccctcaggagtcctccctactatgcgtctttgtgctgctgcaccatgaacttaggttaatagtcaaccctccagggtattataggtacacagaatggacctctcactctaacagagagacactgcagtacaatagtttccccttacccttggggctcacattccaagacccctagtggatgccagacactgtggattgtactgaaccctatatatactatgttttttctatgtgcacatacctgtgataaagttattttatagattagacacagtaagagactaacaatcattaataataaaatagaacaattataacaatatgccaacctcactactcttgcactttggggccattcttgggtaaaataagggtttcttgaacacaagcattgtgatcccacaatagttgatctgctgaaatggctactaagtgacttatgggcacagagcatctgcagcatggatccactgtaccaagggatggcttacatcccaggtggggtggagtaggacaacacaagattttatcacactactcagaacagttaacaatgtaaaacttacgaattgtttatttctggcattttccatttaatattttcggactgtggttgactgggtaaccraagctatggaaagggaaagcaagcttaagggaggactactgtataccaagcaagctactgagagaagacatatatgagaggaggcaggacttgggggctccttaaatcacactctgtgactggttgaaaaatcttgctatgggtaatatcctcctgaatagttcaagacataacataaagaagagagcaacagagagagaacaccatatgactattgagaaagttgaataattatgttaaaatcagattacaaagaccctgtagggtgggctgagtagctggtaattgctcgagtgttagggacactataggctcttgtgtaatatgatggaaaaggtgctttaggatgctgcatacaagcraggctggaggaaagagaactgactgttgtgggtctagattatgtgcgcacctgccgcaatctagctttccagacaccatggctgtttctccccacaccttctagaccagagtctctgaaatgagacatgtcacatgtaagactcattctccaagctttcagagagaatcactccaaaatctgcccccttgatagaaatgggagaaaggatacaatactttcaagatggggcccaataatgtaggacagagatgagttttttttctaaataaatctttactcatgagcacgttgctaaatatgcagcctagaaaagagcacctgctaggggtagatagtgtaatatccactcattaaaaaagaaggaggcaggtcttgattttgcccccaactttctgtggcattgaagagttttatttttattattaatattatttttcatttgtgaatcataattgtatcattgatgacgtacaaatgtgatattttggtcgatgcctacaatgtagaatgatgaaattaagctaactaacatagtgatcagcagaagttgccttattacttgtgattccaacaacaaaacaaggctctggttatttattcaaattatattatatggttcagattctctttgggttttgtaatatattgtctgggggctgaaatggtagatgaaagtcaatcttctctgagacaagagagatgtggatgggttcttaagtgttgcagtgacggctgacaagccccatctacaagccagaattcaatctcttcgcctttcagtgcaagatctttatattgaagcacaacctctaggctatgaaatggaaaagaaaaggaaggagggtcagaggagacagagaccactttataaggaatctatgatgggggcaattaggccaccagcttctgcagtgcacaactgcttacagagatccctggagtggttgttgttttcatgtttatgtagtgcctgggcatttatattttttaaagtactaacatcagaacccccgaraatgaggctcaggcaatgtaacttttaaaactccctcagtgattctaatgtgcagctacagttgagaataacttccctagtatttgaaagaaactaaatgttgattataaggattttatttttgaactatttttctggcctcaatgaatttaatgtctggctagaggaacttgtggctttgagatgaaagaatgcaaaaacaaaatcaaggtacagaaaatcactggtgggggtggtggagagagagagagagtttgtgctgtacatgcaacatcggcgtattagtctgttctcacactgctataaagaaatgcccaagactgggtaatttataaaggaaagaggtttaattgactcacagttccacatggctggggaggcctcaggaaacttacgatcatgccagaaagggaagcaggtgcatcttacatggtggcaggtgagagagagcgtgggaaggaggaactgtcaaacacataaaaccatcagatctcgtgagaactctcactatcacgagaacagcatgggagaaacctccccatgatccaatcacctcccaccaggtccctgtcccgacatgtggggattatgaggattacaattcaagatgagatttgggtggagacacagaatgaaaccatatcaattggtgtaattkagtgcttattagtcatattaggggctagaatttttctgcccatctaaggaaagatctatctccaaggaaatatacatatatacaaatttttcagattttaggattatcatagacttcctgaagccaatgttaaaaacctcagaggtagtcatagacttttgtaactaccttcaaaggaacaaataagcagtttttaaaaatccaccataagaattaagaaccctgagtagaggtcttgattttgcccccaactttctgtgtgattctaactaaattacttaagcttggtaggcccaagttttcatatctgtaaagtgagattttcatctgccccataagaaggtgtgggtaatgttttaacaattttgtaaaaatcaatttagagtgaataaacaaatatgtgtgataataccttgaaaagttgcaatttattatcagagctatttggaattaatctgagaaaaagaaacatacagcttttgggtaactgacatgtttgtgtagctctcatttttatgtacatctgccttgtcaacacaccatacatagattagaaggaatttagccactctgtatcaggatagtgagtcccattggcagttgccctatatattcaattcttctttccctgtaatatgaggattatcctgcagtgtttaccagtggtgtcttctgtcaaactactagtaaatttgttcttataacttgaaaaatacagcatgcattaaaattcaaagaaaaggtagcagtttggggaaacagaaacctatgaacccaaatttcaatctttttcacaagagccccgaaataacttctctgccctccacctcctttccagctgagggccctagggactgccactgtcctgttccctacaagagaatggttatctaggaaggcaatcttcttatttcccaagaaatgtacactgtctcagaaaaagtccaagattaagaataaagccagtccttcacagccagcggttcaaagtgaattattgatgcagcctgtggtaagatgttaactagaggtgcaaagtttatgtgcaggaagtaagcagagccatgctgaaagaaagacaccaaccaaagcttttgtgttcttaggtgtcaaggtttcccattcattttattgtctgagtttcaatggaaatgaataaaatgctacatagaggatctaatactgatagtgaattttgactgctgttttccactcttcagaaaaaatatattaaacaaaatgcagagtcatgtaattcaggttactgtctgttttgttcataaaggaaaatgctttatatgcagaaatttcaagtgagaggagatgtcaggtctccaaaagcagctattgtcaaacaaagcagccagataattaatgccctagagatggctgtgaccacgatattggatatcagcccatgtcttcatctctcttggtagaggcacatgcttttgagctgctgattgtacccacaaagcctatctatgtgttctaagttttttgacataaaatttcctctcctctttatagagtattactttaactttctggttattctttctacaacccttgctgaccagatactatgagtgaggcatggaaaaagaatggtatacgatagtattcaggatgtttttgttatatgtaaagatgaataggccatttaaataactgatcagcttgattctccacttccaaattaatatcccccttccagacagaacagctctgcgtgtaacctcttaccacatcctcttgtagagtggctttttatcccgggcatttaagagagggattctctatttcagtgcagatgactccatcacccctctcagaaactgggctattctgtaagggkgtgtgtgtgtgtgtgtgtgtgtgtgtgtrtatgtgtgtgtccaaccaaagacactattccaaataattaaagaatttggcattttaggtaagcccacattctggttaattgagaattgccacttatgtacattactaggttataagcaaatagggcaaaaggctctcaaggtagttacttcctttgtattaattagaaaaagaacactcaagagtttaataacaaaatcacacaccttttttggacggttgatatcttgtttctgtgtatcatgactaatagtaatgctgtaattcatcacattaggaaagtaatcaacagttctagctgcacaaaattaaaattgattaagacccggcgtcaccctggcagaagctaaaattacatcagtgttaactctacggccaatagccaaaagtctttttagtctcttttggtttaaaaagatctgctatataaaatctagtgtatacaaactaagcaaaatggattagaataaaataatgttgatatatttaatataaatagttctgcagagaaagctactctcatgtttattgaccactggtagaacatcactatggactgggtgctgtgctaggtgctctgcaaatttgatccattttatcctcaccaaatgcatgaaggtatgttggtgccagcctcccacgatagatgaagaagtggggactataggaatgaagtaaccaattcaggagcccagagccacagccaagactcaaatccagggatgtctcaaatggttgaacaaagcatcctttctaatcaatgagcaactgtgctgtctaagaagaccttgtacatgagtacaggaaatatctttcacagatctagattcaaacactgggagaaaaacactcttcttagaaatcatgcccttacttttacaatcaagagttttccgaaggataagcaaaactggtcaatatccagggtctcagaggatgttctccttggaggcacagctcatcaatctcttcttgaatgttgcaaacaatgggccaggaacagagagggatggaggaaatgaagagtcattagccacaataagtgtccttatgaacagctctgatgtcatttatctccaccttccaagaatcctggatgggcttgcataggcaagtgacaaatattgtyaattaagtctttgaagataatggcaaatgtcactaagaaagatttgtgttgaatattacatcaactcagcgttctttcctggccacgatggccaatgtgaggtgacatgaggttaggacagtcatgcctgtgcttggatgaagcggaactctgttctgagtatgcagaagttagattagagattctccaaaaacctttttccagatggatggcaagagtgaggcagtggcccccaattctggaataaaccggtgttcttggctggtgtgagaccatgtattagactctaaagacggtcagaagcagtaaccacaacactctttrttctacaattctgagtgtgctgataatatgggcaggagttagaagggaactatttttctgactttttctcccaggctgtccctgcaatatctaccatttcatgaaagaaacaatcttaaactaagttatacagagtacttgattcatgtttcctctcttttttatcatcctgattctacctttatggcagagagaataagccatctcatgattgccttggaccaaccatcccaggccagtagagaaagatacacctatttccccaggagcagagaggttgtccatggtgggggctgggtggtgaaactgcacaacatggccagttgaatcttcctttaaaaaggtcctatcatcaagtggggcacatagcatgattagaggccaggggttgcctttattcacttctgcttcctcctctgcctaatccctgtacctgagggagccttacagatcccccaaatctgggtgatggagcaatgaaccatataggcccatgttcccctgtattatctcatcctatacctactttttatatttgtcaataaaaagtctatggctgtcttgttttttgcaatccatccttatgaatgctctactactaaaaacatagaacaacctttatgggacaattggaaatttgaacactaactctacatttaatattaaggaaatattaaacttctatttaggagtgrgaatggtattgtgaaaatattaggtttgtctaagagtgcatggcttttagatctacgtaataaatattttcagattgaatgacatgatgtctaggatttgcttcataataacatgggagggatggcagccagaggacatatggatgaaacaagattgggcttgagctgataatctttgaagctgggtgacgagttcactgtactgggtttggtttttggtttgttagttgtgtgtatgttaaaaatgtcccataataaaagcttttttaaaaagaattaaaattggttattttaaattaatattagaaaattgtatttctcaaaaatattttatgtgcaattatcatgatttataatgttaaatggaataggaagatctaaaacatataaggtacaaagtactgcatgtaaagtactgcatatacacatttgcttttatatgtacatgtaagtggaagaagaaatgatgcaaatgtaaattatggttgcccctgactggtgagaatacatattatttttctttattcattgttacatttttgtacctcccaaattttctagagagaaaataaactatatttaaaattttatagttatttttatatataagccatgcttgtgacatattattagattttttaaaaaagatacagaactatttgtgaaaaagaacctcaattctgttttaaaatgtgtgcacatggtaagtgtgtgaatgtatctaaaatgaacagcatcaaaaaaagaaacaaatctatattctagattttcatagacaaaaataaataaatatataaataaataaaatgaacagcatcagttgttaattgtggctatctctagatggtgacgttattggacawtttttagtttatttgcctctctgtgtgtttcttcaattaataagtataatattataatcagaaaaatgtggcataaaaaataaagctagatttattatacttctttataagggttagctatatagggcaatataacatacaagtaactacataatatatacttacaaaacacatatgtaagtccaaaggaattttaaattctcaaagtatgttaagcttttaaacgatgatataaaatcttttcaatagccaatattatgtgatgatgctcttgccttcatatacttaattccttaataatcatgtttcattttctgttcaactccaggtatatccatgccaataccagtctttgggctacaggacgattcraaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacwataccggctttggcctacaagtytagccaacttcaaatgggacaaaaaaagaattcaaagcaagatgccaagacaacagataatgactgctcaatggttgytctaggaaagcagyattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctstatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctatmaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcmtttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctycaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattrgaatcaatgttatatatatgattacaatgctgaagcatttctattgaatgagaaatagtgtttgccctaaacctttggraaaaaaatacagatttgaaaactaaagaatgtgggaagtgtcattgtgtaatttggaaatgcataaaattctcattatgtcctcatagatatgttgaaagatggttcactrtttcaaagatagaatgtataatatgctgctagtaccaaggcygcatttgaactgaactactccttrtgatataccatactaactgatgaaaatataaatgttaaaatgtctccrctctaatgtattttgccttcacttgtaactctgcacatttcattatatattagggaaaagattacagattctacccccatatactcaatcttgatcagaatgwacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttwaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactcaaaaatgaatgaattttgtgtgagtccatagctgtgtctactaaacggaattaccccaaatcttccaggtcatcagactcagaactccaggtatcatcctgatattcgagagcaaaaaagcctgtgcttctggaagtcagccatgtcacagagctaggatccatccagttggattagctttatcgccatgatccagtttctagttatctgcagtagaaatatgctccatgtttgatcactatgtctggttccacgaagcctaagaacatagagaacaacttcagtgccctaagagatgtgcacaggtgcgtgtggtgtacaccaggacatgcacacaggtgtgcacacgcacagatgcattaacatatgcacacacactctctctctttcacaggagatcatttcaggaattaaagtaaaccaaggaggcatggtgtcatttaacagttaccctcattcatcatttcatctttaactgcagggaaagtatattgagtgcctactgtgtgccaagcattaagctggttgctttccttgcttcaccaaatggaattttcacaacaatctgacaaggtagaattatttttcttttttacagatgaagaaacagagattcagagtagttagtaacatatttaaagtcacactgctggcaagaaaattggcaagtttaagcctgggtcatctgactccaaagcataaaatattttcccaacctcatgcagtgcaggggaaagatcacctgtcaaaaccacaataggagagttcccatgttggcttctccattcactgcttatgtgagttggaaccagtctcttaacaactctgggccttgatttcactgtctgtaaaatggagctgctggtacccatcctggctaactgacagagtaatttagataagatcatgcctatggctgtgcttgataacttgtaaaacaccatgtaaatgtaatcagtgtgttagtaaaaaggaacaactccaaagcctctgtaaattattagccatcagagcaaattctagccaaaactgtgggataggcaatattataattcagcagcttctgctactctcttggtgtttctctttttcaaaaaatttacttctgctttgtccccaccttaatgcagatctcccttctttggtgctctctcttatgacttacataaaaactttccatcccatatgccattcccttgggtgtcaactctctggaagactactactaagtaactgaagctgatatgccattgtgtatcattgacatctcttcagcagcccaccatgatgaaaacccaaaaggcagaaatcaaaggaaaaatgttaggcatcaaggagacaagtgagaagaaaatttggggacaagaaatgttttcttggtatccctgaaatgaccaacaacaacaamaaaaaaacaagtatcttcaaacacttcataacttatataaagttttakaacttaatattgaatttaatccacaataataatgatgattttgaaagaaacattcaagactttgaagatttcattctaaactaagaacattaatgatgcatttgtcccagcaaatatgcaatgagacaagacttctttgtgaatttctgattattttggcatgcggcttgctaaaacaaaatttttaaaaattttttccttaatggtttacacaccagtcttaactctttctttttttttttttttcttttgaggkggagtcctgctgtatcacccaggctggagtgcaatggtgtgatctcagctcactgtgacctccgcctcccagggttcaagcaattctcctgcctcagcctccttagtagcagggattacaggtgcgcaccaccacgcctggctaattttttgtatttttagtagaggtggggtttcaccatgttggtcaggctggtcttgaactcctgaccttgtgatcccctcgcctcggcctcccaaagtgctgggattacaggcgtgagccaccatgcccggcccaactctgaccttcttttttgatattaacaccagtatgtccatctgagccagcgttttatgggaagtcttcatacccaattggaaccttttttcatgtggcccagtcacagcagaagacagacaggaaaccgaggtccagcctgctgctgttgtctgaccttggacgaatctgagtttttcctccttgaagcatataataagggacttagggtcaattatctcagcaaggagtctcttctatgtctatgcttatctgaacactagagagtccagacaaggccttgttgaaccaaggcactgcttcaggtgccaaggataatctggaatgcagaaccctcaygttttcttaaattctctagatggatttcaaataaatgacaactttatcttttatatgggatgagataaatcaaattgctaagtatctaagaagtttctaagatatgagcccaggaggcaaatatcaacataaatgtttgtacattggcattttcctcacagttgggctctcttctgcagtttcatagctactacaatattttggattggcctttttaataaccctcaggcttcctgaagaacaagtgctcctactatttgagttcaatttccctgaagggttaaaattaaaaagcccagatagatttagaattcatggcgcagagaagatctcttttttaaaagctagatttacattgacagtatgccaaggtcacttaagttttcatttataattgagattatgagaccttaaaaaagtatttattctgtcttctagaaaaacagcacaatttgtacttcctgtcctacacttatttcagatattgaaaagtaatatgccattattcagataatcttgtcttagttagggtgaccctaagagcagagttaagactcaggtgcaggttatttatgcaggagatgctctgagggagccaacagcattagagagggaagaagtaaaagtttatttaactgtgtgttcagtgtgtgacataagcaaaaactatactcaaattgggttgagcaactagtgctgcaaactcatttattctcttaataggtttgctagtgagggtctgctatgtgtatgttttatgtaagaccactaagtgtgggaagtctagggatggaattactcttttaaaaaacttgaataagatactgggtggggagattattctacctctttacaaaatgtttgtttatttcattgagcctaccaactttgtcacaaattagcctaagtaatataggataacttaacacgcctacccagagatgccatgctgcatatgataagatatccctcaaggcattgccaccacccgatgctgatgtttcagccactttagacactggtgaaaagcaaagttgtgtgggccaatggcaaaagtgttaagaatatagaattttaaaattagttttatgaggaaaaaatgaaaattagatagaatgttcaatatcactatctccaggctccattgttaaagttctgcattctaagacctaggatcacaatggggtgtataaagaagaatatctaaaagatgggaattagtcaacatagataagcaatccaagaagaatttttaagaagacgaaaaaggaaatgaaaaaaataaacaatagtaaatataaaaacaaatgtgttcagcatgtacacatgtaatgatgtatctctctgatactctgaaaaggggatacatttattagtctttaatttctagagacaagatggtggggttttttccaaattagcagaaaaataggaaatgttattcacaagtgattacaagtatgacaaaattaaaacaactaaacatttccaagactgaagaacaagaagattgatttgcatgaaaatgtaacactacatttattcctctaatataatcaccagagaacttgactatgattaattattcctacacttctctaaaatagaatgtggaagctatgacacactttttgtccagctcctctccaccagatagacctaagtctgaaaacctattggaaccactcataaagaaaaaaaatcttctctaacttagaattattatcactgtcatgatgcaaatatcaacttacttcaatctatatgaagcataataaataaaatattgaaactattagtacatttatataacattctgctttgagaaatttgctttaataactttgaaagacaaaataactatttctgccttaaatgagcatattttttatttgacttaaataccagcttcttttgctaatagctttgagtggtcctacttggttctaagaatttgagcaaagtacagctagccacttgtagtaggcaataatgtatatataaagcataaaccagcaatgtttycacattttttgaaacagcgagattaaatccagaaacatccaacctatttctcttactacaacaaggaaaccagaaggaatgtcaaaggaagacactgaagttgatacttattgagcaacaattttgtgctaatttcacacatttaatcacaataatgtgtctatgtctcatagtaaccatagaggaaactgagtctcaaaggtaaatttgaccaattccaccaagctaaggagaagaatcggaactcaagcatgactatataaatgataagcttttactgtttctaatttccactgtgctaaagatcagaaaatattttctataaggrgccaaatagtacatgttttaggttctgttgtggtgtgaaaacagccatagacaataagcaaatgagtgaatgtgactatgttccaataaaactttatttacaaaaacaaactctgggtcagatttgagcctggactatatagttagctaatccctggacactaccatccaacaacagcaacaataattaccacaaacacaacaaccacaacaacatatactactacactactactaccatcacatctatttatttgagcccktagtaaatgtcaagtattatgttagatattttaatatatccttacaataccagcactatacagtggatattatcatcatctccatgttctatataaggaaactagagattaacctatccaagctcacacatagtaagtaatagagctgggttt

SEQ ID NO: 13323 - DNA, 98560 bp, Homo sapiens
cctcagggccattgtaaggaagaatgttttgccttcatcagaccacaggtttcaactctgacactcagctgtgtgactgtgggccagtaccttccacatgagtcaattacctcatctggaaagtcagaataacattccctacctcacagggctcttgtgaggcttaaagaaaatgtgtkcttcaagtgctgagctcagggcctgcagccagcaagagctcagacagattagctattgtttccatgtttaggttttttttttgtttttttgtttgttttgttttgttttgttttccgagacagggtctcactctgctgcccaggctggagtgtagtgagccatcatggctcactgctgcctcaacttcccgggctcaagtgatcctcccacctcagcctcttgagtagctgggactacaggtgcacgccaccatgcctggctaattttttttttttttcgtagagacaggacttcaccatgtttcccaggctggtcttgaactactaagctcaagcaatccacccatcttggcctcccaaaatgttgggattataggcgtgagccaccacacccagccaggaactttaatctttttttttttttgagacagagtttcgcttttattgctcaggctggagtgcaatggtatggtctcagctcaccgcaaccttcgcctcccaggttcaagtgattctcccacctcagcctcccttagtagctgggattacaggtgccccccatcaaatctggctaattttgtatttttagtagagacggagtttcaccatgttggccaggctggtctcaaactcctgaccttaggtgatccacccgtcttggcctcccaaagtgctgggattacaggcgtgagccaccacaaccggccgaacttcaatcttaataggtgggtttggtctcttatttaggtaacagacttggtcaccctccccattccacagacacggtcactgaggcccagaaaagtggctttcccaagatcacccaactcagagtggcagagctacagtattcattcactcattgtatattcaatgcctgctttgtgccagagctaggtgcccaggacagggctgtgtacaaacagatagaaatccctgccctcaggactgggcatggtggctcatgcctgtaatcccagcactttgggaggccaaggcgggcggatcacctgaagtcaggagttcgagaccagcctggccaacatggcaaaacctcatctctactaaaagtacaaaaaaattagcagggcatggtggtgtgtacgtgtaatcccagctacttgggaggctgaggcaggagaatcacttgaacccggggtggaggggaggttgcagtgagctgagatcatgccactgcactccagcctgggtgacagagtgagattccatctcaaaaaaaagacatccctgcccttagccgggcatggtggcatgcacttgtagtctcagctattccggagactgagtcaggaggatcgcttgggcccaggattttaaacccaggggtctcttaaaaaaaaaaaaaaaagccaggggtggtggcttatgcctgtaatcccagcactttgggaggctgaggcaggtggatcacctgatgtcaggagtttgagaccagcctggccaatatagtgaaaccctgtctctactaaaaaatagaaaaattagctgggtgtggtggtgcgcacctgtagtcccagctactccagaggctgaggcaggacaattgctggaacccgggaggcagaggttgcagtgagccgagatcacgtcactgcactctagcctgggcgacagagcaagactccgtctcaaaaaacaaacaaacaaaaaatctctgccctggtgaagttccccttataggggataggggatggacarggaatgacactatacaaaataaataagtgcactaaatacatttgttaaatgatatggccaatggagagaaataaagttgggagaggcccatggcgagcatggggaagtcagcatgttcaacagggtggagaggtggaacttgagcagaacccagaggaggtgaggagggtactgggaggaaatgcggggaagagcaacccaggcggaggacatagcacatgaaaatgccctgtggtgggtgtatacctggggtgtttaggacctctggaggccagctggaaggcaggggtttgtgctctgtggacactgtggacactgaggggcagtgaggccctgccagcaccaacatccttgctggtgtttcccaggctggcctaggctgtggacaactgggttcaggtaacttcactcccgtgccctcttcccagcaagtagtaggtccttggggaaggggcttcttccaaagctcakggcagatgggagtggggagggaactcgtgatcagggcacacatctccagatgacctctcccctgccccagttcccaccctggctaccctcttgttcctggagccaccaggggtagaatgagggcaatcaggcctgagtctatgaagtgggtgctgggcattgcggccacagcccctcaccaccttcctggttttaaagcactcccagtgacaatatggtttctgataacctgcagtacctgctgtctggggagcagctctggccacccatcctggcccctgcccacccatctcctcccaggaactctggcaggtccctgagctgtcagccagctctcctggcccccagtggtgtcctaaatcccagcagcatgtccatgagtgtgaccttaaccaccagatctcaattatatagaaaggagagaaacatttttttctttctttttttttggagacagggtctcactctcrtcacttaggctggagtacagtggcacaatcacagctccctgaagtctctctctcctgggctcaagtgatcctgccgctttagtttcccgagtagctgggagtacaggcacgtgcaccacacccggctaatttttttttggtatttttttttgtagagatggggttttgccatgttgcccaggcttgtctcgaattcctgggctcatgcaatctgcctgccttggcctcccagagtgctgagattacaggcatgaaccactgcgcctggcctggacattttcttagaacccactgtatgccaggcacttttgtacgagttattacctctaatcctcacaacagcctcactcgagatattatactcaagagatattctatgatataaatattattatgttttatgaacagaaaatagattcagagtagggaaaggtttaggttttacccaaaggcacccaataaacacatgttaattttagcactaaaaccccattttaatgattgctgggagtttctgcagcctgattcataattcaggagccagggaggtggggttagagaaaagagaggccatcaggaggtttgccctgggagctgttccatgataaatggtttcctatatctgaagagctcaatcaaggggcaaagagagataaccctgaaggtagaaaggaacttttgtttgttaaagcttcaggaagggtgactttgggttaatgggtatcatgactttgggttaatggacccctgtccatcagtggagcgggcgacctcaagaggtggggaacctctcatcactggcggcacgtaagcagaaccaacttttccatttgcccaagatgccacagaaggaatgtttcagtgagggaggttgrcctggataatttctctacaagctctcagacttgggaacttttgaaaggctcaggcaagtacttgtgccccaaagtatctttggcagggttttttatttttatttttttagatggaatctctgtcgcccaggctggagtgcagtggtgcaatctcggctcactgcaacctccacctcccaggttcaagtgattctcctgcctcagcctccttagtagctaggatcacaggtgtgcaccaccatgcctggctaatttttgtatttttagtagagacggggtttcaccatgctggccaggctggtctcgaactcctgacctygtgatctgcccgccttggcctcccaaagtgctgggattccaggcgtgagccaccatgcccagcctggcccaggctggagtgcagtggcgcgatctcggctcactgcagcctccacctcctgggttcaagcaattctcctgactcagcctcctgagtagctgggattacaagtgtgcaccaccatgcctagctaatttttgtatttttagtggagacggggtttcactgtgttggtcaggctggtcttgaactcctgacctcatgatccgcctgcctcggcctcccaaagtgctgggattccaggtgtgagccaggcaggaggtttttatctgacttgtttcaagctgcaagtctgtctcctgggtggggtgtttgcttttcacagaggaagggtggcccaggttgggtaggctggagtagaggatcggactgcatcagttctggtgtgacctcttacggttgccttactttgttctcagataaagcaaacgcacaaaaatttgttttctgggcttaacaaaacaggagtgaccagttaggtcagaagactggaacatcagtgaagtggatgtgtggtaggcggaggggaaagacttgctagaagccctcccgctgcggggggctccttcagaaatggctctgcctctagcagctctgcctggacactgagcagggaaagggtcccgacactcattagtaacagtggtaagtcagagaaccagccctgagcctgtgtccccagccctgccgggggccaatgcctactgagcacttcccacaggccagttcctgggtgatgagttttaccaacatgtatttcccttttacttttgaggaaaatgaaggtgggctcagtcacagagatagtgcatgctccaaagccagtgtctttcctgtctcctcggttggcctgccccatcctagcgatgttgtgaagattgggactacctctaaagcagcacacagtggctgctcagtaaatgctcaacactggtaggtgctgtgggccaaggtggagagaaacgggccatctggagcaggaagcagctgactgcagaagtcctgtctgggcccccagcagtctgggtgactgagcaaatcttggaacctctcagtctatttccccatattacataacacctggctacaaaagggcttttttcttttttgagagggagtctcgctctgtcgcgcaggctggcatgcaatggcaccatctccgctcactgcaacctccacctcctgggttcaagcgattctcctgcctcagcctcctgagtagctgggattacaggtgcgcgcaccacacccggctattttttgtatttttaatagagacggggtttcaccgtgttagtcacgctggtctcgaactgccgacctctggtgatccgcccacctcggcctcccaaagtgctgggattacaggcatgagccaccacacccggcctacaaaaggggttcttctgggacccgatcgtctaaactcttctccatttgaccccctccatcactactccacagctcaccggtcttttctctgttccttaggtgcccgtcctgtctccaggcctttgtacataccattcgtcttgccttgtttgccctgccctcacacttggcacatctggcacctcccctgmacattctaagacagcatccttccgtaccatttgacccaccccgttttttccaccacagtactcatccatattataaccctttattcacattttgtcttttatctcagtcaggaggaagcgagggcgggggactctgtgttgttccctaccgtaccctcagcgcacagtctggttcagaaaatactcgagagtgaatgagagaatgaatgaaggaaaaaatgagtggaggaggggtctttggccgagctaaagagcctgggcgccgcgggggcgggaagctctaggcagtgctcgtcgcrcaccgcccccagagtaaagcgaatttcagaagagggcgtggggccctgggcgtgtggggccctgggcgtgtgtgacccgggccaagtccaagtccgcaggaggctgcgcgggaagctgcttatagctacgacccgcggcccccggcctctagccccaccgccgccaggcaagggcagggacgccaggtcagttacaggctcgggtgcggcagccggcgaccaaaggcactgggcgggaggccggatccaaggggatactgctacgtagctgcagcggaaccggcaggctctgcggcgaaacacactgggacttgtagttctcggctcctctagacgctgtcgcgagcccccagataaagaggcacttcgcggtgacrgggaactacatttcccagaaggccggaatatgttgggggtcaccgggaaagcgccccgactggcggcacttacccggctctataggtccggttccgggggcgcgtggctgcagcggggcccgcgtggtgcctcctgaggcggcccccggatgaagagatctgggaacccgggagccgaggyaacgaacagctcggtggcagggcctgactgctgcggaggcctcggcaatattgattttagacaggtactgaccgcaccggaccgccgcggaaactgggagagggatctgcaaggcccgaggggcgtgaaggcttgcggcgcctcaaacgctgcggggcggggccgccagttcccaggcaatgggggcgtggcgtggcgggggtgggggagccgcgtgcgggagcgccggctggtgtctgtgtgtgtgcgtgtgcgcgcgcgtgtaaacctcagattgcgtgtgtcagagacgggggcgttcctgagctcgtctgattgtgtgcctgtgtgtggccctgagattgtgtgagactcagaggttgtccgtgttagtctttgggattgtgtctcactgaaattatgtgatgctctgagagtgtgccggagagtgagtgtgagtgtgtatgaccgaggctgtgtgtgactgagcgtgggcgagggtgaaggaggccgattatatgtttgggagtgtgttgtgtggcccctgctcccgtccatcccccagggtcaggaggccagcttttgcccagaggcaagagagtggtggggaccctgcctgtctcccagccggccctgggcaggctgcagaccaccacccagccgtttcggggccataatgggtgcgaccggccccagaagctgggggcctggcttgcctgctgaggctgccctctgcagagtcctaggccagagagtgcctgtcctggcatctccccaggctcccaattccaatggattccaatttccaacctctcttgcattctcccttctatcaaagcttcctcttagatgctccatttacctttttcatcacccactcttcatgaagcctgtaaggcacrtctctgccccaarcagcttctaatccagttctttcgctcccttcattccttactcacatgtgcatttattcactcactgatccagccagtattgattcagggccggctgagggcctcgtgtcactcagaagtttaagggcacttctgtcactgagctttcattctagggagggagattgtaggcctggaaagccagagagttctctgaaggagctaayaccagttagtgttttgaagagtagctgatgggaaggcgggattgaaatcccaagagagcctgttgccgtatctgcgagggagggacctgggatctgagagccgaaaggtcagtcagtggggcaagattccccagaggagggaggcagttgcgaagccctccaggaggcacaggaggagatgggccgctggccctgagggagcgcaggaccgttggccagatgggtgctcagcagaggacaggaagaagactattactttagtaaactgtccattgaattacaacatgcagtcagatgagtgatgggtcctacccctacagctcctgcattttcaccaggtgaacctgtatctgttaatcctcagatcaagatggggggtcatgatcacctccaggggctgccctcagaagccaccgtgtagaagggtgggtgggggagccatgtagaagggggggcagaatgcaagggggcagtgtccctttgcagacccatctaggggcctgccccagggcctgccagtgggcaggggagactaacygggtgtgtgaggggtgggcttctctgctctttctcctttctccccagggctgtgcagctggagagagctggggctggggttcgggtcagggtgacccttgttgactaacattctgcttttcttctgctgtccttgttggtgcagttaagcttcctgttgccaagggatttttcttaaagaaagaargaaagaaacatacaacatacaacattacatatttgcttatgtggtagctctactccctcctcaatcaaaatctccggttttaaaatatgtcagtccctggcctgggagagttgcaaggtttttgttcaccccatgggcgtctgagctgcaggatctccggtgctagccctgtgctgctgtgctgtccagtagaaacatcgtgtgccacatgcataatttaaacctttctagtagccatgttaaattagtgagaagaaatggaaaatagcaaagaaatagaaaaataattttgacaatatattttattgttaccaaaatatatatcagacatattttgtcctgtggcattccaagcttgtggcactgcctgtgaccagtggctgccatgtcataccaaacagtgctgctctgggtaccatgccctccaccagctcttttctgggcctgcttcagcaggtacagaatcttgcttttgtttttwaaaaaaaaaaaaaaaaaatcagctgttggggctgggcacggtggctcacgcctgtaatcccagcactctgggaggccaaagcaggtggatcacctgaggtcgggagtttgagaccakcctgaccaacatggagaaatcccatctctactaaaaatataaaaagttagccaggcgtggcggcacatgcctgtaatcccagctactcgggaggctgaggcaggagaatcacttgaaccccgtaggtggaggttgcagtgagctgatatcacgccattgcactccagcctgggctagaagagcgaaactctgtctcaaaacaaaaacaaacaacccaaagaatcagccattgggctgaggagttagggtgaggagtgtgcccgctgcagccccactgactaaggcccttttgctccttgttgccctccctgtcaggattctggagccttgctcctcagctgggcagctgcctgaaggcagtggggtggcagatggatgagagcagggtctgcatcttgctgtccacaggcmggggcacctccaggatycagaagatgactccagtagggcctaggggtgcgggcacccaggctggcagagcacacygaggtcctcagagcaagggcacatgcccaggtctcaggtcccttttccatagcgaatcacctgctcaccagagcgggtgagtgatgatgtctccagcttggtgttggtgtcaagaagaatggggacagtgagggggttatggtgaagaccagaatgagatgagggstgtaaagctttatgaagtatcgagtgcagcccacctaagggtggtcctcaagaaggcaaagcccttgtattcagaaggctgagagacctggggcaggggacacaggtccctgtgtgtaatatgggcacccgagtaagaccctggaggcaaagctccgatggccgatgcggggtatcttgactgcctttcagggaaaaatgtttgcctttatccaaaatcgtttccaaaaatcttttgattgtattactttagttgaaataaacattaggccgttatattagatgagttactctgtggtgttttcaaggccgtacattttgtcttcagtaattttggcatcagccaagacagagcagggttgaggctttccgtggctgctcatcaaaacaatgacagaaactcttggagcttgtttcccctgcctctgttgagatgacactgtttttcctcattaagctgtaaatatgaattccattgatgttttgaatgttgaactagctctggattcctggggtgatctctggctggtcctaacatattatcctttgtatatattgctggatttgatttgctctaatttttggggggatcttctttctttatctggtttcatttgatttaattaatttatttattttaagacagagtctcgctctgttgctcaggcatgtactcaggaatgcagtggygtgataccagctcattgcaacctccgcctcccgagttcaagcaattcccccacctcaggctcccgagtagctgggattacaggtgcacctaccaccacacctggtttttgttttgttttgttttgttttttgtatttttagtagcgacagggttgttggccaggctggtctcaaactcctgaccttaagtgatccacccaccttggcctcccaaaatgctgggattacaggcggtgagccactgcacccggcctggttttagtgttagggtaatacagtgagttgggaagtattgcctccctcttccatattctggaagagattgtgtggaattggaattattttttccttaaatgttaggcagaattcatccaggaaaccatctgggctcaaggctttctttttttaggtttttaagccataaattcaaatcctttaaaagataaaggattatttcttgaatgaattttgacagttgtgtcttgcaaggatcggttcatttcatctaagttacttaatttgtgttattcatagtattcccttattattactttaatgtttgtgaggtcagtagagaagtccccccttttatttctgatattgatattttgtgtcttttctctttttttcttggtcaggctggctggaggtttctcarttttattgggaaaataaattttccccaaagaaccagctttgggtgtaatttttttttctctattgttttcctgttttcaatttgattgatttttgcttatctttaattttttgtcctgcctcctttgggtttaactcattcctctttctctaatttctttctttctttttttgagacggagtcttcctctgttgcccaggctggaatgcagtggtgcaatctcggctcactgcaacctccgtctcccgggttcaagcaattctcctgcctcagcctcccaagtagctaggattacaggcgccctccaccacgcctggttaatttttgtatatttagtagagatggggtttcaccatgttggccgggctggtcttgaactcctgacctcaagtaatctgcctgcttcagcctcccaaagtactgggattataggcatgagccactgcgcccagccactctttctgtaatttcttaagggcaaagcttatattcctgacctgggacttttcttccttactaatagaagccctgccttagccgcatcccacagggtttcatgtgttctattctcattttcattcagttcaaaatgtttctagatttcccaagacttcccatttggccctcgcgtgcattctttccacgatcgctttctgtgactgatttcgagtttaattctgtggtggtttgggagcatactgtgtatgctttctattcgtttaaatttaaggtttgtttggtggccccaagtgtgatctgttttggtgacaccagagactgcaggctgttcccaaggctgccatgtgctgtggtcaggtccagccactggatggcgctgctcaggtcagctgcgtcctcccgattttccacctgcgtttttttytttctttctttctttctttctttctttctttctttctttctttctttctttctttctttctttctttctttctttttctttctttctttctttccttccttctttttcyttttctttctttctttttctctttctttttctttctttctttctcattagattttttttaatgggtctcaaaaatctgtgacaattttttttttttttttgagacggagtctcgctctgtcgcccaggctgaagtgcagtggcgccatcttgggtcactgcaagctccacctcccgggttcacgccattctcctgcttcagcctcccgagtagctgggactacaggcgcctgccaccacgcccagctaatttttttaattttttagtagagacggggtttcaccgtgttagccaggatgatctcgatctcctgacttcatgatacgcccgcctcagcctctcaaagtgctgggattacaggcatgactcaccgcgcccggcccgacaaatttttggtcaagttgtttccattcaaaagtactgattttaaaaactaataacttaaaactgccacaggcaaaaaagaaaaccaaagtggtccacaaaacattttcctttccttctaaaggttttatgatgcattgttatcattaaccagtcttttactactaaatttaaatggtcaattgaaacaaacagttctgagacgttcttcaccactgattaagagcggggtggcaggtattagggataatattcatttagccttctgagctttctgggcagacttggtgaccttgccagctccagcagccttcttgtccactgctttgattctctcagtcactgagaggaccatggagggccctaacaagaactgtggatttgtcttttccaccctttagttctgtcagcttttgcttcatacctcacctcacttctttttgttgttgttgtttgtttttgagatggattctcgctctgtcgcccaggctggagtgcagtggcatgacctcagctcactgcaacctccgcctcccaggttcatgcgattctcctgcctcagcctccagagtagctgggattacaggcgcctgccaccacgcccggctaatttttgtatgtttagtggagacggggtttcaccatatcggctaggctagtcttgaactcctgacctcaggtgatccacctgtcttggcctcccaaagtgctgggattacaggcgtgagccaccgcgcctggccactcacctcagttcttaatctgaagagtgggcatgcctcgcagggttgtcaccaggactcgatgacacagttgtcacagccagcgtctgtctagccatgccccccgccaggcactgcgctgagtgctttccttgcactttctcatttaatcctcctggcgtcccatggcacctctaccattcccacctcccaggctaggaagcggtgctcagcgaggggagatggctgcccgccgtggcacgggcgtccttgtctcatcagcactctgttctgcctcctgcaagtcccttgccagagcttggcagctggttcacttccgagtgaaggttggctggcttattgttactattgtcttcaaaatacaatgtgtatttacacagagacacagtagcacctagcaggttctgtcctgggccctggaaggtaaaggtaaagaaaaggaagatggctgggcttggtggctcacacttgtagtttcagtactttgggaggaggccgaggtgggagactcacttgagcccaggagttccagaccaaactgggcaatgtggtgagactccatgtctacaaaataaaaaaaaattagccaggtttgggccgggtgcggtggctcacgcctgtaatccctcggcactttgggaggccgaggcrggcggatcatgaggtcaggagatcgagaccatcctggctaacacggtgaaaccctgtctctactaaaaatacaaaaaaatagctgggcatggtggcgggcgcctgtagtcccagctacttaggaggctgaggcaggagaatgrcgtgaacccgggaggtggagcttgcagtgagcagagatcgcgccactgtactccagcctgggtgatagagtgagactccatctcaaaaaaaaaggaaagaaaaaagaaaatggggtgaagctcacaaccagcagargagtgagaagaggcagcccagcgtggaggcgagcagggccttgagaagcaccgtcttacccgtgggccccacacccacccctgctggagcacgtgagctgtcagtgccttttgagtttggtgcaggtcacacttgttaattgaagaatgaatgacatttcaccctcctgaaaggagttatggatctagggaactggagcagctgcctgccatttcgttttactgtgggatctagagaccacagtcgcattgtgacattctaacttccacccctcctgccatgaggtggtttttgctgcccagggcttgcctgacctcagattccagcatcggggtcttcccaggagggtccctccagagagtgaatggtgagagagggacctgtattagttgacattaagcagacagagtagaggggccgccagcctcggccctgagtgggccctgtacttttacatctgttcttgcttctgtgcagaaggtaacctcaggtggcctgtctcatcacccccattccactcaagggaaacctgggcttagattggtcatgggaggcttgccatggtccctcacggtgggtggtgaagctcccagctcagacagtggctgccaaaggccagagtcctctgagccaggtggcctcttatgtggaaaaacagggttagggggctggcttaatatgaaatggcttctcctcttctaccagagaataaactttttaaaaaatatttttattttattttattttttgagatgaagtttcactcttgttgcccaggctggagtgcagtggcgtgatctcggctcactgcaatctccacttcctgggttgaagcgattctcctgcttcagcctctccagtagctgggattacaggtgcctgccaccacgtctggctatttttgtatttttagtagagacsgagtgtcaccatgttgtccaggctggtctcgaactcctgaccatcaggtgatctgcctgctttggcctcccagaatgctgggattacaggcgtgagccactgggcacggccagagaataaacttcttctttttttttttttttgagatggagtctcgctctgtcatccaggctggagtgcagtggcatgatctcggctcactgcaacctctgcctcccaggttcaagtgattcttctgcctcagcctccccagtagctgggactacagtcgtgcaccaccatgtccagctaatttttgtatttttagtagaaacggggtttcaccatattggccaggctgatctctgactcctggccttgtgatccgcctgcctaggcctcccaaagtgctgggattacgggggtgagccatcgcgcccggcccagagaataaacttagaggaaaaagactctggcacactcatccttatgtctttgtgccaggcacagggctctaacccaaagttgccctaaataaacgttacccgagtcagcttatggtgccagggcatgagggcagctctgggggcagtgggggctgcagcgctgcaggcagattctgcaggggtgatggatcccaggaggacctgtcccctctccagcagcccccacccattcccctgccctttgttgtgtgtggtgtgtggcctggaatcgatgtgactttgcctgtccaggcctgctgtttgtccatgtgtcacaatgtgacatgttgacccactgcagatcattccctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggcygtggtgggtagctcctttcctttagtcagattccgaggcctctgcaacctggagccttggagtgggggttccattagaattactgggtagcagaaagccgggacctctgttgtatgaaggaggttggggctgggagtggatgggagaccgccctttggtcacaggtgtgaaggggaggccatcaagggagactctgacacccggaggcagagcctggatgtgggacccaggactctcctactctgctcacgtctgacctggatttttggttcttttttgccaatccagtttcaggagggaggtccaccctcctgaggggggttttggaaatgacagctatgagaaagggactatcatgtctctgagtggggatcggggagctgggaggggcttccctctgctgcctagaattccactctgaaccattagtcattctttccagcgaagcaggtgcttctccgggcaacataaatcctcctcaaggtgactgaagtgaccggatggacaccaccaccctcctgagacaggctgacctgaggccattgggacctgggcacaggagggagaggggggagggggtggatacgttccagctttgaccagttcagccctaattgggagactcaggtggatgtcagctgctgctgggytcccccagtgttagttgcttaatctttcagtgctcagtttccgtccttcatcttggctcccacagaaggtgaaaaaagcatatttcttgctcactttcccagtttccttgggtttcaagacccaraagcactcacttttatccttgtcccatttttatggggctttctgtctggtagggctggccttgctcaggctggctctgctcctcactgcctggggtctggaggctttgctcttttatctggaaagtaggctaacaacaaggctttacttttaggrtggctgagagtatggccagagataggtctgcgctcactgacaggtcctgtgttttcttagatcccctagagtgagggcctccttagtggagctcagctaaggtgactaacatcgagttgaattccttatgagaggcagcatttcccccagggcccagtggggaagtagtagagagatcatttacactcaggaagatgcacctctcttagctgtagagttgaaggggcgccagtgatatgggaagtgtttttcctggccctggaaaatgccctctgtcccttcctggccccaggctcagtgtccctaggcctttcctgctttcccctttcccctagctgagcggggctctgctctgtgactcacactctgccctttctcctctttggcttggctaacagcatgctggtccataggtaagggtccatggggagggctctgggggaagtccaaaggcaggaggccactgaggtcctttgctgtgccctggggagcaaccggcaaagccagggttggaggagggagtggattaggtggttgtgtaagaggcggaataacagatgggccacgggaggattggtaatgggaatgaggcaagggaggggtagggtgaggccaggttttggctgggggctgaatggggaatggggagtgggagggatgggtgaaaactggccgctggcccactcatagggtctgctgtgcacatgcagggagataactcactcttggtgcacttcgtaagtgccaggcatgaccaaagccacgactcttccctgagccagctttccaccctccccccaccaggctgtcaagggacagggccttggaattggatgcgtgttttttgtttttgttttttttttgagacggagtctcgttctgtcacccaggctggagtgcagtgggacaatcttggctcactgcaacctccgcctcccaggttcaagccattcttctgcctcagcctcccgagtagctgggcctataggcgtgcgccaccatgcctggctaatttttgtatttttagtggagatggggtttcaccacattggccaggctggtctcaaactcctgaccctgtgatctgcctgcctagcctcccaaagtgctgggattacaggccaccatgcctagactggaggtgcttaatagatgttatcatcaagctgaagataaggccaggcctcaggttaagccccaggttctagaagctttggggctgcatcacaggccttccctcccctcccttcccctcccttcagggcaggacagcctgctctgagcctggcccagttgtccttcatgagcggccagtgtctgctctggggagtgtgggcctaggctcacagccccaggcgttgggaggcacctgctggagcgccaggccttgttggctgcaggcgctgggcaggcactgcgcagttcccagaggctgtggccacagctaggcaagtggtgcttccctgggttccttcttcccgccatttgcggagtggcttttcttagtcatttgtttactgatgcccacacctgctgccgtggccactctttcactcagctattctgtctacagattccagtagcagtgcacctttggtcctatgtcagctcattcatcccttaggaggggcctgcattggagcattttgtttgtttgtttgttttcagatgaagtgttgctctgtcacccagtggagtgcagtggcgcatcttggctcactgcaactcccacctcccgggttcaagtaattctcctgcctcagcctcctgagtagctgggattataggcatgcaccaccacgcccagctaatttttgtgtttttagtagagacggggtttcactatgttggccaggctggtctcaaactcctgacctcaggtgatccgcccacctcggcctcccaaagtgctgggattataggcatgagccaccacgcccggcctagagcatttaacatctgcttagccctgcccttggccctacagtgagatgattgtttgcacctcagggatgcaggctgatcaggtggggaggccacacgtgggaaggatggcaggccatagcagaagatggctttatactgatagacgtctgagggacatcccatggtcacaccctgcaagtgacctggtagcaggcagagttatgtcaggagactgtcgtttggggaagcaaggattggagtggaggctgcgcttgccccccagggctggctgaccctgggcagaagcaccatctcctccccaccgcttccccaaaatgtgggagatcaaagcgctctttgaaggaatttactgtatttccaaatgcaatagaacaaaacacaccattatgggaaagatcacagctctgatggactttacacttattttttttattttttgtttttaattttttaaaaaaatktttattattatactttaagttctggggtacatgtgcagaacatggaggtttgtacataggtatacatttgccatggtggtttgctgcatccatcaacccatcatctaccttaggtattcctcctaatgctatccttcccctagccccccgccccctgacaggcctcggtgtgatgttcccctccttgtgtccaaaaatgtggaacgcttcatgaatttgtatgtgtcacccttgtgcaggggccatactaatcttctctgtattgttccaattttagtatatgtgctgctgaagcgagcacaactttacacttattttataatttagtatttttaaaaaattttgagttgcatgtggagagacaccataatatttttcagtgcattttagaaaaagttttttattttaatttatttttaaattaattaattgtttattttttgagacagggttgcccaggctggagtgcaagtggcacgatcacagctcactacagcctcgaacacctgggctcaagcgatcctcttgccttggcctcccaagtaactggaactacgcccagctagtttttacatttttgtagagacagggtctcactatgttgcctagactggtctcaaactcctggcctcaagtgattctcccaccttggcctcccaaagtgagcccaggagttcaaggttgcagtgagctatgaacgcgccactgcattccagcctgggtggcagagggagactctgtctcaaaaaaaaaaaaaattgtaaaatctgaatatttgatactatattttatgttgttttctagaaatttctgtctaggtgctgaatcatgcagcctgctcttctactcagccgtgtgtttcagaacgtttcacagtgctgtgtgtagacctcgtgcttttttttttttttttttgagacggagtctcactctgttgcccaggctggagtgcagtggcgcgatctctgctcactgcaagctccgcctcccaggttcatgccattctcctgcctcagtctcctgagtagctgggactacaggcgcccgccaccatgcccggctaattttttgtatttttagtagagatggggtttcaccgtgttagccaggatggtcttgatctcctgacctcgtgatccgcccgcctcggcctcccaaagtgctgggattacaggcatgagccaccgcgcccggccgacctagtgcttttaactgctgtagtttarctgctgtaggaatgggccgtgggttttttttttttttcttcatttctttggttgctggacacctaagttgtttgtcattgttcctgacgttttcatgcaagatgatggcggggcgggggcagtgtccacgtgccccccgtatgcgggtggcgtggccgggatgtgggcacacactttttcagtttaccccgccccactcacaccctcgtgtgcactcaagattgtcccctgtcgagtgtgggcgaggagaggcacaccactattgttttaatttgcttttacctgattcctggtaggttgagcatctcttcacatttatctcagctgcttgggtttcctctggggcctctgagaaccctcatccaggagggtctcggtcacaccagggttggtgtcacctcccttcagggtgccaggcacccctcttcagaggtgctgatttcctcatctggcatccaggcacatttctgcggccgccctcccaggacatgacacagctcattaggtttcagctttttatcttcccttttatgagactacactgtrgtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatccyagctttgtggctgccgtcatcaccatcaccttcaatccgctctactggaatgtggtaagtgatgtgcctgacactgtccagacgggagtatcycactgctyggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatgaagtgggttgcccaggaagtaggggctctcttccctctctgccatgtcacacagtaaagccacttgcttgtgaatctcccacccctcgtgtgttccacaaacatggttatttttcccacatgaggcttcctgcaaaacggcctgcgcattccggacctaggcgagctgggtggcaggagcaagccggcatgagttgaaaggaagccaccagcgtggcaccagctcgtgatgggtgccaggggatgtttgggtgcccgggcaccagcaccgaggggtgggtggactgcatgggaagtgggctctgggcccttcgaggaaagtgtgggaggggagggccgtcagttccttctgcagcctttctgagatgcctcccacacctcccagactgtggggtgaagctcttggggttcctggcccgctctcccaaggctgtctctggggggtgcttctgggctgcttcccggggatcctgctgggggagtgggtggtcctggggctcagcgggggttgggcttgctgatgcagagccctgagcgtcctgtgatcacccccgaggctaatctgcagagtaaggccaagatcagcgtcagcagcacattgttccagacagttttcatttaaggtgaacccttgatcccagggcagaacaggacatgtttttcatttagtttatgacttgagatttttctccatctggtgagagaagtgggtgggggccagcctgctcatgtcaaagacagtgcattccaaagaatgccctgttcctgctgtcctgaacatgctggacacactccgaggatggatgctctggcggcccacaagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccarcctcctgacatgggcctctggagccagggctgcagccgmagtgcctggccatcctggcgtttcctcccactgcctggcctgcatgcttcctctctcctttcacctttgcacacacccagcatgccagagatatgaggtggtkaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctmtggtggaagcacagcccagtcggcaccttgattttggcccagtggtaactrattggggattgctgttgttttcagcccctaagttggcrgtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccrgaggaggtccctgccctctggcttcctgcaggcctgacgttgaccagcagtcattgaggtacatatgggtctcccagcactgggagcttggctggctgaatgcatagcaggtcctgaggacgcttttatttatgcacaagccccctcaggtcacttcccactagcctagccaacagtgtgtttttaaagtgaagttcattgtgaaggttctcagtggctcatgaatggcagagtggttaagatgcagtaagatttggccgggcgcggtggcccacgcctgtaatcccagcactttgggaggctgaggtgggtggatcacctgaggtcaggagttcgagaccarcctggccaacatagtgaaacctcatctctactaaaaatacaaaaatttagccggatgtgatggtgtacgcctgtagtcccagctactcgggaggctggggcaggagaatctcttgaacccaggaggcggaggttgcagtgagccgagatggcaccactgtactccagcctgggtaacagagtgagactctgtctttaaaaaaaaaaaaaaaaaaaaagatgcagtaagatttggaagacagcatgtgtctgtgtgtttggcatacgggtttttttttttttttttttttggtcataagcttttgattagtctcattttgagatagtttttcactggaacagtttgtggtcattggtgggagagggagtgagctcttcaaagtggtttcaaaaggagaaaagttaagaaacatgttgcagttccgtgggctgctgccggggagagtatccggacggcatctggartgggatgacgaggcccagctctgtgatgccagaagcccagtgggtggatcagttgagccaaggagttggagaycatcctggggaacatggcaaaaccctgccactacaaaaaatacaaaaattagccgtgtgtggtggtgtgcacctgtagtcccagctactgggttggctgaggtaggagaatcacttgaacccaggaggtcgaggctgcagtgagctgtgatcacactactgcactccagcctgggcaacagagcaagaccctgtcttaaaaaacaaaaacaaagacaggccaacaggccacaaccagggaagcacttaaataacttaatagttatcaatgcagttgtccctgggtatccataggagattggttccagttccccgtggataccaaaatcggcagatgctcaggtccctgatgggaaacaatgttgtattcgagtataacgtatgcccaccctcccatrtactttacatcatctctagattacttatcatacccaagacagtgtacatgctgggtagttacactgtattattttttatgttattactttttgtttttatttttttcctgaatttttcttttyttttttttttgagacagcatctcactctgtttcccaggctggagtgcagtggcatgatcttggcttactgcaacctctgcctctcaggttcaagcgattcccctgcctcagcctcccaagtagctgggattacggggacctgccaccaagcccagctaacttttttgtagttttagtagagatggggtttcaccatcttggccaggccttgtgatccacctgactcggcctcccaaagtgctgggattataggcatgagccaccgcgccaggccttttttttctttttgagacagagtcttgctctgttgcccaggctggagtgcagtggcacgatctcgactcactgcaacctccacctcccaggttcaagtggttctcctgcctcagcctcctgagtagctgggattayaggcatgcaccactgtgcctgactaatttttgtatttttagtagagacagggtttcaccatgttggcaaggctggtgtcgaactcctgacctcaggtgatctgcccgcgttggcctcccaaagtgctgggattacaggcatgagccaccacgcctggctcttgaatatttttatctgcagttgctgcggagggctggctggtggtggcgggactcatgctcaggtgttgtgcccagtgcatgtcatgcagtatttcaatgaatcttcacagcaaatgctgttaatatcccctttggagactgaagcttgaagaggttcattcatacattcttcaaatgtttattgagcwtctactgtgygctgggcaccatcccggcccctggccctcacgcagcagcttcagtggtgaatgaatgtatagcactgccggtgacacagcaggcaaggggagggacagacaggggtggtggtcagggaaggcctctctgatgggtgtcctttcaccagaaacctgattctcatgcaggagggccctcaggtgtctggggaagagcattctgtcaggaaaacacaagtgcaaaagtcctggggcactcttgagtgtcctcggaggttttaagggacagctgccgctggagccaggcagagggagaatggaggagcaggacggagaggtggctggggacggtggtgcaggccttgcgggccatggggagagacattccctggactctgagctgggagccattgcagaggtggcatgatctgagtcagagtttcaaggtcactgcaccaaggacagaggagaagagrcaaaggtggagctgagaggccagcaggccccagatggcagcttgaccacagtgggactggcggaggtgggagcagtgatcagggagagctgagagaggyggcttggccagcccatggttgggcctgagtgacccgtgggaggcaaggccgttggctgccctggggcaaccgtgggaggagaggcttgtggaggaagagctcggttttgcctgtgtcmgacacggatgtccttgggctccagacagtgtgagaaggccaggcatggtggctcacgcctataatcccaagcactttgggaggccaaggcaggcggatcgcttgagcccaggagttcgaaaccagcccgggcaacgtggtgaaatgtcatctctgtaaaaatacaaaatttagccaggtgtggtggtgagcaccggctactgggaaggctgaggtgggtgggtcacttgagctctgggggtcgaggctgccatgagttgtgctcaagccactgaactccagtttgggtggcagagtgagaccctgtatcagaaaaaaaaaaaaacccaaaacaaaacagactgtgtgtgagtctggactcctggggagctgggggcactggaraggggccttggccccaggcccactgtgtgcctttctgggctgtggctctagggagtgttttcccagcattgggctggggtgctgcccgcttctgctcatcagcacccactccgtcccttccctcttccctcccaggcttcctaggtgagccacctgctcccacccctccctccacctggccagctggcatctcctccactctgttggaacatttcttcccaaggcctcctcctgctcttccttgttcagaccatgggaggctttcccggccttctctttctgggtctttgggggagttcacactgcrgaccctcactcttcctggagaccggccttcctgtgcgccacgatgcttttctggctctcttcctgctgttcttgtgaattctgcttcctccacctgatgttcatttgctcagcgaatagtcaccgagaacctgccatgcaccaggcactgtgtgtgtcctcagagagtgaatgacctctgtccttccagagcacagatatgtttgtaatgaacactgtgataagggctcaggaaacaaagatcaaggtgtcacagagggactgacaggcttttccctctgtcatctgagtctcagtctgtggcctggactcctcagggcttcaggaccttgggtccaggcactgtggccctaygtgggagtctccagtctccaaagggagcccctgccaagacctccccaatgttctgttctttccctatcactccagatgccagggcagtggtccaaggaccagsatggactccctcttctcacctgcccccggatctgtaccctcgcggactcyacctggcttcrtgccatcacccccgccagatcaccagcagcagctgcttgcagccagtctccccactgctcctctctagccacccttgagggccatgctcagaggtccccaggttttccaggaaatggaacttttcccctgtcccgggaggcccttctggcaggcgtcctcccacctgtatcctcagtcatcccaggtcttgggcctttctgggtgatctggcttctcttgtgcaaggctgcccacagacctttgttaccgcagcttggagtggtccttgtcaggtgtcccctccctcatrcctcctcaccctgccctctctgactcagggttgctgacttttggggccatccctggcactacaggtgtccagcaatgtccccggcctctgcccactagatgtcagtagtaccccaagcccaggccatctgagtggtttccagacattgcctgatgtcccttgagggccatggctgcctgggcgttctgagtacctacccctcagcacagcctgccatacctgctgtcactgtttgtctctcactgtccccttcccaggagcatcctaagagagttgaagcggagcctgctctgcttctgtgtccccaatcctggcatgtgcagtgctccgggtggcagctgctgcctgaccttctgtgtcaaggagggtagggcacctgttgtagctcagtgcctgtgcccagcaccatgcctggcagaaatggatgtccaggcagtgtttattggctttgtgagcgtggattgcccattgactggttttctgcagtggcacctggtggacaaggtgaggctccattgtgccaggttctatgcacaccccgactctgtgaaataaagcactgcatggaggtaaagagcagcagtcatttgtagcaggctcagcgattcctggcatcccagtgaagataagataggcagcctgtgccactccagctcccagagcccccctgcttgccctgccctgccatgccctgtgttgtcccgagggagccagcatgggaggcacagcagctgccttgagcagttatttacaagagcaaagtgtgcacatgctttggtattttaactttattgaagaccagttgcatgtaaccaacatcaaagctgctggagacatagcaagttggaaccctacttccaacctagaaggatttctaggcagagttgcctgtgtctgacttcccttcctcactgggaccccgtaaacctgaaggggagctgtaaggaatcctgccaagayggcagatgcacacggggtcacgccggtttcctccagccttgggagggtgcttcctggtgcctttgtttgtccccttccaagccctgcgtggccaccctgctttctgctctccctgggtgcctggctctcatgtgcaggtctttgcttggggacacccaagtccatcctcaaggtcagtgtgcagctcctcccctctgaggcccctctctcccacagtgcaccctgcccaagacctctcgctccattgggccgggggtggctcctgcacatgtgctccagrgaggaaaggcatttgacaggtcagctgcagacaggtgttctgacactcactgtcaaccagaccaaagccccagcccttggccctgcagaggatacctatagaggggcagcaggccttatgtctgtatcaggacgctgacctgtccctctggccggggactttcctgcttttagcctgagagtctctttccctggaacccaagtcagtcctgggcagaacaggacagttggccactgtagtctggagagttgtttgggaagaggcagcttttcctttctgggaggtgagagtccacttgctgcgctgggccgctggctgggcctggggtttcctgggcctggatgtttgacctgctggctggtactggcagcagctgcaccccagggtggccagacggtaggtggcgctgtgggcaaggtgaggtgtgcttctcctggctcctgggaggaggaagaggaggaggaggagaaggaagaaaaggtgtgggtgctcctgcctcacctcagtcacctcctcacctgcagctccctcacctgcctaccacccttagtgtgagtttgctgctgctgctgcctcagtttccattttcagatccccagccagcggtctatggctcgtttctgagtgccccaagggatccctccaggtgccgggaaagccgaccttgtaggtgctatgggatcagcccaggccctgtacccttgtcattcacatccccttcctgggcatcggtttctccatttgtaaagtgaggacgctcagctgaggccccatctagctctgaaatgctgcaatccctgcgctttaccaagtcctggctctggggcagctctgtgccgggacgggaccctgccctcctgggctggcactggattaacaaggtcagattggacattagatgttacatagaaaaatcagcatttggttaataagaaagctcacaacttattaaccaaggagttacggagagagcataaccaggtaatgcgtggggagacagggtcgtgggggctggaggaggtgatggtgggccataggcagggcagcacttggcccacgtgggctttttggaggagtcataggggcagggtgggcaggagttgaggccaaggaragggatatgagtgtagacaaaaggtggactacaggtgggcctggggcttgtgagggaggaccccaagtgcatacctgcaatctggactgtctgctcaaggatggtggcakgtgtgtgtgtgtgtakgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcrtcctctgccagggcctcttgcacttgygggaaagctgagctgagctgggcttactggcggagcctgtggcacaagaagggtttttctttgagcagagccagctggctcatcaggcctgactgagaccttggctctaggagcacagctcttgtctcttcagaccagtgtcacctaagatactgtggccctcctagctctcccccgctcctgtctgggctgtgctcacagctggactcctgcagaacgaatggcaggtctagcttcagctccatggctggggacagtcagtgccttgtccccagtgcccacgctcactcccctggccccttgatgttgggtctcaagtgcaagccgttccacggcacatgagtgtgggatctttcagagccaggcagtggacgtgggcttttagctggcaacagccctgctgcccctggggcactgcctgcctctgaatggcagctgagctgggcagcagcattrctctgtgtgcygctggcactggcctggtggggagcctctgctatcaggctagggctaactttagaattgtggtgcctgagcaacgtggtgacaaagtgtacaacaaggtrtctcgaactgggtcagctcacagcctgtgccaggatggctgggagtgacatggacaggaacaaaagggaggggagagggagcrcactcccacctggagcctggcaggcaggatccccactgagccgatctcttccactgagccggcccatccctccctgtaggttcctcatactccagagatggctgggtgggacccaagcgtgtcttccctggatgatttatttttggttctggcatttacagcatgatgaaggctattggacactgctagtgtgagcagaatcaccctaaccgaaaggcagcgtgcggccctgggcagtagggtttggtgtagacatctctcgggatccctcccacactgaggagaggaggcaggggacccaggctgccttagttactttcccttttcttaggcattcccagtaggttgggcctcctacttccacctttctgtggacccggctggtggccttcaggctaagcatggctggtgaggttcgttcgcgacctgcccccctgcgcccagttgggtgcatctcctgaaacttatctcccagagcttgggccacctgagccaccactgttctgcagacgcgttcttctccgtacttcagtgcctttgcactttctgcttcctccccttcgccagctttcccgccttcacctggctgccttggctcttccagcctrgcttccctgagccctggctctgtgcagacatggctgggccctcctccctgtgccttcctgaaccctgcggcagtgctgagccctagccccgggaactgaggttgaaagtgtgtgttttgcctcctgcctagactgagagctcttggaaactaggggtggggtctgaggcacctgtggatgtcccgggcctggcctggtgctgtgaggcatggatggtgaagggtgccctctttcctggaggaggaaccctgaggcgtccccaggaagccatgcaaccaggcacactcacccccaactctactgggatcacgcacaacccgcttggctgttccccactttctcatgccttctttctctccctgtaaaactccctgccaggccccaggcctgcactgtcaggaactgagatgcagcccagcggggctgtgttatttgctttaccccattcctgggtcttctttgraggctgaatgaaattccatggacaatttccaaggcatgagtttttgtgtcatttcactgctaacctacttggtgacccaaaacaaaacccttcccttgagtctggaggagcagcctctgccccactttgctcagasgtgcaacaaggccttcaggagggaatgggtgtaaaagggtttgggctccaaggagaagcagctgcgggagctgcctggctgctccatctccagaagagctcttgcatgagtggaaacacccaggcctgcctctttcagccactgctcccagctttaggccaagcactttcacttagccccagaaactcttgcctagaaaattctcatggcctctagggatacatcttggagagtacttctgtagctggcggcccctttctctccagaagtgcggagtcagcctgggagggacagcttgagactcaggagctgatggatgtgctcatttgtggccaatgccacagggccacacagtggcagctggtgttgggctctccagtgtcacggatgctgctgccagggttcatcagttgccctagaggcagccctgttcctgccacctgtcctgactccccgccctccccatttcctgccaggcgtggcacagtgagacttaggtgggctcagataggagacggtaagtgctaggctgcccactgggcctcccggttcagaagatgctgggctgagaacactgagcttctgttccaggggagtttcccttgtttgtgttactgctggaccttgagatgattccattattttattcaaaaaaggggacactggcctgatgcagasgtgtggtctctctcctgcaggtgttggtggctggtgagcctgggctggctgtggggacccttcgcttacaggcaaggtgtgccctgggcagtgggcagagatctcaagagaagctgaaatgggggcagarcagcctgactcaaaggtcctgggggaagggggatggagaatctggttgcctgatgggaagtagccaattaggagggtcctgaggatggacgcagagggtgggaggtggagcctgcagagattccccagccacagttttcaaaaccagctgttgtctcgcaaggcactggcaggcaggcgcagggctctgcaggtgtgcaagaggttccaggcagctgctgggctcaccctcctaggaagacatttgtcccaccatcccatgctgaaaatgacccaaggcagggaccccacccggtgtgtgcagtgcaggggtgtgtgttcctggaggcctttctcccaaggccctccctggccagggcacccctaccagsctgagtcccacctgtccagctgacgtcacagcctcttgcttgaattggcatgggcggtgggtgtgagcccctctggtgaggacagcgttggcagctgctaggcactgtcccccttgggcagctgtgggagcagagggaagagagactgggggtacccgccttcccagatggarcgggctgctcatgggacttagctggagtttccaaggagactgaggtttgggggtttctgtgagctggccggatgttgctgaagtgcctctgccctctctggcctctgtgcccttattatgtgtaattctgttctgcaccgccctgctgtgtaaacttggcaagttctggtcccctctcctgcttrtagtttcctgggctaaaatcaaaggaggtaaattatctcccaaggtcctttccattctggatcctctgttaatccaagggagatggggaagagggcttggaaacagctggatttggggatgaagattccactgggggcagaggggaggcagccccccacccaagccccatactccatctccattcctcactccctgccaggagtggaatgtgggcaggtaagagtcccagaggggtaagagccattggtgggaagcaactgtgggaccagtgccgccaccayggcccaaggacctggtgttcratgccgcatccttccggtggcgtctgtggctcttctccttccccctgacccacccrtgcctccgccctggggctggtgggattgctctcaaaaccaccttagccaagagggctccttcccaagactcaggaggaagaacataggggacagccaggcctaaaggggctgggcaggggctctagagaattaaagctgccsaggccacagccccgccctgtgagggcctcacaagccctgtgcaggcygagtgctagagactcccctcttccaggagccagtgccctcctggggaggcgggcagactgtgccccactcctgggtgaggtgggtggggctgtgctggagctggctgccctagtggcctcagacctggccatgtgcgttcttagaaaggcgtttggtctttcctctaagatgagcatagcgtcccttcctcagggttggctgaggagcttggtgtggrcagccgggctccaggcacacagcggycccagtacacctgtcgctttgcctgccacccgcttacggtagcagcatggttgtaataaagcaataaagccagcgtggatgggcgatgttgctattgctattaatgatctttgctcatgaaatttttagtcgcctttctggccttcctctatctcaggccaaaactgccccttcttcctaaggggcaccctgtgcttcttgctgcagaatcctggggcttcccccttcgcatttccgtggaactcagagatggyacctccctgcgaggtggggctgagagggggcccctgcggatgcggttattggaagggctgaggggtcagaggccaggtttggccccaccaatggctggcaccaataacaacacccatgtagaccaggtgtctgcccagaagccccatgtacctgaggtcaggaagcctccctgggaggtggaggtgctgttaaggagcagctggtgggaacccccaacgtgcttctctccgagggcctcaggggctcttagtctgccggctcctcaggctggggcttcctgcacccctagcgcccaccctccaactctcccctgctgctgagrcagatcttggagcctcggccaggctgtcctagtcacaaggtaagtgtccaaggcaggcgtcagagtcaccagcagccacttgaggcctccttccctttgaattgagaggcatggaaaagggagcgtctgcgaggaaaggatggctgcatgcaggttccttgtcaggtgggtggggacgtgggacatgcctgacatcagagaagccacatggggcagggggatggggaaatggcctcctctgggcaagggtctggtgggacctgggggcatttctctctctttttttttcttgagacagactcttgctctgtcacccaggctggagtgcagtggtgcgatctccactcactgcaagctctgcctcccaggttcaagaaattctcccacctcagcctcccaagtagctgggactaccrgtgtgtgccaccatgcccggctaatttttgcaattttagtagagacaaggtttcaccatgttggccaggctggtctcaaactcctgacctcaagtgatctgcctgtctcagcctctcaaagtgctgggattacaggtgagccaccgtgcccggccaggggcaattgtctgctcgaaggcacatgttccccaacagcctttgagcgtgggatcaagggagtgcagctgtcttgaggggcgggacagcccgtggcgagggacagtgccctccccatcaggagctcagtgctaaccgtgcctccactgtgactgtcacggtggtcagcctcatagtcatcatcaacactcctgccactgtcgtggctgccgctgcagtgagctcagtgcctgagacacaacacatggatccagcggatccgatctgccttaaggggcagcactggtgttacagaagcagcagctgaaggcccgagaagtcacttgacttgtcagggcctcggccgtgtgtgcagagctggtcccgccctgtgcttcatgcccyctatgcctctcactgcctggtacatggatgcatcatggcaggaaagtggaaaaacagccccgagctgcagcacggccgactccaatgggccggaacgccagccttgctggcaggaagaggccctccaagcgcctctcgtggatccggcccagatccggtcctgaggcccctcccaccrgagcctggggtgccctcacatgccctgcgccaacttcgcaacagcccagcttcccggctgctgtgtgccctgcctgtgtcaatattatgactggacttcctgtgggtcaggccgcacgtggggcgtccgcgtgaggtagccacgtggaagtggtacccccatgtccttgagcccactggagtctgtcccccttgccatcctcgggagcccggtgcggttgtgcccccctcatatctctgggcctctcagcacacaggtctrtcctgcctttgatagcaagacggaccygggcaaggttcctggcttctccgagccttggtattctcatctgtgacccaggcacagctgcctggctcactgttgcaagggccgggatggtgcctggagtgggtggtgcctggagccagctcagcgtcagtgaccctcgtctgttccctcttcctacctccagycttaccgtccgcttccccctcgggcagccaccccagggcatctgttgtggaactgctctgtgggttttgtccttgatacctttccaggcttcttcaggttgggctcaggcagggactcagggggacttagcttccagcttgcagcctcaccgcttgggttccggctgtggctggccattcactgtgctaagcttcgtgccttggcgttcttaactgtgaaagagggttacctgtaggttccacctcctgggtcgtgtgaggatgtgacacactccgtgtgcagcacagggagccaggcagagttgaagcctgaaaaatgtgagctgggagtggctgttgtcctctgggccctgccccacggtgcccagtgaatgtttgatgactgtggtgtgtgtgggtcctgcccatcatgtgagactccctggaacctgaggcaaatagratttgagtgtggggtctggaggaagggaggagagaggggagaggaaggcgcggccggggtccttgctatcttcagtcacactgcacacattgctgactcctagacgtgtgtcaggccaggcccagggttcagggatcccagggcccaggggatggttggttaaaggcagtcttgggagcgggaaggacaagcggaagctcaggcagcgtgtakgtgarggtggggtgaggtggaggtggggaggagtgtcgaggggaggctggacaccctgcccctgtggctagggcagcagggagcctgtgtagacaygcagctggtgtggacgcgaagggtggcttggttgggacctgtcacccggtcaccatgctgctccttggctaggcagggctattcctcaagggccagtttggttaaaaggtgatgatgtctgcacagatgtggctccaaattccaccatccccaggggcccgcgcccccattcccggttctctaacccctccccggggccggtgtggtgaagacagcacagcttctgggccccaggcagcccctgttgctccttagctatgtggctttggataggttasctgcctacccttttctggataggtacctctgtctccttttccgataacctctgccacagcctctgctgtggcatttggtgatgaaatgagaccatgtgtgccaagagctggtccaggacctggccccggctggcgagtggcggggatggggcggccccttggtgtctgctcctgcctcccaggcgggcagctcggcctggcccagggcacatttctcctgcacccaggcatgttcttgcctctggtgtccccgaggctggggcctacagcctttccatcgtacttggcacactggaggcctccctgtctgccttcacccgatgcctgccttgaccatgtgatggtcaaggagtgcacagtgtacagcacatggggtgctktgcaaaggacatgccccagccaggtcaccggggatctttctggccaggtcaggccgtggcttcgctgtgactgtcttggagacygggtcttggcgggcctggtggaggccttaggtggggtagagtagccggtaggcctcagaggctttgtccacctctgacttcccagcactcaggtggggcccactcaggccaggaagagcaccgggccactcgcagccgtgcagcggggctccagccccagtcacaccactgattggcctgggcttgccgtttcactgctctgaaccataggttccccactcagaaactgggagggcgtggggctgcatggtgggccttttctgcccccacacttctgttgccatcctgttctcgggctcccctctgtgcctagggtttcctgggaatcctggcccagactcactgataaccacaaatgcccacccaatccagaggccacaattcctccacccctacttggacgtcccttaccagccagaactggccttcatctggccccaccagcctttggcacctctgaggactcacaggcccgtttcaaggagctcagtgctggactgcctctgacccctgtccctctccacaggtgcccaggctctggctggcccccttcacagcgggttcccttccccgacaggcctctgaggggcaggcacccgctttaaacaggctgcctggcttccagtcctgttctgcctgcctcgagcaggtcagttagcctctgtgagcctcagtttcctcttctgtgaaatgggtacagtggtsttgatctcaytggcaaggcttgcatgggaagtcctaacgtagtgttccttcagaccccactgcctccagccctccccagggtccccttttctgaagtcctatgtcttggagccaggcgtggagaaggggctgggaccagcctcgccagcacacttgctagctgtgcagccccggcgggtcataccgggcctctgggactcagtttccttgtctgtaaaaatgggggggagcgtaagaagctgcgacggggtgaagtgagcagagacgaggtctgatttggattttgtgaaggtttctgcaacsatggcagggatgcagagagagcagggttgggatgggatgcattttggaaatggtgaaggacttgctgatggaaacctttccaatcagacttgctaagaattctttcgtgcttctcttaggaccctggttgggtgggctgaccttggagtggtgcttcctgctaggtggtgggggcagkctctgggaggggtgtcggctggaagggaccttgttatagtgtacrtggagcacctgaggcctaggagggctcagaaatcactacaaacccgttgtcaagccaggctccggtccactctgctgccctttctttttgtttttttttttttttttcgtgaractggttctcactctgcctgggcaggagtgcagtagcgccatctctgctcactgcaacctctgcctcctgggctcaggcgatcctcccatttcagcccaagtagctgggaatacagccacacgtcaccatgcctggctaattttttttgttttttgttttttttttttgagatagagtttcactcttgttgcccaggttggagtacaatggcacgatctcagctcactgcaacccctgcctcccaggttcaagcaattctcctgcctcagcctcccaagtagctgggattacaggcgtgtgccaccacacccagctaattttttgtatttgtagtaragacagtgtttcaccatgttggccaggctggtttcgaactcttgacctcaggtgttccacctgcctcagcctcccaaagccctgggattgcaggcatgagccaccacgcccagccctaatttttaaatttgtgtgtgtgtgtgtgtgtgtttgtatgtgtgtggagacgggagtctcgccatgttgcccaggctggtctcaaactcctgggctccagcgattctgccgcctcaccctcccaaagtgctgggactgtaagcatacgctcctgtgcccagcctccactgccctttctttccgtgcctccagctggctcctctgactgtcctgcagcaggaagctactgcaggtgccaagctcttggggttctggtgtttagcccagccagccaagcatggttctgtccctagctagtccctggccctccctggccattcgcttagagatgccatttcctcctagtaaaccctggggagggtgaggccggcttgaagctcagcttggcagccatgggctccaggagccagtattttccctcgggaacacctgacagtcccggacgcctggctctacatggaactgggagagtggcctgtcattgtcaccagcccctgcaatgtccccctctactccttggtgctggcttgggcccaccccatttcagtcctgctgagctttgccttggttctttattcattcagcaaacatctcctgggcatttgccccartggaaagtactgttctgggcgctgtgggcttttggccatgagcaggaagttgactccggaggctgcagggacctgcttaggcatcctcattaccgcctgggtcccagagcgagccaggagcctctgaggcagcrggggcttctcaaccacacacctggctctcctcctccaagactttctgcgtgcaccagcatcttccattttgtgtttcctgtctgtttaccatgtgtaattttgtcagcatgtcacgtycctttcataatgaagcaagggacaaagaaacaagggccagtggagcccagtacagggtggccagaggtgtcggctctatgtaggtctgctgctctggtgtgtccctgcgtgagggtcaggctggggaggtggcggcaagaatcagccaggcaggaaagactaacaggctgcccagaggccgggagccggtgcatgggtggtagtggttgggggcattgctgagtgcagaggctccgggggaaaagccaggggttaagggatgccaggcaggcatctgacctgggactgaatcctctggcagcaacctagaagcagctcagcaaggtgagggagatttgaggcatcagaggcaaattatgtcctcttagagcccctgcggatctgccaagactgagggcttctctgtctcttttctgcatcctgtgcttggctgaagatgagaaccttgctttcccactgagaggcagtgggccacagcactgcgggagccacgrcatctgcagacgcatttgatttccccattaatagcaaagctcccactccaaggatcttccagcagacaaagggcattttaaccttcctctcagtcccagttgcttggagtggctcatgtggcctctctgaaggagggaggaggcttcagacagccccatgcatgttcagaggcaacagaaatttgcaggaagggccaggcgcagcggctcacacctgtaatcccagcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctcycatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatcyagccacttcagtgcgacgtgtgactgctgcttgtgcccttccccaggagtggctgtgttccgctcatcatggaggcctggtgcccggcacagtgcgcagcacttcaaggcctcagagcatgtttccttaaagccacatcatctgtgaaaggagcggagcattcaagcctgctggctcttcccaggcagagggagacctggaggagaagcccagggacccacgcatccccctccttctatgggagccactctgcctgccccacccagatgccatattcagaggatgggaggcagaaaaacaggtggcttccgccccagagggcgagcatttgcttctgtgtgatcggagggcagcacaggggctggctgggccctgggatsatcgtgacaggctttagtggtctgggtggatgggccgtggtcagagccgatgtgaccaaattggctttcaggggagcccaggccaccttctgagtggaacccaagcaccagcataggtcctggaggggccaaaggaaaagggaggttcagactcactcaggtgtgaatgctgcccctgcccaggtagggacatggcacccccaccctcttctgtgatgcaggcctagaggtggcagttctggaaagttcctcctcaccttgcaggggaaactgttgaggtggagggcacttgtccagggcagcacactgtgacaggtgggagccgaggctckggaggtgggccgggctgagctgtgacaggtgctggtgagcatctcctccgcttccccgtgctctggcygtagcagaaagtgtcccactgctgtctccaggcagctctggctcttccctaattcggccccatccctccgtgtcgcccttcttcttgggggtgggtacagtgctctgcagagctccatggcttcccagctgggtgacatggacaagccatgtcctcactctgggctccagtttcctcctctgttaaatgggcatagtgggagtacctgcttgtaggatcatcgtgagaatccagtgagttggtccctctgcagggtttagagctgtgcccattagtgctcaygcatgtgtgtgtggtcactctggtgcccatccgcatccccagtggaggccgtgcatggccttgaatgagtagctatgtgctccctttcacttctgtgctgtgggacctttaaaaaaatctgctggccgggcgcgatggctcgtgcctgtaatcctagcactttgggaggccgaggtgggtggatcacctgaagtcaggagtttgagatcagcctgaccaacatggtgaaaccctgtctctactaaaaatacaaaaattagccaggagtggtggcgggcacctgtaatcccagctactcgggaggctgaggcaggagaactgcttgaagccrggaggcagaggttgtagtgagccaagatcytgtcactacactccagcctgggagacagagcgagacactctgtctcaaaaaattaaaaataaaaataataaaaatttwaaaaatctgctgaattcactctggccgtcactgatgaaaccttgcagggaagcggctccgttgcctcagcctgtgccgctcgcagctcacgtttgctggcttaaaagcagccagagcagggaggcaagctgcccacgctgttggcygcgcactctgcctyccgaacacgttcctgtactgcttgccgtgcacggagggccacgttcatgcctttggggccacgacagctctctctagagtaggacatgggaggggggctgtgaacatctggggcagcatcttctcttcatggattgtcaggaactgcacccttgtttaccgagggacagaggccagcctcccactgccttgtggytgaggggagggggccgggtctctaacgctgtcttctttgtwctgaaaaccaaacaccttctctgcacaaggtatgtctgtgagagaaacagacaagaggacagaacggagcaggtgctgaaagggttgctgttggctgcaggatcccggctaccaggccccgagcctggcctctgctggccttcacagccagttcctgctcacgggccaggtctcaggtccagtgcctcctcccgcagaagcctccagaccctcctgcccagaggagccccccaccccacccctggctgggtgtgctctgggtgggagggctgtgactgccgggcagcgggsagggarggcgagtggttcccccaagtgcggctcctctcctgtcgtggcagggacatggcagctttcaggacaggcagaggacatagtagggaactgaggagagttgtccagagaagtttctagatttggctcagctttccacgtagggtacagacctggaagggaccgtctggccacatctgactgccaagtgctgccggggagaacctgctgaaggtgctggacgtggctgtcctgcgagaaggccacgcgtgggagctgawctgagcagggggtgctgggtcaggttagtgctggccattgggtggacgcgggcccatcgtgggcttgtgagccactgtgggcttaaaaagtgcagagttggggggatccagagtgaggggctggagcacaatttcatgtgaggggtcattctgggacagtggcaccacaagcagacccgggtggccgctggtaagggcctgtgtgtgtggttgcctaygctctttccatctcttgtcggcttctcacagcctccacagaagacagggatagttacagggaggacagggaaagtccgaagtgtgcaggcgccctgcatcccygcagccaagttctgggcggacactgccctgagccaggayggtgaggtgggacgccttccccacccagctgccagatcacccctcctggagggtggggtggggccctgacaccttgttctttgtccctgccccaaactttggggcctgaatagaggaaggcagtgacattaacttcttcctggccatggatacaggtccctgaggacaccgtgtgtggggacagcaaagccttcctaatcccccagccggccaggcaccttcacacctaaatggaaacctgcatgctggtttccatgaagaaaaggttgcgattggggtttctgggaggccagtgaggggttgggactctacaraggagagtggactcacggggcgctgggccgccctccagccaaggctcctggcctgggggaaagggggcaagggatgagggatgcagggagcagtgtgttcagaaaaggttgttycctgagcacagatttgacacctcttcactgtcagckctgagacacgcccctgccctggggagctcagaaagtcaggtgcgggatccagtggcctaattttagatcttgggtctccatgtcgaaacgacagcagagtgattaaaaaagaaaacgacagcatggccttgcccccttgttaattatggatcaagcacatttccatgagaggggcatctccacgcagggccaccgtggccgcatttctgcagcctgcaggtctccgtggcacccacaccccccaaccgggaatgggggtggactccccaccgccctgatggggcttgggtgcgccgcgggtgaggagcagcgtctcacccacagaggtgtctcctcacggggatcagcaccgggtcagggatgggagggacggtggtggccgtttcaggcaaggcccttattagacatgagaatcccaaatggcagatgaaatacccatttacccaggaccctcgggaggaacccattttgcatcagagaattctccagtattcagtgaaacttttttttttttgagtcagagtctccctctgtcgcccaggctggagtgcagtggtgagatctcggctcactgccacctccgcctcctgggttcaagcaattctcctgcctcagcctccctagtagctgggattacaggtatgcgctaccatgcccggctaatttttgtattttttgtagagacaacctccacctcccaggttcaagtgattctcctgcctcagcctaccaagtagctgggattacaggcacgcaccaccgtgcctgactaatttttgtatttttagtagagacggggtttcgccatgttggccaggctggtctcgaacccctgacctaggtgatctgcccgcctcggcctcccaaagtgcaaggattacaggcatgagccaatgcgcccagccttcagtggaactttaaatgcctgaagtttttttgtatcrtctytttaaaaaattaaccgtccgtctcagtctcaggtaggttccctgccctcctccatccaaccgtgtcatggtgacgaggggtcgctgaccagcagctcaccagagctgggacacacggccctcatgccctgcgctggtggccgagggtgctacactttttcaggactctccttgttcagtgtttctggcccctccttccagtgtcacattgctgcttatggtgcctggtgcctgtcccgtgcccctcctgttttgctgctgcttatctgctgttcggggcatcctgtgacaggccagttggaatcctacrtagagtgaaagcatctcagccccagacaggcccgaccactcccacgccagcttgtcttctcatcagggactgggctgggctgctgtggaggcctgcaagcccgcgccagcttctccaccctgctgggcctcagaggcgcctgtcagctccagctcaccaccrtgtgtggccctctgccccttgcctctgggacaggtttagtctgcagttattatgttcaaaattttaaaattttaagcagttaacactgatgcrtgatgaaaattccaacagcacaaaaaggcagatagtgacaatgtgccccttgaatccctttcccctgaacccctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactgsacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacrttccagaggkgggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatrgttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaayaaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccaccctccacacactgcccagacaggctctacctcctgtccttcaagacctgtactcggccggactcggcggctcacgcctgtaatcccagcactttgggaggccgaggcgggcggatcacctgaggtcaggagttcaagaccagcctcaacatggagaaaccccatctctactaaaaatgcaaacttagccaggcgtggtggtgcatgcctgtaatcccagctactcaggaggctgaggcaggagaattgcttgaacctgggaggcagaggttgcggtgagccgagatcgtgccattgcactccagcctgggcaacaagagcgaaactgcgtctcaaaaaaaaaagacctgtgctcaccgtgaagccgtcacagactctggtatgaatttagccacagacttgatgttctgatgcctcgaggagcttctgggtccctcaagggcccaggtgacatgatctccagtgcagcctagagctttggaatccctcttcctcccccagacccctggtctccagaagacccctaggagcccagggaccattctagaatggcatgttgtatacacgctgtccctccccactggatggtcagccctcaggggcagcacggcttggcccagcctacccagcccagggcattcaagctttggcctcacctagagccaggctggacgccagcagggctgtgtgcagcttggccagctttggagctcccatctgtggactgccgccatgacaatagctacctcaaagtgttcttgaggaccaaaggaagtcattccttcccctcgagggaggctggaacctaatgggtatcccgggaggtggggggaggttcggatagaacatcccgctgctgtgcgtgcagcagagtggctgccatcagatttctttggggtggcctgcgcactggctctgatttgatgacgttctctgtgttttccaattttcttcttgctctttagctccttccttctggcttctccatcttcacatttcccacagaattcagttgtgatttagattttccatgcccctcactagcgtgttctggctcctgtcatgcagacaccttacacttaaataccaagtccgagataaacctgctttcagttcacgggcgcttggaggtcctgggagttctgtccttgagcatgaggaaggagatgcacagggtagggccctgtggctgtgccccagacaggaggaggaggacgaggaggatgaggaggaggaggaggaggaagaggagggaggctttccagacacacaggcagggctgggggagccatgcaggagataagccaggctgaacttgggacttttgcacacaatgcttctctgcctggaaggcccttctttctgtgttctgtgtggtgtctgcttttcatcctgcacgccacagtgtgaaggtcacctccctgactgccctcgctccaggttattctttctcccagcaccctgttctttggcgagcgcatctctggcatcatcacacagagtccatgcggcacagacaggaggcccccttgggcagaggccctgaacgcctcgcctgcttgccctagtgccccagggcctggcacttggcagccctccatagctacctgaagaacagatctgtgtgtggagaggggtcgggagctctgcactttgggaggactatggctggcatttgcttgcagttggggctggtttgcaaatatttctctctgcctcagcaggtgagaaatagcacctcggagctccttgcctgttcaattatttcygattgaattaattatcctgcagtaacagcggagctgctaatagggaacattgggtgccccccaggcggagcatgtgsctcgagagcacgcctggagctggagaccagtgggcagcccagctcttcgggggcgcaggccccctggagctcttctgacgatgggcagcttcatcctgcagtcaccagtgcatgcagaggtccagccacggccacctctttcttttctgtcctttaaatggagagggtcagcacgtagcaaatgaaccaactttgctttgactgcagctgtgaagataatgaggcagccttggttgtcatctaaactcagcaatggtcgagagctatttgggatttcctggcctgcttccaaattgcaagccctgttgggctactaatgccccaccttgtcccagcctctctttggccataggctaggccagccccagggtggacagggaggctccccagggtcggacgaaggcaggcgcctgtgagcagaggcctgggggctggatgggtggcaggtggmcaggccactcttcctagcccagctgatgccatcccgttatcttgtaattttcttcccggggccttatcagccttattagcaaatgtcagaaacaatgagagtcacttaaacctgatcatgcccactgcaccccccaccagcctggcaccagtttgaaccaagcctgcttctgaaaatgtggtggagaaagccctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgctgtgctgggagtgagcccaggcaaggtggcccagggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtmcatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgamagcacctgtaatgtaggcaggcaatgggctcctccaggtggcaggaacacygtgaggagcatgcaacgtgctggagaccatggggcatgtgacctccgggcacaccctggacagacctgggtgagaggtggkctgggacgccaggacrgtgargggcttcaaggtgtgtttgtcctttgtccttatacaggtgacctgcatgggcgggtgaggtccatcagaatgctctagaacaggacaactgaggtcccggctgccccgctcaacacrccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcmtgcctgtaatccctgcactttgggatgcctgaggtcaggagttcaagaccagcctggccaacatggtgaaaccctgtctctactacaaatacgaaaattagctgggcgtggtggtgggcacctgtaatcccagctactcgggaggctgaggcaggagaatcgcttgaacccgggaggtggaggttgcagtgagccgagatcacaccattgcactccagcctgggcgacaagagcaaaactccgtctaaaaaaaaaaaaaagaaaagaaaaagaaacacaagctgggcttcctgcttcccagctgtgtggctttgggccagttactcactgtctgggtgcctccatgttcttgtttccttatataaaataaagttctttcctcgtggattgtcaggaggattctgtaataatccacaggatgtgttctgcatgcactaggtgctcaactttcctgacccccgtccagtgcccccctcaccgrccacgtctgccctctaagctgccagtcctataggaggcattaagacgtctagcaaggctgtgttctcagatgcctcgaaatgggacctcagccttggagttctctcctcccacatggaggcaagtcactgacagtcatctagcaaattgtatgcatggtcaagctcagaggttctattttgggtcaaaaaaggcatgagctggctgggcgccgtggctcacgcccgtaatcccaacactytgggaggctgaggcaagcaggtcacctgaggtcagcagttcaagaccagcctggccaacatggtgaaaccctgtccctgctgaaaatacaaaaattagctggatgtggtggtgcatgcctataatcccagctactcaggaggctgaggcaggagaatcacttgaacctgggaggcgaagtttgcagtgagccgagatcgtgcccctgccctccacctggggtaacaagagcaaaactccatcttaaaaaaaaaaagcacaagctggattttgccctttgtcgtgagagcatttcatgccttcatgaaagtcactgcagctgtgcttcaggcagagggcccgggatccaggtggcgtgcgctgccttccgtggccccttcaaagggcagccaccttcccagtgccgcaggagctcctggtctggggccacatgcttggaagggccactgaatgtggtgaagggctgggtcctggtactgagcctgttgagacttctgcaggattcactgccgtatgcctgaggaaggcagacgaaggaaaggacagtgtggagtgctcagcagagtccccatggtcgcacttgggaagaacgccctggcagtggacggtcagtggtcacatgcacatgcgaggccctcaggactctgtaggacacgacgtggcttctccacagtcctggggatcggaagcagatgcagaatgtggccgagtggcccgggccagggcctgagagtctgcattctgacatgcttccccggtggtgctgctggtctgggaaccacactgggtttaagtaactgatttaagtaactgatgcgaggaggccatgctctgggggaaggcagctggagaggagaagaatgatgtccccatgccccttccagcctcagagtcctctagacccggcagtgtgcaggaacggcagcttcactgcccatcccctggggtactccctgcagccttgggccctgctcctgcaacggtggccgaacggtgcaaaggaggggrcggcccagtccctgcaggctgccctcarcctgggtttgctcatctgtgagatgggatcacatgtataatcctggctacttcacagagcccaggcgaggatctcatggacttgtgcatgtggaaaagccctgaaactgaaagattctagaaacaccaggattgtggtcactgtcattactggagggcataacccattcccctgtttttcctccatgaaagacaatcccaccaaaacacgaaggccctgccctcaatctgtttgtgtccttggcatggttcagcctgctctccccatggcctgagaggaaagcgttagccaggagggtagttggaggtggcgggaggtaatcccaggagcccgtggtgagctgaggatatggagaaggctcatctggggtgacctgagcaagcaccctctatcccaagccagtccccagaggccacgtaggcmcctgtttctggattaactgagcgggagctcaatcaggcaaaccaggttgcttggcacggtgtttgccttaaagaagaacaaggtgggccaggcgtagtggctcacgcctgtaatcccagcactttggaggcyaaggcaggcggatcacctgaggtcaggagtttgagaccagcctggccaacatggtgaaatcccgtctctactaaaaatacaaaaattagctgggtgtggtggtgagcacctgtaatcccagctacttgggaggctgaggcaggagaattgcttgaacctggtaggtggaggtttcagtgagcagagatcatgctgctgcactccagcctgagcaacagagcaagactgcatctcaaaaaaagaaaaagaaaaaagaaaaaagaggaaggtgggctgtgcccttctggctcaggcactgatattcaggggccagtaccaggcagatgagccctgggtgttgggctcacatgtctgtggcctgtcgttttagccttggggccaggggtagcagccgtttctctctgggcaaggggctcatgaggaaacgtttctgccttggcagcccaggccacagctgtgctggctgcagacaccctgggcaggccccggtcgctgaggagccttcttgggcaggttgcttcatctctgaagctcagaatcctttcctggagcacagatatcaaaatatttatccccagaagcctcaacaaacctgtgctcaccgctgctttaggccctgcagcagtcccaggtctgggcagatgtttcaagttcagtgtgtgggctctggctygctggagctgggcccagggaactggcgccttgggatgaggcccgccatgtccgagcctgcccatgccccgctgctgctgcggccggtggtcttggggctgcctgccagccttctctcctgggagctaagtggggacaggtgctgcgggccacggtccacgatgctccctgcttcctgtttggtgggcagcctgggttttaggaatgtgtagagctggaggagctgaaagagctggrgctcgggatcaggtggttcagctgactcgggaaactttgaggcaccaccgcacmtgtccgtgygtgagggagacatcttccttgcagggctctgggaggatggggtgcttctgtaatgcccagtcttgggcctggcgcctacctcatatgggtgctctatatagcagcaggcggagcacaattctgctaacgtcagcaacaatcctgtctgttggaataaacatgcagatgcatctgtgaccccagaatcccagtggtggctctgtccycgyctcagccgagcactcakcggccagggtggctggactcagcacggggctggcactgaaactggcagtcactgctgtcagtgcccacagamagcaagaagagaatagacaaataccaggcagtggagacactccctgcccactgcagatttataatcagcgaacatttactgagtacctgttgtatgccttgaggtgctcacaggggagcactcgggagcccattcactcgccagtgatgagtgggcactgtgccaggtgctgtccaaggtgggggagcgagggggtcactgcaggagagggtgagaaggaggctgcatgctgcacgaccctctgaaccctgagcctgcctggagaagtgggctgtgctgcggggaccctgttggagaggggcagcatggggaggggcggagcctgcctggggcctctcatcctgcagctgcctggaagttgggctccttctgacagtgtcctcaagtagacgcgggttctgggggtctggctggtggaggccagctggtgctcctgactcactggctcctctccttgcacagtggctgctgccacctgcctagggagtcttcctggggctcagttcccctgaccccctgggacataatgccagaactcatgctggctggccaccctccctcacgtgtgctgtgctcagcccgaagttggtgctttcacctgtgtgctctgggcaaagcaggcgcagaggaggcactgggatagagcgcagagtccacctggggcagccccctcctcgtcccggccattgccccatgttgggggtcttctgtcgggggagggagggttggagctgggattggaaggcccctctgaggctcttcttccttcctccatgagccctccaggccccaccctccatcctgcgcccctgccccatccccacccacggccagggctggctgctgcccattttggccccttcccttggggcgttgcttccaggttcaactcagattctgtcttttccagaagatgtctctgtccttccatgcccccagcctttgttccttgtcctcccctgtccctgcactcctggggtgggccctcctgctcccgagcctcctgcgtggaggctgtgagctccctgccacctgcgtggtcagtctttcctgcaccagcctcccaggacccctcctgcccacgctcctgagagattcaggcgccagtgcatgggtggggcacaggggctgcggcagacagagggtggtgatacaggggtggagtcccacaggccggatgccttgayacttctcagctgcagggctgtgcccggggctctgtgcccctgaatgagggcaatggttcccctgcacagtgaccttgtgagctgattcaggccccatgatcgtgattagctgacagcacattggccctcagagaaatgaaaatacacagttacacagtagcaaaatcccacgagcagtccctcagctggggcagggacacacggactgtggcacgtccacaccaaagaatcctgcgtagccacaaaaaggaacaagctggggatacatgtgacaccctgggcgcatcgcagaggcatcataccaagtgcaggatgccacagcctgcgcgattccatttctgtgacacttgaggagggaaacgggatggaacacaggacaggagtgtctggggtgggacagggaagggcccagctctgggttggagcctggagctggctggaagtgctgtgtcctgatgtggtggtggtatgcatttgtcaagactcatagacctggttggggcacagtggcttacagctgtaaccccagcattttgggaggccaaggcaggaggattgcttaagaccaacagttggagaccagcctgggcaacatagcgagaccccatctttactaaaatcaaacaacaacaacaaaactcacagacctgtgcattaaaaagggtacattttactttatgtgttaccttcataaatctgacctaaaaatgatttttaaagtccccccttctaaaatatactaatctttaagaaacaaaaacaaaacaaaaagctggctgacagtgggtcctactactagcacatgggcgttgatgatggtgataatgtctctcgcccataaaaggccagcttggaaacctgagccccagctgcttatcggcctgtgtagccagacaaccattctgccactcgccaaatattttcaaatttcctttccgaggcaggctgaagtccaggtaaatattgacccaagaaggcggatcacgctttgtgctatatttggttaatagttggagtcactcctaagctactttttcagttgctttgtacaggtgggtttgttttatgtaaaaagaaaagacactttaaaaagctgcgcataaatcagacatcataaatgcagtagaaagcctccctatttaaatgactcagcgaatcttctgatgaaacaactgcctcttcccctttaatgtatttattaatttttttttctttttttggagacagagtcttgttctgccacccaggctggaatgcaatggtgtaatccaagctcactgcagcctcaaattcctgggctcaagtgatcctcctgcctcagcctctcaagtagctgggactacaggcatgtgccaccatgcccagagaatttttcaattgtttgtagagatagggtctcaatttgttgcccagcctgaggcaaatttttagatatatattttatttaagtgagagctgtgacagcaatggcacaatactgcctctgtcctggcctgaggctctctttgccgctggtggccatcgtctttggagaagccgctcagcgtgtattgatggagtgacctccctgcctccctgtccagttgggctcaggtacccagctctttagcaccctccctctaccatcgtggggcctgcaggtcactgagggctgggagggctgggacccaggcccctgactggccccctgttgcagcgttggagagaccacctcagacascaaggacggkcatgccatgggtcccggcagcagctgtcccttcctgaggagggcgtttgccagctgaccactccctggtgatttctgccctgatcttccctggaggtggcaggttggacgtgaggatgaggtcccacccaagtcacaactgtgtgactgtcttccaagtcaacaaacatcctcctggaaggctgagtggcgggaaggaaagacacctgccttctacgccatgctgggccctgcagcaggcactgtccatgtctcaaatctccctcccygggaaatctaggcacaggtcatactgctggaaggcttgtctgtctctcccagtctcagggccagagcttccaggagcaaagagtggtccgggcctttccttctctttctcccactctatcttatctctcctcctgctttctcccagaagacaagtatcagggatggaagaggtggccacgtgcagagcatgactaatcagcagctgagtggcacacacacaggggatctcgcctgaggcctgggccagcatggggaaggcccctgcargctgctgggcacggggatggctcagggtcctgggctgggctgggctaggcttgggggagcccggtgtgttgggctggagctggcctctgctgtcgctggaccacagtcacccatggagggcaggggttgggaacctgcagggacagcatctgccctctggccggtggggggttcttagtagcagggcaaggggaaggcaaagggggccaggcccaggagcaggtgggkcctcctcacaggagcagggcaggattcgaggagctctgggctcccacctccgagctggactctgagcatgctggctccytccttctttccagggcagcagcagccccacattcaggacagagccatctgtgtaagcagggctcagagaccctcagacagacagggaaaaggagcaaaatgtattgtcatcgtccagcctgaaatctccagtgggacccgtcagtggagcacgtagcagacaccctgtccctcccgtgccccccggcctgtaagggcagctgaggccgtcttacctgctgagggagaccccgcactccctgacttcccgggctgggtgctggcactggtgaagggtttcgggctgtgagcctcttgccttccactcagactgggccagacccgacagcaccatgaaccagagccgccctgagtaggggctgacactgccaggccagcctcatcctgctcccggccataccaggtcccacggggccaatggaccatttcagtggatgcagggagcacagagcatgagtcgcacctggtggacgggcaggtgtagcaggccctcatgagaggaacaccattgactttcccactgggtgaggaagggacagctctgtaccatttccctctgctcaaacccacaggagccagccagggcatggacactcccatgaggtcacctttgctggtctgttccttgcggggctgctgagttcttgatagaggtaacaagcaaccctggggctcccgtgtgcaggaggaaggttggggactgcctggttgtgcttcggacccrgaggcagacagaggaggcctttgaacttggcctgagcttgttgggtgaagccaaggacagaggctggggtctgagtgaggggagatggtcccgtgaagtcagattggcacagattcccccatcagagttgggaggccccagaatgttcaggaacagcatgtggcaggggtcataactgaagccagacctgagttacaatccatttactcactgtgtgtccttggcaagtcctgcaagggaggcacactatcggacgtcccccgtggggctggcatgcagattgaataggatacatggctgcactcaccccagcgcctggtgtgcagcaggccctrtgccagtgtcggctgacgtcactgtgctgtgggtgtcatcagagcctgcatgccacagtcagtgcagtggcacagggcctgcatgccacagttaaggagattgtaggcccttggggagacagtggcagaataagggagtcgttgccagacactggaccaaggccctcacagaacccaagggagggcaggggcatcccctgctcaccgatggggactgtcacccttagggaagttggggacctgcctgagctcacacagctgggaaacagtgaagcctggatttgccttctaactttttattttcaaaaatatgcaacatacactaaactagaaccgtttaatgacccctgcaccaccgtacccaatgcccagcttcaagaattctctcacaatatgtcattcttgtttcatctgtcttctgccccctctccgcctcttccccttcactcctgtctgcttcctttcactagagtgttttaaagcaaatccagacatcaaatttcatcagtaaatatctcacatgcatatgaaatgcagaatgtatctctaacaagtaaggactttttttttttttttcttgagacggagtctcagtctgtcgcccaggctggagtgcagtggcgcgatctcagctcactgtaacctcgtctcctgggttcaagccattctcctgcctcagcctcctgagtagctaggattacaggcacatgccaccatgcttggccaatttttgtatttttagtagagacggggtttcgccacgttggccaggatggtcttgatctcccaacctcgtgatccacccgcctcggcctcccaaagtgctggaattacagatgtgagccactatgcctggccataagtaaggacttttaataatataatacattaaacattcagcaaaattaataatttcattttaaaatagccttacaggccagacgtggtggttcagcctgtaatcccagcactttgagaagccaaggctagtgaatcacctgaggtcagaagtttgagaccagcctggccaacatggtgaaacccctctctactaaaaatacaaaaattaaccaggcataggggcgcacacctgtaatcgcagctactctggaggctgaggcaggagaattgcttgaatctgggaggcagaggttgtagtgagctgagactgtgccagcctgggtgacagagcgagactccatctcaaaaaataaaataaaataaaataaaataaaataaaatagccttatagaggaataaccaacttacaacaaagtgcacctatatgaagcatacaatttgagttgccttttttagagatggggtcttgctctgtcgcccaggctggagtgcattcgtgctgcagcrttgaactcctgggctcaagtgatcctcccacctcagcttccagagtagctgggrctacaggcatgtgccactgcactggctaatgtttttatttttgtagagatgggggtctcaccatctggcccaatcttgtctcaaactcctgggttcaagcaatcctcctgccttggcctcccaaagtcccagagtgttgggattacaggcaagagccgctgtgccctgcctacaatttgagttttgatgtgtttctacagccaggaggcacgtactcaggttaagactgtgaacatatccattcccacctttgagatccccccagcccctcttgccctttctaacccaggctgctgctgatctgctttctgtcactggacattagtttgcattttcaggaattttatgaaaatggaatcatacagtatactctatgtttgtctggcttctttcactcagcatagttattttgtgggtgatggatgctcttgcatggactggtagttcctttttagtgctgagtagtattccattgtatccattcaccgtagtttgtttacttattcactggttgatggacatttggattgtctccaggttttgactattacaagtaaagctactgtaaacatccatgttcaagtctgcctggatagctgctttcatctttcttaagtaaatactaggagtggaatggctgggtcatgtggtggtaggtgtgtgcataacacttcaagagactgccaaactgggctggatgcagtggctcatgtctgtaatcccttgcgaggccragrtgagtggatcacctgaggtcaggagttcaagaccagcctagccaacatgttgaaacccctatctctactaaaaatacaaaaattagccgggtgtcgtggcatgcacctgtaatcccagctacttgggaggctraggcaggagaattgctagaacttgggagacggaggttgcagtgagccgagatcgcaccactgcactccagcctgggcaacagagcaagactctgtctcaaaaaaaaaaaaagagagacactgccgaactgccttcagaagtgattgtgccattttgcattctagcaaggagtgagcattctaattgctctgcttctctccaaccctctttacttttagccattttgtaagaattctttatgtattctagatacaatcctttatcagataaataatttacaaatatgttcacccattctgtgggttgtctttgtattttcatgatagaatcatttgaagtataaaagtctaaatatttgataaagccagtttatttttctttcattgcttgtgcttttggtgttgcatctgagaaaccattgctaaatccagggtcatgaagatttatacctatgttttcttctaagagttttatagttttagctcttacatttaggtctttgatccatttcgagttagtttttgtatatgatgtgaggctgagagtccaccttcattcttttgcatgtgaatatcctgttgtccttgtgctatttgttgaaaaggctattctttccacattcatttgttttggcagccttgttggaaatcacttgccatgtatgtggaagtttatttctgggctctgtatgctattccattggtctatrtctatccctatgtcagtgccacactgtcttgattactgttgcattgtggtaagtttgaaatcaggaagtgagtcctccaactttggttttttgtttttttgtgtttttttgagatggagcctcactctgtcacccaggctggagtgcgatagcacgatctcggctcactgcaacctctgcctcccgagttcaagcgattctcctgcctcagccttacgagtagctgggattacgtatgcccaccaccactcccagctaatttttgtattttcagtagagacaggtttcgccatgttggccaggctggtcttgaactcctggtctcaggtgatatgcctgccttggcctcccaaagtgctgggattataggcatgagccactgagcctggcctttttgttttttgttttttgtctttttttaaaaaaagattgttttggatattttgtgacccttaaatatccatatggatgttagaatcagcttgtcagttttacaaagaagccagctgagattctgattgtgactgcattgaatctctagatcagtttggagagtattgccatcttatccagtctgtaatccatgaacatgggatgtctgtccatttatttagatcttttgtttctttgaacaatgtttcattttcagagagtaagttttgtacttttgttatatttattcttaagtattttactcctttaattgctatagtaaatggaattgtttttttgattcctgctttcagactttttattgcaaatgtgtagaaatacaatcgtatcttgtggccttgctaaactcatttattagcttgaaatttttttagtggattccttaggatttttaatgtatgagattatgtcatctgtggatagagttagttttacatatttcttttcaatctgaatgcctttatttgattttcttgtccaattgccctggctaaaacctctagtacaaagttgaattgcagtggtaagagtgaacgtcctttcattgtcttgttgctgagtttagggggaaggcatccagtctttcaccattaagtatgatgttagctttgggtttttctgcccattgaaaaaaattgagttttttgttttcttattatcaagttctaagagttctgtatatatttttgatataagtccctcaagaagtatgtgctttgccaatattttctgccagtctatggctgatcctttcattctatcaagaatgtcttttgaagagaagaagctttaaaagtttggtgaatttcaagttatcasgttttcttttatgaatcatgcttttcatattgtgcctaagaaatcatcatataatccaagatcataaagattctctctagtctattttcttctaaaagttttagaagrctttatatatttagattgatatatttatatatagatttaggtttatatttctatttatagtccatcttgaattcatttttatattttttctgagttatggattgaagttcytttttttttttttttttttttkgcatatgatagccaattgttccagtggcatctgtggaaaggctgtcctttctccactgaattgccttagcactttgtcagacatctcaaaatctggttgtgttagttccactttgtccttttatttcagagttgtcttgagtattctaagttttttgtattttcatatccatctatttgtggtttccatctgatttttgacatagatgattattgttgtctgtgaataaagacaaatcctactgagacagactgagaccatgtctcataaaaaagaaaaaaaaaaccatttcagaataatgcgttagtgtcctagcaacctcagcatgtctgcctttagccagctggggacccttcaagtgtttcttagtgttcttctggcgtttccacctcgtctttcatagctttcagtctcaggttcaacatcttctgttcccagagtagactggaatcggccttttaaccaaggagctctggttatttttagtggaaaatgatatttggagaccacagtttgaatgctagggtgctcactgttccaggcctctctaggaaaaatgatttttttttttttttttttgagayggagtctcactctgtcgcccaggctggaatgcagtggcaccatctcggctcactgcaacctccgcctcctgggttcaagcaattctcctgcctcagcctcccgagtagctgggattgcaggcacctgccgttacgccmggccaattttttgtaatggaaaaatgaattttttagaaatagaaataaatcatgaattcataccaatatttcyacttcaaaagtttttgttcaacctttcaatttcatttttgtaccacttttataggaagcttggatcctaaatacagtaacataattaatgtgtatatagtcaaaataataataatatctgtattattaaatattttatcaccaacaatagatttactcgatgcagtctagaatctttctggktcttttgtcctcaggctgtgcggcaggagggaggattagtcaaaatactgtatttcaaaatcacttgaaacttcttatctgtgtttttaccaggtttattgattgagtttttggatttctagtagttcctttgttctctctctttttttttggagacggagtctctctgtcacccaggctgragtgcaatggtgccatctcagctcactgcaacctccgcctccggggttcaagggattctcccacctcagcttcccaagtagctgggattaaaggcacccgccatcatgcccggctaatttttgtattttcgtagagacggggtttcaccatgttggtcaagctggtcttgaactcctgacctcagstgatccgcccgcctcggccacctaaagtgctgggattacaggtgtgagccactgtgcctgccctgttcttactcttaattatgcaaaacatttacatggttccatagtcaacaaaggacatttgtaaatgtctggcatgtctcctccctcacctgtaggtaataattttgatcagttttgggtttgtccttcccctgttgctttttgaaaatgtaagcaagtctgtgtgtgtatcttcccccagcccctcttcatgtccttatacaacaggatgggtgcaccttccgcacttgcttttttacttaatgaatatatcctggagcttacaccatagcaatagatagaaatcttcctcctttctacaaggagcccttctccagggtggggctgtagcgcagttcattcagcccctccccctgccagtggacactggggtgggttccatctttatacgatgctataggtagtgctggagctagaatttgaactcagagcccatgttcctattgctctttctcctgtgctctgtgggccgtcataatggaggaggcggggagcaaaacggagtgaagaggttgagcatgagcactgaggctgggggaggcgagtgtcccccgctgtgccatggcccctcgggtgtgaagctgggtcatgttgctttgctggggcctygggtgcaggttgtctggaagtgggcagctggtgctgggacctgctctctggcactagtgtgctcactgcagggcgagagcttgggtgcaccttggacagggattgattcactggactagctggtggagtgggcaggtctgttgatctgttggagacaatgactgttggagccctygagcaggctgtgtcacgtggaagggcagttgagccatgtgctgtgggacgctttggatgctgccctgagctgccactggtcctatgtcctggagaggccctggcccaggttcagcagcactggccagattggggcagatctgaaaggagccagggctgtgcacacctggcaggacaggtggaactgggtgttgggaagggcaggtgtgatccaggtcaccgggccggctgggcctagcgtgtgcagagcagagggggctgacacggtgcgacctcggagagccgcctgttcatatatgcacttgcttgctggcccagggcctgcctagctggcagtgactgggtcctgtgctgggctctgctgagctcccacaaacacaccccatccactatgagccctggtgagaagggagaggggtccaggccccgctgggatgcgcggtgtggacagcacttggcgtgcacatgaagcttatgtgacggtatcacagtgaccttgatctggggctggggaggaaatgcctcgatgggctgtcctcatgctgctgggcctgggccatcggggccggcctaggggatgcccagtagccttggcagcctcagccatccttgtcaactccagtgggactgggggatcctgaatcccrcctcctgatgccagtggagccctgagtttctgttcagaaggccaatggagggctgggctccaccgcctctgaggtccctgacctctcataggttctggggggccagggtgggatgagggagagacaggagtcatgggcagactccctgctgccccggggacgtctcactcagacatttgtatgtcacctacaggtaccctgggggccttagggcccctcctctcttcatggagcccagctagyggccccctcccttcctggctccctgcaaggcgagggaaagaggagaggagagaaggcctcggagcgctgatgtatccatcattccacacagacccgtgcttgttgagtgcctcctcgggtggtagccccacgtgggattcagcatagtgcaggcagaggtggacacagtgtgaactgttaggcsacagccacatcttgccggagccgcaaggcaggagttcaggagtgagaaggcactggctgcggctcctggggctggaaagggggccagtcaggcaggcagaggggtgggtccagctgtagaagcgagatgggggcggttcgggargcaaaagcaggaaggcagaaggaagcttggagctcatgagcccctctgtgctggcgcacggcccacgtcctctaaacaaaagggatgggctccttcagtggttccgtgggcccttggcaaagctcgtggaaacaccagctcctccccagcattcattaccaatgcgaagcactagccctttgcttggggcattctagacccccaggtgcctaggctgggagccctgggccaggtggtgggggggtcctggctgtggaatccagatgggacctaccactgcagctgggtattaggcagatttagccagggaaggacaagktgagagaggaggagcttctgagagtccatcaagggctggccgcagaggggagaggcctggcagccggcgagcccagtgtggcacaggtctgtctgcctgtcctctccctggggacactgcttcacaacagactttcttcatcagctttgccggggcctgtcaggccaatagcttggacttagcctcttgactctcacccttttgcccattccaaaacaaaacaaacagcagcaccgccatgcgcccatgtgcctggtgtagtatcgttccaggcatttcatgggcaggaattcgcttaatccgcacagcagctctgtgacgcagtcgagagtattattagctccattttacagatcaggaaacaggcagagagaaaggaaataacctgcccaagctccaagctgcaagtagaggagccggtgtttgagcccagaacctggcgctgggagccacgagctgccctgctgggcactggggtggacacttgcccatcagtccttcagtgagtgcgaaggagccgtgtctcacttcaaagagggatttaaaaattctaccctcrccgggcacagtggctcactcctgtaatcccagcactttgagaggccgaggcgggcggatcacctgaggtcgggagtttgagaccagcctaaccaacatggagaaatcccgtctctactaaaaatacaaaattagccgggcatggtggcgcatgcgtgtaatcccagctactcgggaggctgaggcaggagaatcacctgaacccgggaggcggaggttgtggtgagccgagattgcgccgttgcactccaggctgggcaacaagagcgaaactccgtctaaaaacataaacaaaaataaaaaactcgactttctgcggcctcacttcaaggatgcgtaggaaatttgagagaccaataggaagtctctaggaaagggtcttgttcccagaagggggtcgtgcttcttgggcccttactgcatagctgggctggtgtaggccttgtggggtgggaggctgtgttcattgccaagatttgagaagccttggcttttatgtgaaaaacgctgagtgtttaattgttgatccaaatattttaaacatgctatgagtttgaccagaacacatcttgggctgccagttacaacctctgagtccaaggacaccaagaatagcaccctggaaagggcagggaagaagcatgggtcctggcgtggagacagaggccggagctgccacctcaggccagacgggcaccacgggcatgtgcatgggcagaggcygttcccatctgagtgggacccagaaggaaatcagacacagtccctgctctgagccacggatagggggagagacgggcgctctcacatgtcctgggccacatgccagggctaggagcctttcatccctcacctgctctacccctccttccacgctggccggggatcggggtggggggtactgtccgtcctgtttttcgtactttgcagctgactcagtttaggtagcgggcagctgagtgatttgcctatgaagtgctgtcggcttttggcgaatgtcaaggccaggatggtgtccctgggtctcgaccccattcctgttttcctcccactccacttgccttgggcctgtctcttctgccctagggtagaggctgtgggtgagatttgcaaaaaaagaaaaggagccggcatttggggaggagacctgtgtgttccagagctcagctgggaactccttgccagggtgtgggagaggctgggctactgaatggagcaaacacacacccagggcccggttgcattagggttccaggtcaacagcacagactgttttaggattaaaagcagtcccatgggacaggttgcaccaaaacattgtttgtttgtttgtttgttgtttgatacagagtttcgctctgtcacccaggctggagtgcagtggcacgatctcagctcactgcaacctctgcctcccgggttcaagcggttcccctgcctcagcctcctgagtagctgggactacaggtgcacaccactgtgcccagctaaatttttgtatttttaatagagatgaggtttcaccatgttggcctggctggtctcgaactcctgacctcatgatcctcccacctcggcctcccaaagtgctgggattacagacgtgagccactgtgcctggccaggttgttgtttatctgaagcttacatttacctggagggtcctggcagtgccggggagaggaaatttgagccagggtcacggagtgttgggcaaatgaatccccactctaggattctggaaatctagaagacaggcaaaaaccaggagcagtgagagcagagtgctgggccacgccgctgcctactaagggctcacatgcatggccctgggaggcgactgcgtccggcacccgctcattgttggatgaaacgagcagctgggctcccagtgaggacacggtggtgctgccaggcagggaaggaagttctgggagtcctgctggctgctggtttatcgattgcctcggaataacagccccatygaataccagttcgctgggaggcaaggcgtggtttcctctttttctttcccacatgggttagtcttgcttgatgcttttctgttgtcgttagattgttctgaaagctcatttagcatcagctctttccgaggctaagggacaggtgtggcctgggtctgttgggggaggggggctgtatgggaggctgaggatggcagagagaacccttgaaggaaaggtttttgttgtttttgtttttgttttttgagatggagtcttgctctgttgccaggctggagtgcagtggcgcgatctcggctcactgcaacctccgcctcctaggttcaagcaattcttctgcctcagcctcccgagtagctgaactacagatgcacaccaccactcccrgctaatttttgtatttttaatagagacagggtttcaccgtgttagccaggatggtctggatctcttgacctcatgatccacctgcctcggcctcccaaagtgctgggattacaggcgtgagccaccacgcccagctggaaaggtatttctttatcattagggaaatgcagaccaaagccacctgacacccactaggatggctacagaattttttttcttttctttgtttttgagacagggtcttgctctgtcttcaggctggggtacagtggtgtgccatcttggcttactgcatcctcaaccttctaggctcaggcaatcttctggctaacttaattttttttattattttttttttttttggagagacagggtctcactatgtctcccaggctggtcttgagctcctaagctcaagcaattctctcacctcagcctcccgaagtgctgggattagaggtgtaagccaccatgcccagtgtcccccacccctgaaggctataatttttgaaaagggaaaataactggtgttggggaggatgtggagaaactaraatcttcatgcattgctggtggggctggaaaatggggcagccactgtggcaaacagtttcacagctcttcaataaatagatttaccatgtgacccagcaattccactcctaggtgtatacctgagagcactgaaaacacacatccacaaaacacttgggcacgattgttcctagcaagcgcccgtatgttgcttggctttggccttggtcaccgtggacagtgctgctaacgcaacctaagtgtccatcagctgctgaaccggtggacaaaatctttatatactggagtcgtattcagccgtaagagggaatgaagtgcatttacgcactgtggcacagacgaaccttgagaacgttacataaagtcaaagcagccagacacaaaagaccatgtagtgtgtgattcagtttatatgaaacgtccagaataggtgaatccatagcaacggaaagcgatgagtggttgccaggggccggcagatgggggatggggaggacggggtttctacttggggtgatgaaatgttctggacttagaccgtggtgatggttgcatagctaaaaactactttgaattttatctcagaattggaacaaaacaaaacaaagcaggctgtggtcctgggcccccgcggtgctctctgcagactgctcctcttctgcccccaccccaccccacacattcccagcaaggtcaccgcagccccctcctcacccctgcagcgcttattccttccgccttttgagcttcccacagagtcagcagcggccacctgctgagacctggactagggcctgcttaccttctgggagaattggctgcagtgccaacagctggttgaggggaaggcccgggagctacctccttcacttctccttcctgtaaactttggcataccctgccccccgccatctgctgccccctagcctgccactgccaaggagctctgaggacaggggccagaggactcactagggagccaccttctgggagtcagtggccttgaggaaatcatcgctaatcactctcctgccgcaactrctgggaaaggcaggtccacttgggaagtggagcaggcagcagtcatcgctggggctggggtggaggtaggtggctgggagcaggcctctgaggctcttcctgtgcacacacaggcgcctactctgggcccacagacaacttgctcacatacctagagcccagcccctgaccccaggctgcatgcttgtctttttgcatcctccttgccccctcccctcctctccgttccttcctcagtgtgctgggccaggcccgggcgataaccagctcaggactgtggaaacagcaggcaggcaggaagagctcccttctctccaccgttggtggccagatgttgagattccagatgtgattagtttgaaaaaaaacaaagtaaaaggattctgaggctaaaagtcactgtttgaaagtctgtgccttgagaagagcacttgggcagagggaggagggtgaggggttttctttgctttgctttgcgcctgtgatggacactttgtgaggcccccagcggaaatttgggcctgtgctctgaaggccgcgtgctcctgcagccwtgggctcctctggcagttctgctggggcccttttagagtctgtgggatgcactcagcagctcccaggtagggcctgaggtcagaccccatgtgtctccccagggacagatcttctccrccagacgtctctttctgcctcttggtgggttcatggctgtgtctggttgaagagttgtttccagaaggaccttgttgtccgtccagatgaactgagcaagtgtgaaaatccctgtggaacttgctctagggcagataatgtgcagctgggrtgcatgtggttgttgctcccgtgtaattcttcttctttggaaatgggggctttggagcctgggaagcagagagaggcatgtgctccccacccccaccctggagtctccccaggaaatatctcgttcttgttctctgctcacggtttaggttgcacgatgggaacacaagacccgcaagctgagcagggccttcggatccccctacctggcctgctactctctaagcvtcaccatcctgctcctgaacttcctgcgctcgcactggtaagcacagctctctcactggggagccacaacccctgggctagcgggagggccgctactggtggtacctcatcccycaccacgcgggagccttgtgtctgagcactcaggggttagctctcaaagccacctgccacagcaagccaccctacccctcccagccgtttagactctggccagcagaggagccccagtgacctcaggaatgggggtatgtgaatggggggcaagggacaatgcctgggtggtccccaggtcacatcccagcctctgccacgtagccaaggctgttttaggagtctcctccaggaagcrtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccrtctctactaaaaatacaaaaattagccgggcatggtggtgcatgcgcctgtaatcccagctactcgrgaggctgaggcaggagaattgcttgaacccaggaggcggaggttgcagtgagccgaggttgcaccagtgcactccagcctggggcaacagagcgagactccgtctcacatttttttttttttwaaaagaaagcttctttgcccatctctggacttgggacaggcaccttcctgctgtcaaatgaaaaggtcagagaagaagaactggaactagatgatgaggcacagcccactgcacttgggagcgaatttctctgcccagacaccaggctagacaaggcccacctgcgtggaatgtgatggctgcaggcgacctggggatgcaggctgtgcagggcagctgccccatctctgggccccggtctcacctcccacagtaccctgagaatcattgcgcacggcagctcatggactaaacatggaccacgtggttctccaaaaaatgagaaactagctgcaccagagaatccccatttttgacttgtcgagacagaccagaagttstgtgtgtgcctggccacaccccacgtggagcgctcactggggccgaggcacagctgccccctttggatggggcgcgtgtagcctggctctccccattgcccgtggccccatctccgtcggaccagcctggcttgcaggcactgggtgcacacaggaaggggcctgygaatgctccatgccagcacgtgcggagccrgggcaggccttgctggtggtcaggcccctcacacactcaccgagggtggcctaggccttccccctccgtggccaggcacccttgctgccttctcgtcattgtcatggccttggccacaggaatgtgggtgagcagcgtggtcagggtcctactgaggtcagccttccgcactggacccctggctcctggcctttgcttcttggccctttgggccagggctgcctgctttctctaggcctgggtggctatcccacggtcttggtcctcagaggggtgggtcccctggcacctgccctgggttgaatgatgtgaagaggcttccccagagagggcttttcacccctcggagggcaaggggtttggcccatggcaccgcctcggggcctgtgcgtctgcacagcctgcatgcttacaatcttctaggctctccggccccagggagcattttcacatttatagtctctgggtagagaagactctgactgtgcagatggaggaagtgaggcttggaaagaagcaatggttgcccgaggttttacagctcatgaagcgctgaccagcattggagaacaggcagcttccagctcagcagtggcttagggagaaaagattccatccatttaggccagaggaacctggcaggcaccggcaccacccaggctgggttatgggagcatcaggggacgggagatgggcctctttcctacccatgctgcctcttgggccaccggcagagtgtccctccttacccaggatggggccctggctgcattggcaggacagtcaggggtctgtgccctccagcccccaggcatccacactccccagcggccaggagggagggggctggtgctggccgactgaacgctcagagcttggagtccccccacaggaacagcgaggctgaagacaggtggagggctgcagagggttgagactcagcccagggctggcacgctgagctgttccaccactcctgctccctagagcatgccgggaccaccatcagggccggcacamagcaggagaagtgggctgcagcccacagcgcacacagatccaggagcagctagaccaggccaggtgactgcccagaaacaccggccagcgccacaaggcagctgccttgatggagcccctcctgccagccctgccccgggagctgctctgagtctctgctgagttctgatttcctgcgcaatctcatcttgcactagaaaccccagaggcttccttgagtcctccccatcacctccctgctggtccagcagcacagcctgtgatctgcctgaccctggaggtctgcccccgtcatccaccccttttcaaggcagagagtagagggccctggaaggggtcatccttcctcctccaggccccagccgagtgctgtgtgtacctaggagaccagggggacaggcccacccacagcccagttccagccgtagacagcagcaaagcactgtctggtttgttcttggatcccggggcctgggagtcctcctggggtagctggaggaagtcagcttcttachgatggtggctcccagctttccctcctctcatatcagcgttggcctcacctggcatctgcccagccagcagggccatgacttttggttgaactggccacccctggattttggggaggagagaaaggatgtcctgggctgcttttctcctctcaccttttgygttcagaggcagaggtgtgccctggtcctcactctctcccccactgttcttcccctccaggcccctgcctgcaccctatcctgccatgtccctggtgacccatccttccygcccacacctgccagtgtgaggcacacaggtggcaggtgctggagccggaccgggctgttgggccaggctctgacagraccctcgggaccagctcctgcatmccccacacccccacaccctttcccatgcatgcctcgcttcaryggctgtctagaggtgggtattcttttttgtgcagtaaaatagacataacataaactgttatgaaccattttaagctttacaattcagtgacatttagcagcttcccgatgttgtgcagcccttcctcctgactagtttcggagctttttcctcaccctataggcctggagcagtcatctcccgccccccagtccctggcagcactcgtctgctttctgtccccatgagtgtgcctgttctggacctttggggtgtggcatcgttctccatrggagatggcaagctttgtggggtccaggctgtgctcaaaagcctctgcacccagcaggagtcggttggtgggcagagaacacaggcacgtgcttgagccaagcctgggtcatggatgggatgtccgagaggccaccagcagctgacctgccagcgggtcccaggggagagtaggtcactatgttagcaggtctgcaccagcagtgcatccagaggtggtcaggggaggcccggggcaggatgagccactgttatctggaagcaggtgtgctccatccagtcccgaaggggccattagcacagacctgtttgctctggctgtggagtgtgaatggggaggaaggctgatgggctccggggcacttgttgaagtcccttgcctgagctgccccctgcacagctgaacttggccagctttggctggaccgctaccctctgatgagccacaaggctggtctcgagaaagcccacgggggtgggcgaggcgtggatggccaggcagggctcgaaygggcttcacaggactgggctgcagcccttcctccctcctggctgtgggaggagacagccgagcttgttagggcatcagcgagctcctggtgtcgttcaccagtcacgggatggaactgtgctccagcgcacatcggaattgcctggagtctcccagggctccctctgggtcttctgaggggagaggctcctgtgtgctctggtgtggcgggcacagccaggctaagaagctgcatcctggcctcggagtgtggctgtcgatcaggaatcttcctcaacctggaggtattcccaggctgggctaggaggcacctggaggggcagggtggtctctggaaggtggtctgggtgggtggggtgcaggcggagccctggctgaagaagcsttacgaccaaggcctggaggagtgagccggctcttcagatggctgggcagggcccatgagtcccaggagagggcggcccccactcacaggctgggcagcaggggcagggcaggtggggactcacctcagcgctctgtatactagaggccgtggggcaggtgcaaccctgtgggacaccagactcaccccagagcccctctcccctagggaagtctgttttcaaaaactccctgatgattctgaggccaggcctttggggactgtggccctggaggaggctggcacaggtggccctctgtcctggtgactacatgtcctggtcactgctgcatcccacccagtgcctggccggacctgctcaaggatgtggtcaggacaggccgggggttgagcrgctgcatgaaggagggagggcatggagctgatgggacagtttgcttccgatggagcaatggagggctgggcgtgtgcagcgttccatggcagaaaaaagcgactcctgctgtcttggcagaacaggccagaatttttaaagagtctgtggactgggaagccaagtgtattagtttccttctgctgtgtaacaaattcccacacacttagggcttaaaccacacaaacttactatgtgacagtttctgtgtccaggaggctggatgcgggggcggggtctttgcttagggactccccaggctggaatcaaggtgcctgctgggtgtgagctcacccaaggcgtggtcctccactctttcgggttgctggcaggacgcgggtccttgaggcccagctcctggtggcctccccgcagcacagcaggcagctctgtggctttggcttttggtctctctggcttctagacccttttggaaaggcctacccagggtcacctcccttttgattaactcaaggccagctgattaggacctgaattctatttgtgaaatcccttcaccagagtgatttcctcgmggcaggtgcctggggtagycactgggcggggtccatgagggcagctggagagtaaggggtggggggrcacttaggacagggaagctggcataggctttcctgggcacaagggcccccagctgctgggaaggaaggagggagaggggctgcagttcggcaagagtgggtccaggccctggtagaccaggctggtctggcacctgaggggctgtggctgggaaggagggaagaggcaccctccccatccccaaagcacacacggccaggaagtctggaaggagagtgggtgtcagcctgggattcccaggtgctaggggtgctgggatactgctgcctgttgtccttggcctgcccgtgaggcttgagcctatcccactgtttacaggtcgtgaggaggcaggagagccatcctgcccctcctgctttctaccatctgcttccctgtttgtaaaacaagacagactctctctcagctattgatgggttctggaaacactttggaaaggtgacgtgttattcaaatgctcagaattagtgcagcgtcaaagcccgaaattcaagccctttgatggtctcgggggttgcatagatgaacattttttgttttagtagttacatgcttattttaatatgtcttggaaaagaaatgagcccatcagacgactcatttcatggctagcgtcgtgtagctgagatggagtggaaagagcgagtcactccaagcctggggtgaaggatgtggagtacatggcactcaggccacacatggatgtggacgacgttgcggagacaccccaggatgatcaaagtcagggaagtgtttctggtcggctgcagatagaaacgggacaggcctgtcccaggtggggccgtgtgcctstggcctggtgtgtggcccaggactgctggctggggacagggcggggacactgagggcagtgatgccccctccccacctccaccccagggtttccgggattttatgggagcagagtgcagacagcctcaaatcacattaatgactgaaggttcaatccaggtcttaaaaatagaacccaaggcaaatgaatgagtctccgttccccacccctagtgcggaatacttccaagggaaattgcgtcctatattacctcattctgttagggagcttgtggtcacagagctactcatccatccactaattttccctgtggaatggacggactgtgctttcctggcttaatggaggagctagaacactgtcgattgcctaattcgggccatgagattccagtaaacctggaatctagaatcagagtgtatttgactgggtaaggggccacttggtgagaacgccagggaggagctcagcccagttcctctgccgactctgagcaaatgacccacagagcattgtgccaggagccagcccaggctgtcatctcagagaaaggaaaggaaaggccccaggactggggccgtaggcggaggagcagctgggggactgagggtcaggtctggggcaaatctggggcctctcccacccgctccctggccccggatctgcccttcatcaggaatctgcttccaagcagatctgatttgcctactgagccatgcccccagggaagctgggccctgaaygagctgggcttttgggccacaccagagggaggaagttccctttcatctgctgcctgcttgtgtgatgcagatgaattctggcagaggaaccctgagcatggggtatggacccaggcctggctcgggtctccgcaggagggggtaagagcgacagagtctccstccagagtgaccctccagcgtctcgggcctggcctctgcgcccaccccctattgcagcacctggatgggtctccctggttctgcattttccacagcaggcagagtgcattccaaaccctgccgggccgaggccwgcaccttccctgctccatgccctgccccagactctaaggcacacctccctgctatttcctctttctggaatgctctcccctgttcgcccctcccaacccctgtctgttttctggtccccactgcagtggcagccaaggagccagatgcttgcaggggagccatgctcctgagcagggccggcacccttcctttccctcccactccaccatctgcaggcaggagagtggagggtgccaggcaggggagaaggtgtgcctggatcgtggcaccacactgggtgtgcatgtggccacctgattccatggcagcccgtgaccctgagccaatcccagaggctcggcctggagctgcggggtgaccctgagcccgggcagcagcaggatcagggcagggcactggtgggtggagagctgggggtatgggcagcatgaccggcagtgggtttgccctgacacccgaatgccgctgtttaacaggtcggtgtgcccgcctctgccaccgggtcctggtggctttgtccacaggcccttctccctttctccctggctccttctctgctcttggggatgggaggagaaggaaggagcggctactgcttctctccagtcgatgaatatgcactaaacatccattctgtggcctgggccaagtgctggggggatacgcagggaaggaggagcaacttctgttycccaagagctcccagtcaagctggaggaaggagttccagggaggcataaagacatgtctgtatgtccttagctcagcataaggagtttcacaacaatctgaattcaccaatgaatggaacgagtggatgaagatgggggcttcaatctgcttgaaagagcctagcaaacaaagatacttcatggtggatggatggatggttgtgtgggcagatagaggatacattgatggatggaaggatggatagctggacagatggatggatgtgtgggtgcatagaggatagatggatggaggaaggatgggtggtggggtggatggtaagctggccctgctgggagatgccgtctacagactgggtgtgaaaggcgctgccctgcgtgaggtagcagatctccatgtctcttctgtgttgtgattattgtgagcatgggaagwgcacatttggtcacacatgtccgtgctcccacacacagcctttcctgtgagtgtgcctctcatctagcacccagggcccccttcccaccagcgcccgctcccctgtgatgaggcctgggtacatcagcacatgcctagcccctgtgccctccctgcaccagcccctcagttctccggagccaactggagaacytgagcctctagacccactgctgtcatagtcacccccttttggtcacgccactgccttttctttttttcttttttcttttgatactaagtctcgctctattgcccaggctggagtgcagtggtgtgcaaactccgcctcctgggttcaagcgattcttgtgccccagcctctcaagtagctgggattccaggtgcccaccaccacacccagctaatttttgtattttgggtagagacagggtttcaccatgttggccaggctggtcttgaactcctgacctcaggtgacccgcccacctcggcctcccaaagtgctgggattgcaggcgtgagccaccacacctggaccccactacctttttacaaggccttcagtggtttggccccaaagggagcctagtgggggaattcaggtgtggaggaggacattaagggcccccaaagtgcctttaaatgcaagtcaagccacccaggatgtggccagacccacaggggctgtggaagcgcaatccctagcacagagcatgccccaggcctcggggcactgagtctgttggggaatgggacacctgggcctgccctgcaacctggcacctgcgtctttcctgagcctcactttcctccatagtatgagttgctcattggacaggatgagagtttgcaagctggtggccttcgggctgaatccagcctgctcacatgcakggtctaaagtggctttcatgaattgtctatttctaaaaattaggatatttcacatacgagtcaggatttctggcttctcttgaaaaaatttaaaaatctgacaggcctgggcccctccctgttactgtcacccacctcccaggtggactggaccccacctgctgcctgcctggcctggcagccctgggctggctactctctaagggtccctggggagagggcgagaagatgaggtcggcctcctcccgggctgtgacatcctccctggccatgacrtcctccctctccatcccctgcccacagcttcacgcaggccatgctgagccagcccaggatggagagcctggacacccccgcggcctacagcctgggcctcgcrctcctgggactgggcgtcgtgctcgtgctctccagcttctttgcactggggttcgctggaactttcctaggtaagaccctgagggctggggtgaccctgagcaggaccgctggagccccagggaggtgcagggccaggtggytgctgccctgctatccgtgacatcggtgggagtgctaggggccccctccatcggggcgtctttgctcctccaggcctggcttgtctgtggttagaacaggaggctgggctccaacagctcctcttaccccagcgtgctgagcggctgcctcctggggagtgaaggcagctcctgctgcttctctccagctaatgaagatgcactcaatgcccgttctgcggcccgggctgggtgcaggactccttgagtccagctccagcaccagctcccccttgcagaagactctcaggccttgttgcacagaagcctgaggtggtggtgagtcagccacctctctggcagctcccggcacgcgtggctctcaggccaggcaggattgtggtttgtgccgtgtttggccgcaggcagggctggtgtaggtctggggaggggtgaggggtggaggcaccttatcccttctccatttccctctgcctgtggctgaggtgctttcaggctgtgagcccagtgctggcctggctagacgcccaccartgaccctgatgatggcagcaacttccagctccttggaatctgggaaagaaaagcagccatgggaaaggcagtaggggtcggggtgggaggggagatgggggcaggggtgggggacaagagggggccttcggaacctggaaggagagaaggaggcagtccctgtccaaggggagcccctcccagtgagcagggagttggtccagctggccgcattgcccgctctccgtcatgggtgggaaggcccacgtcttcctccccatcagccctggccagtgcaggagcttggaagtcactcggcttcagtggcctcagtagcctcctgggaccaacggtgtcctgaggagctcccgggcctgcctgccatccccatcctcagawgccggctacagctccttgggcccagcccccagggcaccgtgggctgtcacagggcactccaagttctcaaggagcttgtgcctgccagtaggggtccccccgagggaggaagtggcatctgtgggtgcagcattctggatcgcccatggccaggcctctctgggactgtggggggcacccacaggcagttcagtgcttcctgctcaggcagacgctgtagggagtttggtccaggaagggggacrgcagccaggagcgtctggatctgccaggtgggggcaggtgcgggcaggtaggaaagagaaaaaagccttggtgcaaggagagggaggttgagggcagagtagctggcagctggaggtggggggcagctggactggccgcacaggtgctgtcggttgggacagggcaggaggatgagccgaggccttgaaggccatccaaggggctgaggctccatccccagagaggtgggagccatagggggggtcccagcaaggaagaggttggaccgatggagccaggatcagaggtggggctcaggaggagctgtggaggggcccttccaggatgtgagggcggtgagggccccatgggaagggggactccgggctgtgcaatcaggtcctgtgggagaccagcggcgggggccctccagtggccagtgctcgggtggatctggacagggagggctgcagaggcagcgtaaggagagccaggatggtgggtggagcccctcagcagtggaagaacaagctgggggtcctggacagtcagagggagggaaggagcctgcaaacaccagtggccacagcctcctggcggccctgccagcagacatggcctagaaacaccgaggaccagcagcgcggtatgtaggcaaaggtggtcacttcctgctgtgactcagctcgaattgggtttctgtgccatctacgcacaccctgtgccccacttcctgcttcctgggaagaaagaactttccagtggtcctgggccctgccccgtgtccccagatggtgatgaagctcctggacccctcctgcccatgctgcccattgtcgggcagctgccctactttccgccttggatgaagctccattgtcctctgggaggagagacaaatgaggggtttctggggacagaaggctgggaggaacgaagccacaccctttatggagcggttactctgtgtccagtgggactgtcctctgtgggcctgggacagacactgtgactgtgaccccggccactcccttatggctcagagcagctctgccgggggacgccttgtggctgtgcggctgacgggtgcatggctggcctgtctggaacaggctgttcaatagtcaccctctctccactgggtctagctcctctgggcagctgagtgagaaaacaataccagagctgacctcccagagcaacgggaggcgtgctgtggccaggccctggtgccagagccacacagcctggggtgtggagcagagcagcccttagcaaccagctgaggcccctagagggagaggaactcaccagagcgaggaagagtgggaggtaggacaggaagaggaagggtctgcataaagaggcgccatgagcagagggcgaagggcctgaggaggaaaggcgctctctgtacagagagcagggaaaggcatcgcaggggagggaacagcgtgtgcagagccaggaagaagaggaaggccagcatggctgggtcagagtgctcgagaagaggagcagtggggcaggggcggtgctcagcaccttagtccttaggccccacgccctctgctgtctgcgtgcctgttgggtccctctgactctgcccattgttgaactctctgaagtctcctggagggcagggccctgtctcacctgcaggtytcgccacagcccgctctggggcctccctcagtgatggtgtggccagggctgatgaatagccgagggaccctgccttgcctcatccacaggtgattacttcgggatcctcaaggaggcgagagtgaccgtgttccccttcaacatcctggacaaccccatgtactggggaagcacagccaactacctgggctgggccatcatgtgagtaccaggcttgccacccctctgccctgctggccacctcccggagaggagctggtgcagctcaggacgcgggggccagggcccctggagagagagaaaggaagaacgtgtcatttgtgggggcctaggcgccctggttctccctttctcagaagcgtcttatctatggtaacagaaacaacatcccagaacagggtggtcagcttctccaaagagggctggagtgtggaggctcaaaggctgcaggcaggtcacagctgctcagccctggtcctgccacacaaaacagctgcagacgcaggaaaatggatgcgcgtctttggcgccagcacagctccacttacagacactgaagcctaaatttcagattcttttcacgtgtcatgaaacattctttttgatccttttgcttttaaccgtttaaaaatgtaacaggcgttcttggcccctaggccgtagtttgcggacccttgtgcggggacatcagggctgggaccacccgacccatcttccccgcaggaggggttggccagagccgccagggcccagctcacccgcagctgacagaactccctgtgccccaatagcctctgcccatgtggcagataccccttcccacagagggggccccgtgccatgagggaagcctagaactgctgtcggcctcagccaggtacgggtactgacaaggtatggagatgtgctcccccggsgggtcagaggacctgcggtcaaggatggcacagcgggcgctgccctcggcttcatacccagcccccaccccagcagttctagtttagccattttcttccatagaaggttttttggcagacagtgttccactgcttttgtttaacacttgaaaaccactggcctagaatttacaggttctccacaagacctgaggatcccaaaggagtgaatcgtaaacagtgaatgtcaagcgcaagatgttgcctcctggctcccaccttcagcagttgggaccgtagcagcgggggttggagacagcagaagctagaaggggggctgtgggtctggctgggacccaccctacccccaccccacgtccaggccaggcagtccccagggacacgtcctacctgccttctagcctggtccctctgcctgmtaaggcccagactatgtgcccccaggctcaccggccatggagcacccccactggggccacaggatgagcccaaactcaaaacaatcccccccacccaggtcgtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtsaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccrcctccagaggacatcagccatgcagcrtgctgagagatggcatcaatggtccaggagctcattagagatgagccattatctggccagacgctgacacagcggggacccccacaggcctcccacggcccatctgtctctcacctgccagggccccggagatgggccttccaggtgtctgagcyccccggcatgtaggaccccagcaggctgtgtggcagtgagcccgatgccaggggacagatggcagaggtggtggcctggctgtgagggacaggtgggcctcctgcttcgtgttgtgcaatcagggactcctgtccccctcggcgcccacagtggggtcgctgctggttgccaggcctggggttggagcctgggcttggatctttgcttacgtctgccctgcctcctgcagctcccagacaggcagaccagtgtgaggtccaggggtggaaggcagtgggcagggcagagggtccccacggggtccacaggtgtcctccagccctcacctcgatccagccctgcctgaggttcttgtgatggtttggctggggagggggcagcttggcacaggggcagccaaggagggcacagcccctggcccaggcctgcccatgcgccctctgtgcccgccagacagctcctttcctccctctccttcctctcttcctccctccctccctcctcccyggcagcagcccagcrcctgcgggagctgtgggatcagaggtaactatagaaatagattgggggacagcttgacggcagctatttctggaaacccaaagcagctgcgcccgggctccttggtgccgtcactgacgagctgccgctgcttactggtgtggcggggtcaggagctggtcaccagcaaagagcccctggcgatgctccatccggccttgggcctgctgtatgctctgcctggggcctcccgtcctctgggctggggtgaccgggggctcctgggcgtggggctgctgtcccaccacctgggagagcccaagctgggctaggtgttgagggctgggcggggcggcagctcctaagcccccttccccacagccagatcctcccagggcgtggccatggggttgcacctgtggccaggggctggggactcagggtggaccaaactggctttgggggaccctggacycatttctagaaaacagcctttgttcctcagagcatggtttctgggagacgggagcactttgccccagaatctcctcctgtgcgggaatgaacagccctagccactgggactcttccgcctggggctgcgttcccagctctgggctggcggctggagacccggaaagagtgagcaggccccaccctgagggaacccagccaggccagacaggcagacaatgatgataaatggatcaggaccgagaacatggggaccctggtcctggcacaaaagccagactcaggaaggggcagtgctgcctgggctcggtcggcccaagtggcccagcgtcggccggagggccwgggtcacggcaggaagggccagcctrggcaggtgggccgtggccctgagagaccctggctccagccaggcctgacctgcctctgtcctttcaggcacgccagccccacgggcctgctcctgacggtgctggtggccctcacctacatartggctctcctatacgaagagtgagtaggggctgcggcgggtgggggcgtggctgcccgactggccctgtctctccctctagaacctttccttgtggccagggcaggctcaggacaggctgccgtcagccaggcccactccagggctcccaggtcagagyggccatggtagcttacaatgcggcctgcaggacccagcaggcagccggcccctctcccctcccctctcccgcctgcgctctgaaggctccaagtcagtgttgccccagtggctctgggggatgaaggggatcccggtcccatctggacaccctcaagctgatggacgcagagctctggtgcgggcagtgggtcacccccaggacctgctgaccgaagcctctccccgctgcccggcaggcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaacatctgctccagcctctgtctgtctgtgtggggaaggagcaggcctggggcacgaatatcaggtcaaatagctcccgagcaaggctggctccagcctttctgtcttgaaatctcagagctgaggggtgggcacctctctccaggcctcccagtaaggtacttaggaggcgtcaggggytcacctggccatggccatggtttcatctccaggagacttggtgtcttgtgtcacctgctcccacccctgccccagcacacccaagacagcccctctgctgcctcttcccttggaggatccagccccgtgtccgtcagcatgagggtggagaggtgtgggcatgttgtccttggccaccccagtctagctgggcagatgacactgtcattcctaartgaatggccttgtgctgaccagcagctggacacatgctgggcaccctatgtgtctgtatgggggtgaggggtgggccctgcaagggtaagcctcatctgggggaggcagggcacagtgaccaggagtgtaggctcagccattgccactgggactcctgaggtggacagaggggacaccctccccctctcctcctggcatccatgccgccacttcctgttttcatcccagttctgctgstggtggcagggtcacccctcagcccccargactccaggccccctgactggggcaggtcgaggacttctatgcttggtgggctttggggtgattctccccggggtgctagaggccctcagcccttcagctttggtcaacattatccctcagggtctctctstgagccccgaaggccagtcaggggctcccggaggccgtgtggggattagggttctgcggggagaggcctccacctgttccagcccctctcctcttccacctgtgacctcaggcagatcaccgccctcctccagctccaggggtcctcagtcaagctcagagacagtggccgagggccggctttcccttgacctcccgttactttcgctcagggctgcaaagccacggcctgaatggatatttacaaagcgccctcaatccaggatcttcrtgctcacaccgccaagatggggtcccgggccgcattcctgagccttccaggcaagcctggccctctccttggagggctggaggcgggtgcaaggagactcaccccccagcacaggagtccccaggccagagctgtcagaagccacagggcttccgaggagtgaacctgaccctttcatcacacggcctcttgtcccacttccttggcccccagggcacatggtggaggcagggctgccagccctgaactcctcttgccccagccccagccccagccccctcgcccctggacctgggcaggttccccaacttcccactctgcatatggaggtagagtggatgatggtgccagggttgctgggcaaggctgaccctcacctgtgtcttcgctatcccaggtgcccagttgaccgggccccacagcccaggcaggtggccttcagggtctgggccacagagcctctccatccctcagctgtgctggctccttctctctctgggcctccttccctgtctccccagccaggatgctcggcctgggatccgggccatgggtgggaggtgccagaaagtctcagcctgagcactgctcatgttcctaggcagttccctgctccccacctccrctccccatcagtcccagcccccactggggggctttatttttaggtaccacttactcagcacccagctgtgtgtgcagccggaggaagcctggttccctggcaaccggcctggctcagtccagtgggcccctcccctcagggctcccacctcctgcccactccccactcacccctgcgcttcaccctcacaccaccccccctgccaaatgcaaatggggtcaggacaccccctcaaccccctgttgtcctcagaaggaagtcttggcccattaaccctggggcccaggacttattctctccccagagcctgtcccaccgcggcctccttccctccatctgggctcctgcgatgtcttcaggtctcagatcacctccgcttattcctgcgtctactctcgccattccctccacctggacacccctatccatctatccgtccatccatctatccgtccatccgtccatccatccatccaacaatattgagttagtccttctatgacacaggcaggggactcactcagctatgagcatggttttcatgccctgccctcaggggcacgccaccccttgggacaagccactgcaggatggggacagggcgggatgttttcctctcatcgctgccatgatcgatctgcgtcctcaggctctgcagaatcattctcgctggtgaggtgagttttgaagtcagatctgggtgtgagcaggtgtcaggaggtgaggcagtggggtgggtgaggagccttcccgcccaagggaacagcatgtgccacggctgtggtgggccgacccaggagagggtccagggctcccgagtgtcccttgcaacaggcaggcctggtgagggactcaggttccaagaaacaaatgaagtatgggaggaaagtgacaggttccccttggctgcagggtggaaacagggtctcctactgtgaggaggcccccagggtggggaggcccctacagagttgttctgggcagtggtgatggtgctaggccctggacagaggcgtgaggtgggaagagggaacatgagagatgtgtaagggggagaatgtccaggatttggggatgaatggggaacaaaagggtagcccccatggtgggcgggtccaggggagctggagagatcctgagtccctctgcaacaggcaggtggctgccgggtgtcgtgagagggctgggctggaaccagtacctgttcatcagggggcgagattcacgcttctcaacctggagcacacagtcctgccacctggccaattttatggtttcatttctattataattttaacatctttactgagatataattcacaagccatacatacaattcacccatacatacaattcacaagccatacacacaattctgtgagtttttgtttatccaaagagttgtgcaagcatcaccacaatcatgaaaacattttcgtcactccccagagagacccctgtacccctgagctgtcacccccgactcctctccagcattaatcgccaccaagccgctctctgtctctatggatttgcctctcccggacacttcctataaatggaatcacggtatttgtccattggtgtccggcttctctcactcggcactgtgtctttgaggttcagctgcgtagtgccatgcctcagcactcgtcatttttactgctgaacagtgttccactgtgtrgatggagatgctgtgtttatccatcaggcaatggacacttgggttgctctcaccttcgggctgttgtgaagaatgctgctgtaaacacttgtggacagtttttgtgtagacacgctttcattgcttttgggcaaatacctaggtgtggaattgttaggtcatatggtaactcacacattggacccactgaggaacttctagcctgtttttcacagcacgtgcatcttcttacatgcccaccttgatgataattttttatttttatttttatttatttatatttgagacggagttttgctcttgttgcccaggctggagtgcagtggcgcaatctcagctcactgcaacctccacctcccagcttcaagtgattctcttgcctcaagctcctgagtagctgggattacaggtgtctgccaccacgcccggctaatattttgtatttttagtagagataggatgtcaccatgttggccaggctgctctcgaactcctgacctcaggtgatctgatcgcctcggcctcccaaagtgctgggattataggcgtgagccaccgcrcccagccccgatcattttttttaattgtcagtgtactctggaccccctggatggccayctctcatgcagtcctgccatttgggattggctggattgtttccttggggagaaatggtgcatttccrtaggtggggggccacttatgatgcagcagttccaccctgggtctccccacagacacaagtgcctgggagcaccaactaacacccatccccactgcatcctgtctcctgaaacccccagcattcgccagcgggacagtggacacacacgtcgtggcttagtcacgcaatggtctcccctgcagcaaggaaaggaatgagtggccggtacctgtggaaggatgtcgtggacctaygatgcattgaaaccagacacaaaaggcaaaacggatctacggtggtagaagccagtgtagtyggcagaggcttagccaggtgagggcgcgagggagcttttcagaactggaggtgtcctgtgcttggatgtggtgctgccacaggtgtgcacagaggggaaccttcaagctgtaaactttccatctgtgcaccctactatagccaagtcatatcaagttggaccatataaagttgccaatactgcatgtgaccatttctaacttagaaaagcagtattattcagccgggcatggtggttcatgcctgtaatcccagcactttgggaggccgaggagggcagaccacgaggtcaagagatcgagaccatcctggtcaacatgtgaaaccccatctctactaaaaatacaaaaaactagctgggtgcggtggcaggcgcctgtagtcccagctactcaggaggctgaggcaggagaatcgcttgaacccgggaggcagaggttgcagtgagccgaggtcatgccactgcactccagcctggcgacagagcgagactccatctcaacaaaaaaaaaaaaaaaaaaaagaaaaaaagaaaagcagtattgttctgtgattcaractagtatcctaaaaacttaagagaaaatggagcagtgtgaatagtatgaaccagaaaatgatcagtgacaaccatcacacaggaaattttgraagggacacatggcagtgtgacctgttttcgctagggtggtcargtgggcctctctgaggaggtggcatttgagccaagacccaacttcaagaagaagcaggagggaggaagagcctccgggcatcgggagtggcaatgcaaaggtcctgaggtaaaatacaaaaattagccaggcatggtggcatgcaccagcactcccggctactctggaggctgaggcaggggaatcgcttgaacccaggaggcggaggttgtagtgagccaagatcacaccactgcactccagcctgggtgacagagcgagaccaaggaaaggcatggtgtggcactgggccagayggacactgcacacactgaccctgcggcccctcatgtgtaaaatggccatcatagtcatgactgccttgtgtataaagcaggtgctcaggcagtgcctcccttatcacccatggagctcctcaaggttttctctttgctttctagaatccagaatctgtctcagggcttgaggggcatgagaggcgtccggtctgaccatatccagtgcctccgtcctgctcctgcttgcacaggtgctcactccctccgccagcacctctgcacacacggcctttgaggacatattgctgatggatgggctgagccgggcagcaaagctccgtgcatcctgacccttggttcctggggcagagccrggagccttgggctgaactggcttctgctggaagggtctgctctgtcgggtacagagctcatcactgatgaggaatctaccagagttaaaatctcagcttgatgaggggagcctgtcagagggaacgcaaagccagctctatttgcccctttcctcctcttcaggaggtggcgtaccagggccacacaggatagaagcgtgcctcarggcctcctctgtccaaggcgctggtagagatgggctctggccgcacgggccagcacggcaatgcccaggcccgagggtgctctgggttcctgtcacctg

SEQ ID NO: 13324 - DNA, 59110 bp, Homo sapiens
  misc_feature (1)...(59110): n = A,T,C or G, or insertion/deletion polymorphism (see Tables 1-2)
tatagcttaagttaaatgaataaatctcacagggagtaaaataaacttagatgtttaaagaaggtagataatgagaaacaaagggtatgctcatgatctcccaagkcgcaatagttgtaagtatggatgggctgtgaaactgagccaacatctggtgaggtagtcataggctctggtaagttgaaaataaatgaacatggaaagaaaaatacagtaaacatgacaaagttgtcaatgcaaacatgtaatcaataaatggtcatatttaaaaatataacagcccctagaaaagagagttgatgtcttttataatattttttatttgtaaaagtaatactttcttggtttgaaaaaaattatagaaatatatgaagcaaaaagtacatgttctcatccctctgcctctgtgcctcaaycatttccccaaggtaggtatttttttggtgtgtacccttctagatattttctgcaaaattttctattatgcatgtatgtctccatgtatctcttctctatatctatatctatatctcaaagaaatatagaaaatactayctttttttttagtcagtgtgtcactctgtcacccagggtggaatgctgtggtgcaatcatagctcactgcagcctcagcctcctggcatcaagcaatcctcctgcctcagcctcctaaactgctgggattacaggcatgagccaccatacctggccaggaaatatttttgaacagctgatgttcttaggcgatgaaggtatgtgtggaagacacctgatgaaaggccttggtaacaagtactttaaggaagaaaattaaacatctattgaatccttattaccaccatcaccattttayactttatagagcacttccatgagatgatctcatctgagtctcgtaacagtccttaagrtaggtaagaattattattttcattgacaaatgatgaagctgctgcctgaaatgattaaaagataatgctcaaggacattccaaatccttattttcaccaaatcaaggaaaagacaatggaaaagttagtgttgtattggcctgggcatccctttgattacagtcatttaaaacagatttttttttttttaatcatggaaactttcaaacacgtaaaagtagagagaatagtcaaatgaatctttaagtaccactgttcaacttccacagttattttttttaatttttttaaaattatactttaagttctaggtttaatgtgcaggtttgttacatatgtatatatgtgccatgttggtgtgctgtacccattaactcgtcatttacattaggtatatcccctactgctatccctcccccctccccccaccccacaacaggcccaggagtgtgatgttccccttcctgtgtccatgtgttctcattgttcagttcccacctatgagtgagaacatgtggtgtttggttttttgtccttgcgatagtttgctgagaatgatggtttccagcttcatccatgtccctacaaaagacatgaactcatccttttttatggctgcatagtattccatggtgtatatgtgccacattttcttaatccagtctatcattgatggatatttgggttggttccaagtctttgctattgtgaatagtgccgcaataaacatacatgtgcatgtgtctttatagcagcatgatttataatcctttgggtatatacccagtaatgggatggctgggtcaaatggtatttctagtttagatccytgaggaattgccacactgtcttccacaatggttgarctagtttacagtcccaccaacagtgtgaaagtgttcctatttctccacatgctctctagcacctgttgtttcctgactttttaatgattgccattctaactggtgtgagatgstatctcattgtggttttgatttgcatttctctgatgaccagtgatgatgagcattttctcatgtgtctgttggctgcataaatgtcttcttttgagaagtgtctgttcatgtcctttgcccactttttgatgcgattgtttgtttttttcttgtaaatttgtttgagttctttgcagattctggatattagccctttgtcagatgagtagattgcaaamattttctcccattctgtaggttgtctgttcactctgatggtagtttcttttgctgtgcagaagctctttagtttaatkagatcccatttgtcaattttggcttttgttgccattgcttttggtgttttagtcatgaagtccttgcccatgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccattgcttgtttctgtcaggtttgttgaagatcagatggttgtagatgtgtggtattatttctgcatgttctgttctgttccattggtctatatctctgttttggtaccagtaccatgctgttttggttactgtagccttgtagtatagtttgaagtcaggtagcatgatgcctccagctttgttcttttggcttagatttgtcttggcaattcaggctcttttttggttccatatgaactttaaartagttttttccaattctgtgaagaaagtcattggtagcttgatggggatggtattgaatctacaaattaccttgggcagtatggccattttcacgatattgattcttcctatccatgaacatggaatgttcttccatttgtttgtgtcctcttttatttcattgagcaatggtttgtagttcttcttgaagaggtccttcacatcccctgtaagttggattcctgggtattttattctctttgaagcaattgaacttccacagttattaacctttgacaaatcttcatataacttgttaagacatggagtccaaaatactgttggtaatgtaaccaaatttggagatcatggagagtaatttatgcagtgtgctttgagtatgaacaatgtatattctgtatgtacaagcccagaaaagtagctggagacaagaagtgcttaaagattaaattaaatttgtcttgggtgaggctattacaatgattcctcatttaagctcatcttgacattattttcaccatcgtaaccccagttcctggttcaatgcctagcatatagtaggtgctcaaaaactgttgaatgaatgagcctgcttagcagtttagatctcagcagcatgaagaagcccatgcattgtagtataagcaacctttgcagaatgtttcttaatgtgtatctggtgctttctatgtccaagatctttactagctgtgttggggcctactccaagtgccttacatgcagtmactcctttaattcttgtaagaaccctatgaagaaggtactattataawtttttttgtgtttcatagataagttacttgtaagttggtwaagatcacacagatcrtaagcggtagatctgggaataaaatccagagtctgtgcacttagctactactctgctgtggcatctgaatagcatctatggaacactcaacacatttggggcactttgctaggtgccttactgttgggttaactcacaaaagtcactcctttgcaatgccagataacgagagggtgctgcacatggaacagcctttctttctttcttttctatcttttttttttttaacagactttgccattttttttgtgaacctaaggcacttctaagtgctgtgtgggagggaatgtggtaractgatttcattgagactctgccaaattctggtcttgcggccatcaaaracgcatcatttcctccaagacttctaaagggggctattaccacgggccwgcaggttctggtttgcattcagaggagacactatcttcttaaatgagacatggaagaggaagtgtcatgaactgtaaataaggctgatagggaattgtttggtgatggggatggagaaaaactgccctctccaaaccaggttccatctcccacccctttatccaactttgccagagtccatcctattttatttgctgagtttactagcaggaagagaggagtttctttaaagattctctcccctccccaaataaatacctcccagataaatatgagtacatctatatagtagagcactatgccaacattgaaaagatggaaggatggagctttgttcgcagccagcttaggcaacatagtgagaccctgcctctatataaaaataaataaataaataaataaataaataaataaataaataaataaaagatggagctttaaaggttgatgtagaacgaatctccagtgtatattataaagtgaaggctgggcagggtggctcgtgcttgtaatcccagcactttgggagactgaggcaggaggatggactgagtccaggcattggagaccagcctgggcaacatagtgagaccttgtctcaaataaataaatcaaatttaaagggaaaaaagccaaggctcaaatagcatttataccaagcaattgtgggaagagaagggtgacatgtctacatacttgtgtttaagaatctgcttggaaaaaaaaggaaacataaaaatgcctctgccaaaagaaaagtcttttcactctaagcctttttgtgtttttccaaaatttttttttgccatatacattcattatatttcagcattaaaatatttcacctgtcaacttggaaaagtaaaagcgtgaatacagtaaatatttaaaaacagatgaagataagtaacaggttacattaattgtatacaatcaatctagtttgaattaggtgtagatataataattctgtgtgtttatcttggtgaagaatggtcctttaggttgtcattaaaaagcacctctgggaggtaaaagacataggcatctggaagattcatatttaatgaagttaggggacatttgatgtcactccccaggtgtggggagatatggacagaaaaccagaaggaacgaatgtggtcaggaaggaattggagttcccctccaaacagctgccacaagaagtccacacacgtggagacagttgtgcaatttggtcacagagtgtcctaggtgcttttgcttcattgctcctccactgaagcacgctggcagctggcctccttcccctgggmctaaggatatcttggctggaagctctgctctgaaaaggggcatggccaaactttcactagggctcttcgttggggagcacgatggacaaaagccttcttggggctaggcaggtcacttcaaacttggagccgccaaatattttgggaaatagcgggaatgytggcgaactgggcaagtgcgttttctgattaagagcaaccagattcagctttttaaactacaattatactggccaaacaaaatacccttatacaaaaaccaaaactactggcaggagtcgctgccagcttgcgacccggcatacttggctgagtatccgcttctcccttgtggctccaaactgctgcagattctcggccacttcagacgcgcgcgatggcgaagagrgtcctgcactttgacgcgcctggtgagggagcgctgctcttcgcagcgctcctggtgatgctccccaaatttcggggaccggcaagcgattaaatcttggagttgctcagcgcccgttaccgagtactttttatttacaccagaaacaaagttgttgctctgggatgttctctcctgggcgacttggggcccagcgcagtccagttgtgtggggaaatggggagatgtaaatgggcttggggagctggagatcsccgccgggtacccgggtgaggggcggggctggccgcacgggagagcccctcctccgcyccggccccgccccgcatggccccgcctccgcgctctagagtttcggcwccagctcccaccctgcactgagtcccgggaccccgggagagcggtcartgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtaaggagcccactctggaggaggaaggcagacaggtcgggtgagggcggagaggacctgaaagccagatctaactcggaatcgtagagctggagagttggacaggacttgacattttgcgatctttcatttaccagtggggaaactgaggctcagagactggcccaagattacccagcgagtctgtggtcgcctgtgctctagcccagttccttttctaggactctggtttgcgacagggacctcggctggagcrtgtcctgagatgccgacacaccctcaggctcttgggaggctggggtgggaaggcgcctggggttggcaggcaggaggtgcctccgcaggcgagaamaggcggtgaaaagttgtctggctgcgcgcaacatcctagtccgggcccggggaagaaaaccttgccggaatctcaggccgggtctcccggatcggacggtacactcggttctgcctctttgcgggacccggcccgttgttgtcttcatgctcgaacacacttgcacacccactgtgtgaagtggggtctggagcggagagaaactttttttccttccttggtgcaggacgccgctctccttgcagagcgaagaagggggggaatagggacttgtcctgggggctttgacagcttccccaagggtctccaagtaacagccaactgtcctgcgtaaagcattgcacatctttcaaagcgctgtggtccttggtgtaagcgcatagtcagaagttcaagctccgaaaacctttcctgtgggccttggtacctagctttagtgccattccttcctctccctgccgcctaaaatttccgtctccttcaattaggaacacacacgttcttcatgcaatagctgtctgtcttttcttcctcactttcctttctctctcaaccccttagataatatttctttcctgcagccagtttgctgatatccagatttccaccctttgcagggtgagaaaggggaaagggtcagagaaagaaaaaaaaaaagtcgaataattcagggaaaaaaatttcttactycctaagacaagaatcacatgtcttagaagacactcacacccacatacagtaccaggatcatctgtccatggttactgaattttctttataatgacttggttcaacgggtccagtccaccatggacactcatttgtcccagacaagccctctctctccccctttctgggcagagaatgaaggtctggaacatgtggttgctctgtattccacaaagaagtgagttgcttttaagcctggggtgtttcctagcgtagtagtaacggcaggccggtcgccctgaatataatggtgaacttgcccttttggagtgcattacttgcttaattggattgggctgtaattggtgccatcaaattctagagacagaggcactgttgtttttccttcccgtctttgagctggaagggtaacagtgcacaaattaattaatattggttatgggatttgaacatagaagggctttttattgagtagtagcatrtgtacctcttacagttatttctttagaactttctgaagagtccagctcaagcttgccaatgaaaacgaatgacatttaatggagcaaaaacaaaaaacaaaaaactatgttggtctacaaatatgaatttgaagttattgagagccttgttgaatagatttttgttgtaaacgtgtctctagaatagtatggcatwgtctcagcttcctatgaatgaaggacataccttttcttttttaaaatatttgttacacaggaaagtgtgtctagaatgtgatctgtggcaataaattatgagagaccttcaagagtttctgattttggtagccgagtgggcacagtttattgagaatcatttttactgccatttgttttctcacaagaatgtgcccaaataatggtttttttctcatttggatggcagtgtgaattgtacatcatgttttcagcatctttctcaacctagtgttccccagtcaagtttgaaatctgtgttatccaaatgaattgttttcattttccttttcttagacaaagtgggactccaggtttcattttgcttttaaacattttggttttttgtttgcctgttttgggggcagttatttctttcatattaaaaagtactgtgcaggctgggtgcagtggctcattcctgtaatcccagcacttagggaagcagaggcaggaggatcgcttgagtccaggagttcaagaagtgcctgggcaacatagcgagaccccattctctatttaaaacataaatgtaacccccgttccacgcacaaagtactgtgcaaattaattaaacatgaccacccagaccagcaactgtccaagagtggcccatagaccatctgtggtaggataatttgaaatgcttgttaaaatgcagatttgtagacccagggatattctgacagagtctaaagtcttaagaacaaaactgttctaaacataagtcagtaccaatgccagttaatttctgagatatattgatataacttagtttccagttttttaaaaaccatattattgacttaaaaaccatgatattgaccagttatgtcagtaacttattttgcacatctgtgtggtgtgtgagaacatgtgcagtcacttattcattttgcctgcatttgttcatattgggatcctcagattcaatgcactggatgtttgcactgggtatttacttatactctctctatttattccgtctcatacttcgtcctatttgttcatactctcttatttgcccagcaaggtcaatgccagtttaggcytagggagtcattttttcttagttgatatgacttagaaagcttgggwgcctgcccaacatcaattacttttttaaagctggtattttctaggtcttgatatttattaagaccctagcatagtggacaatttttctttctctcatgctttttcaacacctcatagctcttcacatttagttgacagagaattcagttatcttgctgtagagtgacccatggtgaggaatctatgccatggtacttttctggttcttatcccttataggtaaagacaagtttcttatgtctgaagcttgatgtcaggatgagttcagggctttgatgaataagttcagatctcccaattgtaattcattagcattgcacttaaaaaaatttatatacgtttttaaaaaagggtaatgctaatgaattacaatagagagaaaagtacattagtttgcatgtatgtgtgaaactgggaaaatttttcacgaaaatattcatatactttttaaaaaaagggtaatgctaatgaattacagtagacagaaaagtatattaatttgcacatatgtgtaaaattgggaaaattccacacatacataaaagtatattaatatgcatgtatgtgtggaattggggaatgttttctcttcctcagtttctctcccttgcttttaatgtacagtctttatgagccattatttcagctgtggcagtttggttaccaggggaagcgcactagaaaattgataaaggaaaatgagacaaggtcatagattctctcactcccttcagggtacgtagatgaactatataaaaatccgtctaagtgggattcgttaatcagcaatttagtcaaatgtgtacatcctatgttctataagaaatgtcagtgggtcctttcccaagggagtgagatcatcagatgaaggttcatttggtttcaatgtcccgtatccttttgtaagaccttgaagttggcaatgcaggaaaacaggaactccaccctagctccatgaattgcagaactgttgtgttggtttatgaccatctgcccattcttcctgttatgacacagcttgtgaacttttactgagaatggtgaaaagtaaattcccagttttatacaatgaattgctgaagaggccttttaaagtatagagtatgcattgtttatggaaggtgtttcctattaggtctaactcagtggcaactacattcatttatttaatttgtttctaggtttgcctagtgtttctcttgatctgcccaggctcagcatacaaaaagacatacttacaattaaggctaatacaactcttcaaattacttgcaggtaaggattcattctagatctagatttcttgtgttaagtamctgattgtttattgagtggaaataatttccagtagagcagaattataatagagcttgtagtaattgttcataagtggtgaggtttctaagaactgatgtaataatggaaaatgagaagaattttctctcaaaaattctgtacaattttgctggtgtttttatactattctctgccaacatgcatacacacacacacacacacacaygcacacaaatacacacmcacacccacattccaataaccagtacagccacctggcgtatagtagacatacgctcaataaatatgaatgaataaatgaagttgagggcatacatttaaggaatagagttgaaaaaatttgggactatatttattatgcttggtatgattcttgaacacttattatccctttccaaaaactttgctttataagaaatttattactataattacttaggcagtaatatttaatagcaatttaatatttrgtgggtaatattactgagcgcatgatctacataaataatggacttcgggccctgccttgatattctggaatgcatctttccccacttgctagcaagaagtcatgctattgatttttgataactggagaagtagacttctttgtcaagaagaagaggcctttaaattttgcctttcaacccttaccccaggaygaaagatagaagacccttgggtttaacatagtgatcacacacgaaaggcatggagccttcttaggacctgtgtgtttttggtagagactgtgacaagtggaggtgatgttaccctcctggaagagtgctgggggtccacaaaggaccttgggtaggttattgccattgcttcatacttgttgaatactaagcattaaaccgaatgacatacatctattttagactgcagtataaagaataccctagccccttaccaatacccagcccttgggaaaaaacacagtagcaggtgctgtttctctagctttayttgtttaagacacrtttcccattagattttccttttaccgaccctcgataacaaggttatttgaaatccccaaggatcccatgctccctttttaaaactctgcataaacatttcttatgttctgaaaaaaaccatggagtgtgttaaaagtaacttcattgatttagctgcaacttcctggaaattttaagttctttgaatgaagggccaataatgttacattcttcttgatgttgactatcttcttatcttccttggggccttgtagagaaatgctgcagtacaagccatctatgttttaatgcgaggtccttacaaggtcctgagggactcttacttgcacctccttccttcctaacctcacttcttactcccctttgctcactcttacctggctgctctggtttcctggctgttcccttaatactccagatatrcacctgctccagggcctttccatgtgctgtttttgctcctgtaatactgctcttcatgatgttcctatggctagctttatcaagaccacctcctgcaaaattctttactcttttctttgtatcttctatatttttctccatagtactaaacactatcttttatacaataaactttccttactttttaattgcctgttttctccagttagactgaggttccataaaggcattgatttttgtctgatttgttcactgctctttctctagtccttaacaagtttggcacatagtagatgcttaatagatatttgttgaaagaaagaatgcattaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattctcatgcctcagcctcctgagtagctgggattacaggcatgcgccaccacacctggctcatttttgtatttttagtasagacagggttttaccatgttgcccagcctggtctcgaactcctggcctcaggtgatccayccgcctyggcctcccaaagtgctgggattataggcatgagccaccatgcctggccggtagaagactgactgtgtctgttgaagagtttatttaagtttcaaaaccaaattttctcttttcttagaaatagcctcacagtctggcacttcatattaatacctccctgaaattaatttttcaggggacagagggacttggactggctttggcccaataawcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaaggtaagtggtgaaataaaattcatttcccacgtctctttaccagttataaaagacaataggctcaaagaagaattgagtacaacaaagggcttgctctaaaggctgtttgccaagaggaatacacacarttcttctctcctgaggctttctctgagaaataagactcattgattctggagcttgggccgtgttacctcttttttgcccagttagtttgggtctgatctttgtttccaaggtaaatctgtgttcactgttggccaytgagacttataaaaagtcttcctatgtttgagaagaaaacctaaaattcttgaaatcgaggaagatttgggggtgaattatggagaaatttctgtggagagataagttatctacagcagagtaggagattttcccaagaatgcataggaaagcattttttgccaagggctctggagttttttgcacataggaacctttttttcttactagtatttcataaaaaacaattcccatactcatgtgcaaataaagacattgcttcagactcttttcaggacaatgtttctttcctttgcttgtttggtctgagatcttggatgatatgctgtatctttctaggatgtgcagtttgggattgatattatgaaggctgacttaacatccatatagtataaaataaatgtcacacatattctgcatttataatgagttatgcattcttttgtgtttcaaaaatcttacactatcttatcttttctgtgaaaacctaacttaactaatgagatccctatgatataaatttaaggaatgtaagggctgcatcatagtttggttggatgtaccaaatatttttcttttcagtgaagataaacagacattttatgtatttacgtatatgcctttttacatcccagagtatttgagacaggtgaagatgacttagacttttttcccagaagcagcttttacagggcaagaatttcatcagctttgggaaacacacttgcatatctctgcttacatttcagtagtgtaatatggtcagtgcaatgaaaaagtggagaccacatcaaaataacctatgccactggattcacaatgtttgagaaatatctttgcccagagtaagcactgtcaaagatagaattctgtgccctcctccttccctccacaagatttgaaagagacaaggctcacatcttggagaatttctggctccttttgacctggcagtcttgagagatgcagctcggtcagaagattgcaaggatttcctgctttcagcctgtctagaaatactacaagatgaacatcccccatatctcattatttacttcttcctaagtcaggaaacttggagacatgtgaaaattcatttcatgagtttcagtaaatattttattttgagaggctgggtggtggtttgggtttcttttgtttatttcctttttttgagataccgaaatagaattgatttactaaataggtttagtcttacgtcaaagggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggccatgaagttaaacaatgggaaaggaaacactgaagtattctctatggataggtgtttaatgtcccctctggtcgccaccttacttccctagtcttctgaccccattctcttcagcaatggatggagccaggaagtgagccctggcctcataagataatggctatggcatgtggtgggctagattggctgcttttctgtgctttccagctgggaaggaaatcaaacttctgctgttgcagggaattagctgcctttgtcccctgtggtttaattaactctttcttcactttgactgrctattatgaagcactctgagaatgcttgatgrgatgtgttgggcatagcaatgtgaaatgttatctctctgagatttcaagcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaaatgattctcctgcctcagcctctgaaatagctgggactacaggtgcgtgccatcatgcctggctaattttttgtatttttcgtagagatggggttttgccacgttggtcaggctggtctcaaactcctgacctcaagtgatccacctgcctcagcctcccaaagtgctgggattacaggcgtgagccaagaacccagtcagaatctcttcagttttcttctcagtctttggagtggtgacttttcaaatgtttgtcattgaagatatcaatgactgctaaatgttaaactaaatgcaaaaacaattaaacatggttttagaaagaatcatatccctagtcttcagaatcttaaaatgctcacatgaatggtcctcttgaataaccaaattcaaaagtgttagctgtttcctgttaatctaaagatcctttgggatccattcatttattttcatggaatttacattatttacctaaagagagagcacatgagtattttaaatattagtaaaacttgtcggtaaagtgtatagatttaactttaaattttaaagtaaatattatccttcattttgaaaaaattataatgattaatcttttaaaatgtgaaatctataaaaatatattctgcttgtcaataaaccttgtgaaaggagtcaatctcaattgggagttttttttcaaaatttttatacacacagatatatacacatgcatgtgcatgcacaaacacacacacacacatacacacacaccctcatgtagcacagatatctatcagcagaataatctgtggatgcctttggttgtgtgaggtgtcccttccagtcattcacttgtctggttagagtttaggaacctgaaaaatgaccaacttttctagtaaatactattaactcattaataaaactaaattttcttctagattacagatctccatttattgcttctgttagtgaccaacatggagtcgtgtacattactgagaacaaaaacaaaactgtggtgattccatgtctcgggtccatttcaaatctcaacgtgtcactttgtgcagtaagttgcatctcctccaatcgtctcttaagtttttataattttaagctaatattaagatgggtaacctgtttataatattcacaatgagttttaaggatcctttaggaagggtcaaatgcaatgaataaaactaattagtattcttaaaaataagatgaattcttcagtgatcattgtacatggctctcatttttggtactggattaaatatttgatatgtctttttattacccagagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtaggtaagaggacatttcctttccatatcattaataacatatccttgtattaagatcttggagataacaacatagagtgaagaaggatattgaaaagtataggaactcaggatatggtgttgggcaattcatctgctcttctctaccaaataaacccatgtgcaattgaggttgtctcttttcttgccaagattaaggaagaaaaagaaaactttttaaaaaaaggatgaaagcgaatggtattactcgagcacattttatgaagaattcaatgttcagagcattgcttgctatcaattatttcaattatgactattttatggaaacttcagcaatttgctaaagctggccctactggcctagggctactgaccactgaaagtttactacttttctgtccactgggttacaacatctttgagatctgtgaaggtagtgctttgtaaacctctgttggccattttcctgggagctaccaagtattggtgaggcctgcagggaaaaacaatgtggcatrttttaaagttgcattactttaaaaaataaatctgtgcaaagttataggcttatttgctctctcatgttctrttttttcaatttacttgctctagggtataggatttatgatgtggttctgagtccgtctcatggaattgaactatctgttggagaaaagcttgtcttaaattgtacagcaagaactgaactaaatgtggggattgacttcaactgggaatacccttcttcgaaggtaacgctaatgattcaaagccagacctccaaatacttagataataagccccartgaagtttgcttgagagataggggcctctttggccagataaaatgtaagagccttaaacacacacacatacacacccactcacacacacatacacacacacacaatttaagggaattgcagaacagatagcacccaccaaaaggtgaaataccaggaattttgtcctattctgcaatagccaggctatgaatattagttttctctaggtgattacatctttccacattatgtcatttctctgttctccaaagtttttgatctacattccttttaagggaatttctctttaagaggtggcatgagatacactgctccttaaacagtggtcacatttacttgtgtttctgcagtttatatccatctcactttcaccacgtgaggttttaaaaatcctaattcagttggttccatttatttctcctgaaacaaaatatatttgttgtctgcatgaggttaaaagttctggtgyccctgtttttagcattaaataatgtttaccaaagcccagatttaattctgtgtgttactagaagttattgggtaatgttatatgctgtgctttggaagttcagtcaactctttttttcagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatggtaagctatggtcttggaaattattctgtgccttgacaagtgagataatttaaataaatttaggtcacttagtgattcctattttgttcattcagaagatagtttctagtttttcttgttagggaggccacatgacctagaggtcaagagcatagctttgtagtcaggaacttgggttcaaacctcaactttaaagatgagatgtgctgatatacagtaagagttcatttagtattacttattatagttattgctgctattaggattgttactatgataaatagtattagctaaggtagtttttaaattttcattttattgcaaggctgagaggcctacttgaataagcatgagctttgcaaactggggaaacatttagcaatatacagttgacctgtgarcaactcagggattgggggaactcaggggagttcccctaactttccctcctctgcagtcaaaaatccatgtataggccgggcgcggtggctcacgcctgtaatcccaacactttgggagtctgaggtgggtggatcacctgagatcaggagttcgaaaccagcctggtcaacatggtggaaccccatctctactaaaaatccaaaaaattagcctggtgtggtggtgggagcttgtaatcccagctactcaggaggctgaggcaggagaattgcttgaacccaggaggtggaggttgcagtgagccaagatcgtgccattgtaccccagcctgggcaacaagagtgaaactccttctcaaaaaaaaaaaaaaaaaaatcaaggtataacttttgacttccacaaaacataactaatggcctactgttgactggaagccctactgataacataaacagtcaattaacacatattttatatgttatatgtattatatactgtattcttccaataaagctagagaaaagaaaatgttattaagaaaattgtaaggaagagaaaatatatttactattcattaagtgtaagtggatcatcataaaggtcttcatccttgtcttcacgttgagtaggctgaggaaaagggggaagaggagggggtggttttgctgtctcaggggtggcagaggtggaagaaaatctgcttataagtggactcatgtagttcaagtttgtgttatttaagggtcaactgtaattgaactggaattaaattgaactggccttgagaaaatcaccttaattttttgtttattctctttcatttacataaatgtctgagtttacatggtaatttgtrtggcatcctacttataagccttggaaaggattttggagtttatattatgagaatgcatcaatacagtgaaattttaaaaataccttagataatgctatttattagagttgtaatcataaaagtggcaacaactataacaagtatgatttagtgagcacttactttattagctcatctcatctttgaagctgagattggaactcaagttcctgactacaaagctatgctcttgacctctaggtcacgtgrcatccctagcaagaacttgaaaatttcttctgaatgaacaaaatagaaatcactaagtgtcctaaatttatttaaattatttcacttgccaagawgcacttgtcaaaatacacagagagagatgtgctctggcttatgtttttatagaattacttttgttytccagaatacttcagggaaataggggcagaaataaggaggwcagttgggaggctaattgcagttatccaagtgagagttgaggggtggcttagacaagggtagttgaggtggaggtagtgagaggtgatctgcttctggatatattttgaaggtagagtcaacagggtccgctgatcaattcattggttgtggagtataagagaaaaagagtggaagatgactcgagcgttagcatgagcaactgagtaaatgatggtgttatttactgagatggcaaagatcgagaaggcagtgagatttagggaaacagtgttagatatgtttatctggagatgcctgttaaacatccaagtggagatatttaacatatcaacccggaacccagaggagtcagggcagaagataacacatttaggaggtacgtgaatgatactttaaacctgaggctagaggaaggtgtaaataaagaggaggtctgaggactgagtcctggggcctcatggtggaagaggtgtgtggaggctgtcatgggagcagaggagaaggagcacccaagcatccctgggggacttagagaaagctgcacagaggagcaagtgtttgagttgagacttgagcaatcactaggcttgtgggagtgcactagcggggagagaaaagcaaatgcaaacacaggaggtgtgggagaaacacgggaggtgtgggagaagctgaaaagtgacccactgaaagatagtacaggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcaraatccctgcgaagtaccttggttacccacccccagaaataaaatggtaactactggaaataaatgcaaagcatcatttcgtgtgagagcaaatcctttgactatactaattcctgagaattttttttcataggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatggtgagtccattcaattttcctctctgcccaagatttattatgatacattgtcttccaaatcagccaaaccaccgttcctctgcctcctgctgcttcactcatatcatggctgggcctgygtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatrttgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccaggaggagagacatagagtattcaaggtttaacaaacctatttgaccagagcaccttttttcccctgagcaaattcattaatctctcactccaaacagttygagaaatgcttctytgttgtaattctttgttcccccttctggtacggcatattaaaacttcaggatattttcccatgacattaaggtgcttccctacgtgtcctgatactcttctgtaggcygctgaacttggctttattattttttttcagggaatattttaaagataggctgggtgccgtggtttgcatctgtaatcccagcactttgggaggccgaggcggatggatcacctgaggtcaggagttcgagaccagcctggccaacatgatgaaaacccgtctctactaaaaatataaaaattagccaggcatggtggtgggcacctgtaatcccagctacttgggaggctgaggcaggagaatcacttgaacccaggaggtggaggttgcagatagccgagatcgcaccattgtactccagcctggtgacaagagcaaaactccgtctcaaaaaaaaagttaacaggttccaaaaaggttgtttagaagcagcataggtgtaggggactggggagaggagaaactggaaagtgtataagtaggatgggaggaggaaatgaacaggaaataaaaacaaaacacggacagcaaatagcccatttcatcagttcatgaagccactaaatattttattcactttagcaaattctctgctatatgaaataaacataaaaaagaagtcaagtcttcaaagcataatctgaggctttaggttgacagtaataaggaaatagttttgactttggagtcaaaaaagaaagaaaggaaaaagggagagaagaaagaaggaagtgagagaagggagaaggaagaaaggggaagagggaaagggagtggaragggagggaggaagagggagagagaatgaaaaactcagatgatggtggcaggaatgcattctctaaagatttacaccttcctttaacatgaggtggtttacgtgtttgggttcagaagtcagagtgtctaggtttgttccaggttttgccgttcgttaactgagtgaccttgggcgagtcatttttttctgtttcatttttttctcacgtataaagctgtggacagtaatagtggttgtgaggattaagtgaatgaattcatgcaaagcacttcaaacaatgcttggcacataataaatgtatttactgtgctatttcagctgttttctgtagccttyccctgatctcctaaacttgagaggacagagagaactatctctgtaatacagatgagaggcacaggatttcaacacttccataaagtcattcagcttgttagtttattattattattagcttattgtcatttttattttatttcgttactttattccttttttttttttttggtagagatggggtctcaccatgtggcccaggctggtcttgatctcctgggcttaagcgatccacctaccttggcstcccaaaatactgagattacaggcataagcccccatgcctggctagttgttatttttatgagtatcactagaactcaggtctcttgtttccacatctaggtgttcttcgaaaaagaaagtggaagcaaaatcatatgcttaaagaaagtcagctttagttgctaaaatcctctatttcccattcttcaaagctgactgacaattcaaaagttgtttttcccatcttcagtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccaggtgagtaaggccacatgctctttgctttcctgccatcttgcatttcttacagctgagctatgatatgactccatcctaaatggagaagcctaaaccaaaaaaagttttctctcaagaggtagcctgaatctccatccatctttctctgtgtcttacattttaggggatgtctttgcttggagtatcctcctttggggttagctaagctcagccttgttaggttagccgtgaggtacacttctccaaacacaggctatttgctcagtttgctaattgccagtctttggtttttctcccgataccaatcggctggtgaataccacatccctccttcttgtgtgtgtgaagatccatctctcagaggaaatgctgatagatgagaggcagtgatagacccagccccagtcctcagggtctcaggcccagcttatcatgctctgacacaagtccagacatccttagggaaaaacacaacaacagcagccaacccaccaccaccctaagcagtccacttcctgttgttgtttttgaaatggccactatgagcttcttcctcagctgctgatcatttccttcacagagaccatggtcccagagaaattactttaaggagcccagtggcttctaagtttccttgccttcctttgaactaaattaacttgaattgtcttgtcgatccaatttatgaatgaaggtttattcccagaatagctgcttccctcctgtatcctgaatgaatctacctagaaccttttccttcattgtcaatgcctatttttaattggcgccaagtcttgtaccatggtaggctgcgttggaagttatttctaagaacagaataaccaaagtctgaatcttttccttactcttgactctaattaaagaaaaattaaatcataatatgcgckgttatctctttcttatagccawgctgtctcagtgacaaacccataccctygtgaagaatggagaagtgtggaggacttccagggaggaaataaaattgaagttaataaaaatcaatttgctctaattgaaggaaaaaacaaagtgagtttgaagttttaaaatttgaaaatctctctctctttaatggaaggatggtacaataatatgtgaggcatattggagattaataatcaaatagtctggatgattaaatagagcgtattaagtcactttgaaaataccattgacttttagcagtaccattaacttattaatagcttatcagagaaaaataaaaacatctatgacattaaatctatgcatctgtgtagggtgattctgattttataaacatgagaatgaaaaaatgtgtatcatatcatattaaaacacatcattagtttcatggcttccaaagccctttttatataatgtgtgagctccacagcagcataattatacaaattgagtaaatatcccaaacctaaaaaccccaaatccaaaatgctccagattctgaacctttttgagtgccgacatggtgctcaaaggaaacgctcgttggagcattttggattttcagattagggatgctcaactggtaagtatacaatgcaaatattccaaaatccaaaaaaaaaaatccaaaatccaaaccacttttggtcccaagcgttttgagtaagggatactcaacctgcaattgcataaatttgagcgtgtccaaccgctgcagaagtgggaatggcataggcaggttggagtgattgtggagactgctggactgagtgcttgtgcacaaacagccgcgttgtttatggcctgggatttgttttttccccgcacagactgtaagtacccttgttatccaagcggcaaatgtgtcagctttgtacaaatgtgaagcggtcaacaaagtcgggagaggagagagggtgatctccttccacgtgaccagtaagtactcttctctggaggtttgggttggatcactcacacagtgggtactaagctatgtaattccctgttgtttttgccattcatgtgagtggcatggcatttaggaaagaggacttggattgatcattgatgctttcattcataaattamaacttctcaggtatctcctgggcttatgtgaagtcagtgcgtctaactacactggagagagaatggtttcacagatgctttaaaccacaagctctgtgtggtatttacatctcagtcttcagagtctggcacagtgcctggcttattgagcttcagtacatattggtgggcttgctgtggaacagttgatgagggtgggctttatggaggcaatcagaaggacataggagcagtgccctcccaatgctgccgattttgcctgtgcatcttagttttatggataagctttagctgattgtgctgaatggaatattatagccagggctaattcattggcataaatgtagctttcatatcattgagtgttagtgttaatgaagacctaattttaaaattctgttagaattagagattttgctttggatttttaatatattaaacattgygtagagctcatagtggagatgtggtaaatatctgaggaattcgtttacattttcaagtaatgtgtttggccaaataagatattttgggacctgaattgtctagtttgtttgtcaagttgtagtacatcacctggaayggatagagcttcatttcttttggtactttgtagtagtctgaaagcagcaagatgatagtgagctgtaccaagttaaatcaccattcaataactatggcctcttcattttagggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctaggtagggagacaattctggatcattgtgcagaggcagttggaatgccttaaatgtagtgcaattcaggtgctatgcaaagattactgtcctctaggagattatgttgtaaactggtgcacacttcttcacygaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcacagtgaggtctctgtgtccatgagaacaggaattgttctctgttttgctccctgctatagctctagtcatagagcatagcagcatatactaactgctcaataaggcacctgctgcatgaagagtgggatgatgggctgcgtttaagacctagaagactccatgggaaggaagctacattcactgtctgtacctctgggtcatsccacatgatccagcgtagcccaaggtcaatgggacgatcacttcagtgagcagatagctctgtaaattcctccatagaggcactgtctaccccttgtctaacckcatgccttgtgcaaaagctgggcagccatggctttgtctgtgggaaaatcaggcaaatttggggagcgtctctttgtgccacttctctccattttctcctcttgtggtgtccctttccaattcctaggatatatgtgccctctgttttttttttactgttaggaaggaaattgcccaagtaaattcatctataccacagttttagagggtaacgtcttcatcagaggccttggcgtatttgaagaggcaccttctgacagacactagcataaagttcgctagttttaagactcaggtgtcataataagagatactttggggtcaagtcatccccagcatccttcaagtcacaccacatagatcacatggattttctgttggcttgtctgscttcaaggttatggcagaattgagaaagagatgtgaagtaggctcctggcctagctgtgcccagaaaatatgtgctcgcagttagctgctttgcttccctaaggactcctaacttgttttcctaaaacctattcttagaaataggctagaatccagtacatttgcttagacttcaatgtagtacgmtgttgaggtaatctcattttgctaagtgttgacgtggattttttcagcatgattccttttgatgttcagttggttgggacaagatatttccacagcactttgatgatctgaagaaagaataaatctaaagtgttcttgtacacttaaacaaatactcatgggcttcattttctttaaatccaagacttcccttagggtattgttgttttgtttgtgttttagtggaaatagcactgaactggtcttttagcctcaccagattctgtaaacagttcaactgtttacttagttgcagggacatggacaagtggtttaatgtcgctgaacatcatttatttcatctgtgagataacgctaacagtcctattctgctcattacataagatcactagtgaggaacacaaattgtgtaaacaagttttataagaattgccaaataaatgtaaggcattattggttgaatgatactaaaatttggcacttccaagagaaatttgaagggattctagggtattattkactagaatcttcatgggagggaagttttcacctggggaggctgtgtctaattagaggaaaaatccataaaggtgaccctgaacctttcttttgtgatgggattaccagctagtatcactaatatgaatgttaaaagccattaatctgtttgcagtgtcctgactgacttgtttcatttaactttayccagtgaccagtgtattttcccagaagttaatatatcaacaagttcctttttactaaatttaaactgtttaaaastttgctgataccagaaccatttcaaaagttataattccatgttctgtgattttctttttgtgtgtctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggtaaatagaatttggctatcactcttgggttgcagaactttcccagggatgttatctaaaaagccatattatttcttgatgtaatgtagaaaaaaagcagtattggtgtccatgacctggctcatttcacagacttagaattggagtatggggccctgttgaattttcatgaaagccatataggagattagtcagcagtagatcccatgtgactctacagagttagataatagaacaagatgaagggcagcatttatattttctaaatttccctgaaaaacttcacagactacatcatcataaatgagaatgatcgttttcttcctctgttaggcattgtattgaaggatgggaaccggaacctcactatccgcagagtgaggaaggaggacgaaggcctctacacctgccaggcatgcagtgttcttggctgtgcaaaagtggaggcatttttcataatagaaggtcagtgggakaaaaaaaaatgtggtacatatacaccatggaatgctatgcagccgtaaaaaggaatctgatcatgtcctttgcagctgcatggatggagctggaagccattatcctcagcaaactaacacaggaacagaaaaccaaacgccacacattctcacttataagtgggagctgaacaatgtgaacacatagacacagggaagggaacaacacacactggggcctactgtgggttggggagaaggagagcaycaggaaaaatagctaatgcatgctgggcttaatacctaggagatggattaataggtgcagcaaatcaccatggcacatgtttacctgtgtaacaaacctgagcattctgcacatgtatcccrgaacttaaaagaaaaaaagaaggtcagtgggaagtcatagatacatcctgtggtttttgaagattagtttgtatcttatagacacacattcactttgaatagggcaacgacagatgatttttaatattctttgtactttgtaaattttctcagtgagtatgtattcttttaaccagcaaacataattaatgttgttataaktctgcttgcatcacatttcctattcctgcagttcttattgtggaaaaattcttaatcaggcaggatgaatagcctcttctccctgattctgtctttgtttgaatggcttgattaacttatagaaatgatgcctttatatttatttggaaaaacattagaattgctgcctaatcatggcagtcaatgctatccagrtagtcacaaggattccgagttttaattggactagagataattaagattcacttgtgaacaatagaccattgctcttctgacatggaaaatttttggtttttatctcaatwcgtgtgtatgcagaagtgatgtgaaatctgtcattttcttagctaggaaaagtaatttgtggcagaatattttatcttaagaagtatattcctatggcttttttttttatagcccaccagggaaagaataaaactgtgttgtggggtaaaagaatggtatgcaagggtaagaaagaagtatggtgatagaagggatcgatggatttctatgaactcatcctaacttgtctctcaaagtctagattttggtccctttactctgccaaatctatgatgccargtattgcatcgaratatgttgacatattttcaaatgtataagcttattagcatttcataaactacacttgcaaataaagatttcaaagaccatggcrgttttgtcatttccaaagtgattcatgttttagggcaaatccgcagaatgacgtctagattgtctctgatgctctgcattacctcttgttggtggcctgcagctggttacagatgcctaactaggtaacactggcacagagattatagttacttcttacctggagtgaatgctaagaaaggcagagctagatatttaatactcctgctgggttcccaaatgttatgcgagaatattaatatacaaacacatagaaaacagactctttgaactttttatcctctatgttcaactggacttttaaatctgtgtgtataaatagagaattacttccctaggaccaccagaraaacaaaatttactccaagcataattgtgcttgtctctcaatggttaagttaacttttattttgcaaaccaatttgttacttattttgcaaaccagtttcttacttgtcttcttctctcttgaggccgtagtgggccatccgcacagcktgtggcccggtttgattctccttgcactcttctgatgggaggccccaagtgatgactgcttccttatcatctctttgctaatcactcttagtggaaagcctgtttctgtattttgtttcttccactcagagctgtcctctgaagccctgagcatctgcagctttgcttgctgacttctagtttcctcttctctttcctttcatgagtgatttgaaactcccattaccaggccatgcgtgatgtgctcatcttggctcttcctcttctcctcactcagactcctgccacaagggatggggtagtgtatgtaatggttagttcatgttggacaggcctctttatctcttgactgaaccactgactagctgtgtgccctcagtcaagtagcttaagctctctggtcttctgtttcttcatctgaaaactgagagttgttgaggagattaagtggaatggcatatttaaagtgatgagtgcatagtagatacatggtcattagtaactctcaggtcaaaaaattttgtttatttccctacttggtttcttatgtgatccttttgcaaactctgcacagatcaaaatatygactatcagtttaaaagaagacttttgttttcctcaaatagaaatatttttttttctctgtagagaatgatctgttttctttccatcaaagactgctcttcctctaaacactttctatgtttggcttttaagacattactacttctatgcttaattacttaagaattttattgttgtaagtttacatgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggtatgcacctgtagtcccagctactcgggaggctgaggggggagaatcgcttgagcctaggaattggaggctgcaataagctatgattgtgtcatggtactccagcctggaacatagaaagaaaccctgtctctaaaaawaaataaataaataaataaataaataaatmaataaataaataaattaaattcaaaaaaagaattctgtagactccattcaagttacgggtgtgtaactgttgtcctctaggatttttccaagttggtaagcttgggattttgctttagtgctaaaatttgtcatcttacaaacaaaaagtataagtttccaactgttgatactcattcaattgtgtctttccaggtgcccaggaaaagacgaacttggaaatcattattctagtaggcacgrcggtgattgccatgttcttctggctacttcttgtcatcatcctacggaccgttaagcgggtaaaaaaataatttcccttctgcccatrcacattggttttcatgattaatgaaaactgactggggttctttgagttgtttcttcccattgttattggctcaatgggcacatttttatttcaatacaataacgttcctgcccactttcttttggctggatctcagggatttaattgatagaagccactagagaggaaaagggcttggactgtctagtgtaattaagctttaaaaccttaattctgagctcctttggggracaagggaaactagaagcagggttataataggaccactcycaaactccatgagttttattggaaaatgagacaggaatgaggctccaataaacagcaataacaagcacacaaaacaacagccaaacaacagtgtgtttatgactggaaggattgatgctttccaggccaatggaggggaactgaagacaggctacttgtccatcgtcatggatccagatgaactcccattggatgaacattgtgaacgactgccttatgatgccagcaaatgggaattccccagagaccggctgaagctaggtgcattttcaattgctattaatttgatattgtgtttaccaggccatctcttcctccattagaatgatgacaaatgtggtgtattcagatgttggattctggtttagaaatattaattccatttcttgaatttgtataatcattcatatagccacttagaggtagggtccctatgtaatcatccaaagcaggacatttggagrgtgaagggggagttattaaataattaagccaggacaaaggagtaaactggactatccatgttaaattgggatgtatggtcaccctatctagttgatgtctctgcgtatcactttggttgtatagtaatccaagtctgttttcttgttgctgttgttgttgactctaggtaagcctcttggccgtggtgcctttggccaagwgattgaagcagatgcctttggaattgacaagacagcaacttgcaggacagtagcagtcaaaatgttgaaaggtaaaagcaaaattatgtggtgatctatctttctgttttatctagtctttaaatatgttgcaaggcttgtatcagtagctttgtgcttatgtgggcctactagccacacatgcagtcagcctaaataatgcccttgtgcaaattggaaaaaggatcctcctttgtagctttatgccaggatgcatggtctggcaagcaaagttgggaatggctttcaccttcttgcctgrttaccctcgtgcagggctcagccaacacagttgtacttagtggttctgggtacagggaaaaaggactgtggttatattaaaattgtttcttaatatattgtggaatcagatamttatagaccatctagaracatggaaaggaagatagtgaaatacaaaaatagcatgttctccagaattggaatatgtaaaagatgttcatatgtaaaagataatttgcaaaacaagaatggttgtgttagaaaaaaatataatgggttatattttttaawttaaaagctttataaataattgttaattctaatagtaacggaattctggtctggccattttcattttaggaggttagacagtaaagcttctttcttcaattgtgatgttctttcattgatgaaggcagtgccaatgaccctttgccaataggttttgtgcatttcaaagctatctttctccatctgccttttttctcttgtggccaagggagtgtgtaattttgaggtggctcatcasagccttagatgtggaccatgcctgtgaattagtgggaagtgtagcagtccatacaggatcaaacacatagtcttagtgccatcagcctcatgtgccaactggtctttccagctggccttaattcgcctgcacagatcggcacagattggctggaacattcggtatagcccctaacacgtgaagatatttaatacatggtgttgcttccttatgaggaagtgctgaaatgatcagaccctcagaatcatagtgaacctgaaatgcaaaaatccagttttgcagaagaagagaatctgggcatgattccactgcagatgtattctccgctttgcaaaaggtttcacaatgggttcctttaaatatcaaactttctggctcacttaaaatatgaattttatttcaaattagaaaatagaatttacacttcacttttgaggaaatgcatgtggtctgtaaactaggtcacagctgtgttaccccggagggtaagttgtatagtggcatgcagggagggagggaccccaattattgaaggaaatgtcccatacctatgatttccctctttgtactgtatttgtagaaggagcaacacacagtgagcatcgagctctcatgtctgaactcaagatcctcattcatattggtcaccatctcaatgtggtcaaccttctaggtgcctgtaccaagccaggaggtgagtaactgtgggtggttttggtcacccaattttarcatgcctctctgatagtgtttgagggaaagcagtcaactcctctggccttgattttcttagcttagaatactttgcggattcctaggaataaatatatttcatggaggtttaattggcactagaattaaattattgtaaaactttctctgaattaagaaatgtcatgctactatgatacagtttgttacttrwgtaacagatgtccagagaagagtaaacttccctaaaacttgaaagcttaagggtagttacccccaaaatggaatcatatcaggagattgcactgaaaagcaagtagatgggtgggttttcttctgaaattttggttaatcttgtgaaaatgtgttctggaaaaaagaaaagctacaatataaggggattgggaccagctgatttctacactcctgtcccaatgaaaggttgtagccttcttctaaggtgtttttgggttcatcactatattaaaygcttagtgaggaatatragtgaaaacccattttccttcctggacatgctgcctgcagggccactcatggtgattgtggaattctgcaaatttggaaacctgtccacttacctgaggagcaagagaaatgaatttgtcccctacaaggtatgtcatctcctaatcctgctctggccatgttataaaatgaagggaaactcaaaatggtacaggttagttttttagttgaaattttgtgaagaacttgtgaggaatcttctcatattacctcttggctgttgtaacttcctcttttaccttctgggggccatatgtttctgttttatgtatgtgattttaatctactgacccattacagagtgtggacatgggggagaaggcaggtatgagcgaggaaaggggagggcagagggtaggacatctctgggttattctgtctctcccctagccatatttggccccgtggagtgtaaatccctctgtgaagagcatcctaatgctgaaagtgtgtctgaatgcaactcaaaatgtggcatttgtcactttaagctaaagaaggagctaggctttgtggaagaaaccctattatgcacaaaacttgccccaagtttcagctcagagattgcataatcctgaaattgatgtcctccttgtctgctttttagtagwttcaattatctccatggtttactacattttaaaggttgtaaacttttaaagactcattttgtrttcaaggagtttgtttgttcctttgcttttttatagaccaaaggggcacgattccgtcaagggaaagactacrttggagcaatccctgtggatctgaaacggcgcttggacagcatcaccagtagccagagctcagccagctctggatttgtggaggagaagtccctcagtgatgtagaagaagaggaaggtactggctagtgcttcctgcatgctatggcatgctcttgtcagagcagacagggtgatagggtgttacaargaatttgatcatgggraaagtccaatactacctcataatttgaaagagacctgaatttctataatagactgcctccattctgtctccccaaaagtgaagtgtggaagccctagactgggaagtgaagcagggctagcctgagaaatctgggtagtccaagtgggctaagcagtcggctacaaccacagcagtgttcttaaaatactggttcagcatttattagtgagagaggccacaagttttctggtagttgactagcctctccattgccttggagagccccagagtggtttgccccacgttgcatgctttacctgtgcaaaagtcttttcattatacctaaccttctcaaaggcagtttaggagccatctgttgtttctaccctaccccaagcggcttatcaagtcttccttccaaccatacttcctcaggcgagtcttgataaatatcctggcctttattaagttatgtttccagtgatattttatttakttgtttttatgtttatttttatttttttgaggtggagtctcatgctgttgcccaggctggagtgcaatggtgcgatctcggctcactgaaaccttcgccttttgggttcaagtgattcttgtgcctcagccttccgagtagctgggattacaggtgcctkccaccatgcccagctaattttttttttttttgtattttyagtaaagatggggtttcaccatgttrgccaggctggtctcgaactcctgatctcaggtgatcygcctgcctcagcctcccaaagtgctgggattataggcgtaagcctcygtgcctggcctgagtgatattttagtgctctttttgggtggagctgtggtcccagcctaacttccaggacttcagccggctccaggacacactgtatttctgcctccttcagaaggagcagagatagcgttgtggatgtagagatgggtgacaggctggctccccttgaggcataagtctrgaagaatagtggaagaaacccactctgtttcccttgacatgaggctacagaragaatttgcatttaactccttttccttagaagctgagaaggtagtgtgaggctgggacttggtctagaagcacatggggaggtggtctaggcttcatttagctgggcccacactgagtggtgctgcctctaccctgctctttgtctttcaaaaaacagtggccagtgagccagaaacctaagagattgagttgttgagaaaaaggctcacagccttttaaatacttacgaatttattactacaactaagtttttgtttactctggtatttgtctccaggaaagaagccataagtcttatctgaccaaagagatgattttgaaacacccatttaatatcttagtgtttatttgtaccagttgcactgaagtaaataccaccaatttacgtaaatttatctttccatgtttctgttatctctcaggaaaaaacaccctcccaggccagatttaatgtatttacagcactttttaagtttgaaaatgaattaaatatatttctagtatttttagttatctattgcagattatagtttgacttttggcctttgtcccaggacaaaacctggagagaagagattcaatgaccctgaatattgttgttttatttttagagttcttgatatgaaactattgtttatccctctgggtacatgacaaaaaacagtgtaagtggcaaatttggaaatgtcctctttatttcccagattayctaggtcagtrttaccttattctacctcctggatttactggttcaatttggctaaaatggaaaaaccagtattgttcctaagggggtatgatgaaggctaatgatactgggattcaggagatttacagaagatagaagcattgactctctgcttctatttcctaaaaacttaactcccaagtcttaaaaagattattactctagcaaacttagaaacatcacactaactcatggaaatactgatctccatcctcctgcctctttggacagctcctgaagatctgtataaggacttcctgaccttggagcatctcatctgttacagcttccaagtggctaagggcatggagttcttggcatcgcgaaaggtaagaaaggttgaggggaaatcagctatcttttcagatcacaggtttggaaataagatgtccagtgtcagccattggtgcttgtttgggattgtaattcattcaccacttctacgtcttttagaagagctctactggggaggctctgtttctgctgagtaagagtggttaaggagttcatgaaattaagctgtataataaaggcttgtcaagcatctactaagtgtgaggcagtcttctgagcactgaggatactgtggtgaacaatcaggcaaagctcttcaccttcatggagtttacagttctagtgggtagagcaaacaataagcaatataaacaagtaaaacgtgttgtaggttagatgagagtaaatgctatggggaaataaagcaagaaagggttatagaatacacaggagcaatgcacttgtgtatgtttatgcttctctgtgtgtgtacatctactttaaacaaggtagacgaggaaggctttactaagaacttgacatttgagcaatgacctggaaaggggaggggctgagccttacagatatcttggcatgagaatcatttttartttattttacattcatcaacatccatcaaaaagtatttgttaggagtataattagaaacgaggaaggacaggcttcagatgagagcgattaaaagagctaaaattagaaaagtaggccaaacaaaggctgagatggggacgtgacaagttacaactattccaaaggttgtaaacaccaagcggggagcaaggctggtggcagtgaytcccctggaaaggataaaaggtgtaattttatattaggtaacaatacttcaaattaaggatcaggaagaactatcagttgacagaatgtattcatgcagcttaatgaagaaagaaagacttaagtcatatttttttttgtttttcctaaattagaatgaaatcttcaacccatgttttccccttctcatagcattaaaggcctcaggctctttgatgtttctgctaggtagctcttatgttctctctcccaaggggaaggaggagaactgggaccttayagggttttcccaaagagaaaggccctttacacttcttggagattatgacttattattaccatttttttatggccggaattcgccacttagtcagggttccttttggggactaggaagagaatggaaatgaatgtgggaatgctttaactttccttacatctaccagactatttcttgaatccacttggttgtcgggttaaaaaaggaaactttttgtttggggggaaaagtcaaaaacactgtctgttttttggaattgccagtgttgctcaattgtgctagataatgtgcttctgaatatgccttgttcagaggagagtgccatacagatttgaggtgtgggaaggtcagcaatgcctggcttacatgatcacttctccaatgatttaagaattctccttttggcyrggtgtgttggctcatgcctgtaattccagcactttgggaggccaaggtgtgtggatcacctgaggtcaggagtttgagaccagcctggccaccatggtgaaaccccgtctctactaaaaatataataattagctgggcgtggtggcacacctgtggtcccaactacttgggaggcagaggcaggagaatcacttgaacctgggaggtgaaggttgcagtgaactgagattgcaccactgcactccagcctgggcgagagtgagattccttctcaaaaaaaaaaaaaaaaaaaaaaagttttcttctaagccattgattcatttcttgtgctccccaagactcattttcttacaaaatatcatgtggagctaaagctgccgagtagtaggaagttagctgaagtttggaggatacagagaaaggagaaactgagaagctaaaaggaagagaaagaagtcaagatgaatctcattgtaytattaatgcactagaaaatcaacctgacttgtgataggctgaaattgccttaatagacctttataataacccagcactttgaaatcaggggaagccacattgggaattgtttatcagagccagtctggcttcagcttcatacggaagggggaaaccaacaaagagcactaaaccaatgagagccccttgtttctgatttccgtgcattcattcaaaaaacaaatcccgttctcggacctccttagaataacacgttttaaaccaaatatggggccaggtaaaaggaatgtgtggatgtgaccagaaacacactcttttgtgtcctagaggagcctatttatgattccatcatcatattataacttaattatttaactccaaaggctggggctgtttatggaataagcagatgtgtgtctcagcaaagctcacagacttttttcctgaagtgttgataaaagatactaacccagtccttgttaatcagttggctttctgatgtgggatttttttttgatgcatgaggtcacaacagatgtgaaagagatcagctgtgccgagacctaatgcacacatgattctctttgcagtgtatccacagggacctggcrgcacgaaatatcctcttatcggagaagaacgtggttaaaatctgtgactttggcttggcccgggatatttataaagatccagattatgtcagaaaaggagatgtaagtttcaaatatgaacccagtgcttggttaagtaacagaattaaaactcctcgtagagagcttcaggacctgtgttcaggaacagaggaagtttttttcttcagatatttgctaatttgggttctgaatccttgtcttctacccctgtaggctcgcctccctttgaaatggatggccccagaaacaatttttgacagagtgtacacaatccagagtgacgtctggtcttttggtgttttgctgtgggaaatattttccttaggtaagtcatttctttttgtccttccatccagactccaaagaggaagacaaaagttgtcttttcctctcctgtacttcatgtctatcaggcaaaacttctcggaagctttgaaaaaaaaaatagatacataggtgatgaggatgtgcaagattcaggctcagggttttctataagagaaaatcaaatcaaagaatgtctcctccctgttttattctaggtgcttctccatatcctggggtaaagattgatgaagaattttgtaggcgattgaaagaaggaactagaatgagggcccctgattatactacaccagaaatgtaagactttaagaagtattcctgtgttctctttctttgctcgcaaattctccttgcctggaagactttccattatatagaccttcttcattgcccagttagtgtcctgcttttactttggggcctttcttgataatttcaagcatggagtcatcacttcttgaaaagatagtactttattattcaaagcaaccagttagtttttattagatgttgctttaaatgttttctatacacattgagcctctggagtatgggactctgtgtcttacacagttttgtatccttatttagcatctcacctcgtcrgctctttacaaatgtgtactcatttaagtgcttattttcagcattcaggaagaaagaggcatttaatgaaatcagtgttttgcttctctaggtaccagaccatgctggactgctggcacggggagcccagtcagagacccacgttttcagagttggtggaacatttgggaaatctcttgcaagctaatgctcagcaggtttgtcacctycatccaagaagcacctacaaagagtacttagatgtcaaggactttcctactgcctgaactgtctcatggctaccatgccatcctctcagccattgaataatctactgtattcttctacatctgagtaataatgcttttctraaagctgtaattacccttttagacagataggattctaatttataacccgggagcagaccactctgatttctacctacttatctttttgttatattttcaaatcctcttctaaagttaaaacaaagaaaaaatctggttgatccacagaagatcaacaatggaagaaatttcaagaaatttttaataaattctgcaggcaaaaatacatctaagctatgcaaaagagatggtttctgtcttggtatcatcccaggttcttataacttccactggaagattttagagttgtagtgtttactattagaatgttatttaatctctagtcaatgcctcttactacaatggaagtgaatttcctctttcttttcttttgaacagctgggggacgataggtcagctctatttttatcaataaaccttccaaacatttacagatatcaaatagccctttatttctttttcttgatgcaataatattaagttgtgcaaccttttctcaaaagacccattttcctacccatttgttgcttttctttagactgtcatcagtttttccattgccttgaaatgtggtggctaaaactggatgccatgccctttgaagggcttggctcgtgtggttagggctttgtgratgagtgattttttgttctatgtagctccktgtgttctgttgttacctctckgaccacagcctgctttctcttcattgtaactgcacttccctgtgggctgcttacccatcttgtttttagttctctcctttaatataccttccrtttcaacagctttttgtttctgacacatgatttgtattgttgtcttaaagttctrtgttcagatatgaaagccacacaccctatgtagccaagaagtccctgtgccctttgtttttaatgaaaaggcacttgaagaactgaagccataacaacagtcttctgtgtttattgtttcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcaggtactgtatatggcctaacatcccccgggggagggtgacttcaaggccatctcgggagggggattggaagtggaaggaagaccttgtctaaggctgttgcatcccacttccacataaccttagccctgaggttaacataatggggaatgctcctggaagagggcctgggtaggtgtgcttcctcccatctgtagcccacgctgctgccacagcattgcctttaagaattccaagccctgcagctgcaatagctggaatgccacagtttgctaatttccagaataaagagaygagttttacaaagacatctgcatttaaattatccccgtgtatgcttttattaatgtgaattaaatggcttaggagagattcagaaaggaagagttctgtgcttgcatgagaacatgcttatggctctctggcaaggatacagaaagccatgggtctgtgtccggaattagactggacactgcatctcagaagcccctcccacgtctgattttcagcattttatttgcataatgggatgtctgggcttatttaaaacacatgcactgcagtcctttcctgatttgcagaggggttctaaaggcagctttcttttttctctctcccagcacctgtgcataaggaaagagttggtgtggttttctacaatatgatattaaaattgccctttactaaggctgggactacttcattttgctttgtttctttcctaacccgtttgggtgttttcctgctttaatggaacccctgacagcatgggtccagcctgccagcccgagtgtgcctgggctgcagggaggggcagggagctctctcatgtccagaacttggccaggttgccacatggcaggggatgctaaggagaaactcgtggacagtttgccctctagagtcgtgtggggcagcagaaacactgatgggaaggaagaaagcttagaagccagcaagacagctgaccgttccattgaagtcaaaagcattaggcatrtttttaaagaactttgccgtatattatcagatgttgcccacatcatgacactcagagtcaggcaaggtagaaacaatgatctttttttttgatgtattattgaacatgaggctcagttctattacctgagggcagtacaaacttgtagttaaagatcaggtattagagtcagatagaaatgagtaggacccccaagtctgtcttgtagcagctgtgcaacttggggcaaatcatctaccctctgcctcagtttctttatctgtgaaatgagacaaggtcagtggtgctgtttgaaaatggctgttttgagagttataagatataatctatttctaagcacctggcccttgaaagcactcagtaaaagatayctattaagtgagctgcttaaaatcacatccttgagatgaatccagttcctctgacccctaagtccatgttgtttcctcccatgccaaggagggccctcagagagaawcagtaatgagatgagactacaattccactcctgtgtttacacatttccagttcaagttgagctggccttttagtgtgacagttgttcccacacaccattattgcctccccctttatcrgaaagccatttgatcatgaactacattccatgtgttttctgtgaccaagtagagtgatgatccgagtcggcagcctcctggctcaccgggtgctttgcatatggtgctgagcaggagaagaaatcatgtttgtgtaatggaagcaccaaatacgatgttggatatatagaagggctgctaacgtttatccccagaagcgtggacaaatgtgacaccacactcccagcacaggcctggctcctattttctgtctgtgatttttgaattggtttttccagcccagtttctcttttatccagccataatttgaaaaataaaatggaaattggaatcttttgtctgcatctcctctccacctcctccaccttttttcctttctataaaataaaactcacggtcacattttaatcatctggttttgaagaaaagcagatagaggcatttgcacacggcatgcttcattctgttgctctcctggggttctgtttctctggggagaatgagttgaggctggggtacttctcagggagcttgttctatcctcttacgcatttctggccaagtacaaaagctgagcagtctttctccttctaattttcaattctattgcattataaatagagttggacagagatatcactgtgggagctagcttcatgatttgttgcccctttaaaccatttgaaaaatatttacttagcatttatttagagaaaaggctgagaagtgtgtgggggagggaccactcmtgtctagacttagctttgcctctaatttcccctgtggaccagctctggcctcaagtttgcatgcttcctgcaagaaaacacatacttgctgggctcatctttctttgagggcagtttggggaccatcggcaattgctctgtcattttccctgggagtttcacctcacacatcaagcagcttatcaaaaatttctttgcagttctctcttagagaaaggttttggtacataccattttcttcattttgtaattgttagggatgattaaatggcccttgtagattgatgcttggggcagcctgctagctaggtattcctgagtttggctctaccattagactgtttgcagtgggactgtcctttctgcactttttgtctgtttcataccccgtacttacacccctgaccctgctactgcatgatcagtgcatgcatgacaagagaacagtgctgtgcacatactgggtgcttaataatggcttgaacaattgtgtctgctgttttcttctttcttttccctcctgatactcttccaagggagtctgtatggagtagagtaaaacaaaacaaaaacttcacatgggctttagtgtctgaaggcctaagtttgagtcccagttctaccttttattagccattttctccctaatccttgactccctcatctccaaaggggaaatagttaaaagacctgtttctccgtcttaggagaaacagatgcaccattgtctgtgaaaatgctttgtcaatcatgagaggatcatgccatttaaaaaattactggattaagaatttaaggagctgtcctttctaaggcagctgaattattgtccaaactcgccaaccctagttgattctatcccctagatatctctagaatgagcccatgtctccaaacctcatgggcattccctttttctagccaagctgcctttctttctcctgaagaagtgcagtatttgtctcttgggtcttatgcctctagtcttattcttttcaatccagagtcaattctctaaagggcatatctgatcttgtcaatcccatgcctaaaatccttcagtggctcttcattgccctcaaaataataatccaaacattccagttatgtgattttggataagttcctcaaattttctatgccttggtttcctcatctgaagagttgggatagtaatactcacccctagagaggtaccgtggtgaacacatcatgagatgctgcttagacagcwtctggcacagtgtcaggcttgcggcagattatcagyragggcttcctgaacaagtgaatgcaggaatgattgactacggtaccagtagtgtttgacaactgttacttttaggggttggacttagaaagtaggctttgcttgcaccctgtgtatcatatcctcttaacttgtggagtttcctgagtgaggatgtcaccggaaaatctcattctctcctctctctatagggaggaaccagcctcttggggtaggggagagagaattaatttccattcttctcctttggcccaaggtctatgcagcatgttccagaagtctgcttgtagtgggaagtaggctggtataggaatgaagaatgtattttctgtctcggtgggcccttccagtgaataggacttcccttccctccacttgggctgtaagtgattttgatagcatcaactagactcacccaaagccacacggccgggaaggagcattctcaagaaggagaggatctgttgttcaacaagtcttattctttggactcctgaaggaagctttggaagtcaaaggagaaaaatgagctttgtttgaagagggcattattcttcctaagagcaataagcccaacattctctatgtcattcatcttcccaacatccctgtgagctggggagggagtgctactgccaacacatcttatagatgggacaagagggtcacagaaatattcatgactttctcaagtttctgcagtcagtggtagactctgaaataggcaaaatatcttgttattctcaaaccactgctctttcctgagacagcaactctgggggcgaaaacgaggggacagtgagactcagcccaccttctctttgcacaccaagcctctgttacatggaggaggaagaggttgtcttcaaatcactgctgggttcagtatcctttaaggagaccttcagatgtttcctctgcctatctttcattgaatggttgctctgtgagcattatccagaaaaactttcccaggagatggccagacagatgtgaaacactcagtaatatatccagagctcgatggaggaatcccatgcaatcaggaagccaagtagaaggcagttgatcactccatctgctgttgttgtctttagtccagaactggacctcagaagtaggattcaaaagaacaggctcatcgagactcctcagttatattatacttttaaatgtactttctcaggaaattaagccttccatgtgtgctagcagagaaagatttttattttgttttgtttttctaaaggatgttttgaaggttgctattaagtttgtggttgaaagataatgaacttaggtagccgatctgcagtcaaatataccaccactaaaatataaatatttgttcttttgcagtcagtatctgcagaacagtaagcgaaagagccggcctgtgagtgtaaaaacatttgaagatatcccgttagaagaaccagaagtaaaagtaatcccagatgtaagtacgtcttttaaaaatagtcttagaaataatacaaaggatgaaacactagctagataaatattagcctaagcattaaagttttggagcctcattagaaggctgccctcgagtgtgtgtatcatggggtcattatggagatggaactttgtttttttcataagtaaagcccttggtccaaggttcaagacagtgtagctttctgaccaatttcactaaagtgcaagtagtgtcatagtgaagacagcgatggtaacaggcattctcagctgctgatttgtaaattttctcttctccctggcctgtgtctactcataggaagcagttgcttccttttgtagcttggacaatttgtggctatgatacctttatgttcttccacaggaccttatttgatagacatgatagatgggttgagaaatcagcttaattaaatagttggtcattttatatgctcaattaactgtgccatctcattgtctcttaaaaaggacaaccagacggacagtggtatggttcttgcctcagaagagctgaaaactttggaagacagaaccaaattatctccatcttttgggtaagactcagccayattaaaaagacaaatttcaataggaatttttggaaggaacttaggactttcagtgtaagtgcagaattttccctatggggtctttgttggttggagaaattagcatcaatttaacaaataaagaatggaaactaaccacacaataaaattaagtgataaatctaaaaataatctgaaataaattagagaatttggtcaatttttatgagaattcatgaatactagggaatttctgtgtatatttactgtggtcagtaatggctaaatgaaaaaggtgattggatgtgatccgtaaagctgtcaatatgattacaatctttgtggactctgaagaatttttaagtctgtatacaaatgggtgcatctgtgcttaagaagtatgatatataaataagccaatatctatttgtttgagacatttaaatattattgtctgaattcgaagtatttcattgtgagaaaagtattaaaattagttttaaatataatctcccttctatggctcagtaggaatttgtaggtgtcttgaatacgtgtacgttctcttaacataacaaatcaatgaaaatctatatttataagaataatagaataagtgtagttatgtatttgctggagtttatttgctagagtattcttacctaaaggtaagaatagaggaggttttgatctgcttataatcttttatataaaatgggaatactcatgggtttttgaataatgctcataccaaaaagaaaacaaacaaaaaaaaccccaacatattaaarggtgccattgtgctattttattgttttctttaaggcccaaggtaagaaattgtgaaagtcaatgatatgtttcattcattgattcaaaaaatgtttattcggcaagtatcatgtgcagagcaccatgccattgcttgagacacctacattagttttgttggggttgaattgaaagaaaaaatkgtatttctcattatttgaagtaacttttaaactatgtataaacacgagttactaaaattcccttttgcagttttaacatgaagaagttggggaaaacacctattaccgggaaaaaacaccttagaatggcttgtgaaagtgtaaatcctgaagttttagatcaacacagcctgcatttctaggctttgacatgattaccgtctgtcaggattccatgccattgaaaacattttctagttgctgctgagtgacwggggttctcagtccttccaaggaatgtggttttgatgagtaaaaagcagcgtttgatatgtctggcttgactgcacacatgcttcaagttattaaagtttaaagttgctcaagagctttattacaaccatacacatgccccgtaattcccaaattgccacaataggaaaagcacaagtgaaatttaagaacatcccaatttccttgaatatcatgcaagtggccctttggygcctgtcactgtatacaaatttgtcaatctgcgaggccataaacatgttccatcagttggggcctttgcataactcgagagaactgcctttcatctcatttgaggcttgaaagacttggacctgagtaagaggacttatctgcaactactaattcatgcgagtacctgaaaatagaccttgtccctgtaaacctgctatgctgattaacaactgggagagatacggggctgcggtctccagggagatggcagccatatggagttgggaatggggtgagggtaaaaagcaaaagaattgtcttctctctgccaactcmtttgtttgccatttcttctgcagtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaacyggtagcacagcccagattctccagcctgacwcggggaccacactgagctctcctcctgtttaaaaggaagcatccacacccccaactccyggacatcacatgagaggtgctgctcagattttsaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcagacataatttccatgtggttgttttacatttttactggttttcttactcttcttataagggatattttcataaactgattatatattttacaaaccaataaatgtatttgtagtacaaagtatgagggtataatatcaccacaactattttgaggataagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccctcccacacaccccccaacactttttcatattatattctaagcactttagtagtattgttaaaacagagtatatgtgattccttggccctccagtgaactccatatctgttagaatagccaatcatgaaactcagggggtgaaagaccctgagacaagtgatcagacccatggcagtgcagggaggcatggaccagatttacagtctctaataatattctactctatacttacagagtcagaacataagatccattattgccattttgaatgattaccatcacccaaattcagtaggtggagttatttaataaattattggcccaaataagtgaccttattttttgtgattttttaatacaagattttgaaatgtttatctagtcaaatatgcctctccctatttttaaaaaatggctcctaggttttaaaaaattttattagagaaggtctttccaattctaaacccccaattctaaattttcttcttttattgcatttaaatccatttgggattatttgcatatatggagcaaagtgaaataggagtctaactttattctttttttcaagcagattatcaatcatggcagcactgtttattaaatatccctgttttccctgtggttggcaacaaccctattgtatcattgttcaaaactagcacgtcactgagacgttctgcacagctttgtgatgaagggtggggctgttgctgttgtgtgttcttggggatggcacttccagattggggatgagaacattagggtctcctgaargacactggtaaactgtgggtcaggctggccttgtagagagttcctcatctgttcctgttgttacagtctctttcagtaaatgaatggaagagtctaggttatttgggatggagaagaccttgtaggaaaacacaggattttcttcactttaagaaaaagagaagattttctttttcataagtggctctggcattgcttccaatgccagaaatttggattcagctgaaacttcacactttattaagaaatgctttcagcacctcaggcagaatgattaggaggtgaggtttggccttcttcctctcttttctgtcttccatgcctcttgttcttagcatttttttttctcctcatttgcccctgtattgaagaaaagtctgtggtttctaaaagtgcttcctgcagggtcttattttcaaagctttccttggaggcttttggtgtgttttaggtggggctactgtttctccctctggcttctgccctccctccttctctcccttgatccacttctgtccttctccctccctttaaaccctcgtctcctcatcttccatttctctctccactcaccttcttctctgcacccccgaccccagcaggagaggtgagagctgtggggaggggggggtttcagttcactaccccggattaggttttcctatcaatgcacattcstttgtcctcttcaacaaaaggacgaaaagcaaaaamccacaacccacagctttctagttgctgacttaacccaattttcctgtacccccagcatgtctttctttctacctttgactcagatatttatcagcagatgataaaatgcaggcaaacccagaaagctaaagtctttggaaaaaaatagctgttcttacacatctttcctcatttgcatgggcctttcccttaggggcactgggcaagtccatgtattcttgggtatgcagtgagcacagctcaaagggggttctaacacatttttataagattgcgtttcctaaatgaatctcttccatttaaggatttaggcataattaaaaatctgtagcgtttttgtgaaagcaaatttaagtttaacttttggaaaagttacagactgctcttaggtgctaaaaaattaaaatggtaaaatacggtttaccctgtttttgattgaaatggagaaaagtggcagaatctgggaggagcaacccggagagaaattaacagccaagttgacctgaagttctggtagtagaacatactggccccaggagaggtctaactcagagataaggggggagttatctgagttaggaaaaagtattctaatgaagactactgataagacaaggtttacagtaaactgtggttgatatcaagtgaatgttattgagaagacatcaaattgcaccatagattttatttgctttataacgcaacatatgactttcctgtaattacttaatgcctcctagatgttaaattcagcacttttgtgaatttttttgtttaaaaataaaaaaagaaaagaaaatatgtggtttaattttttattttatactcacctgttgtttatgccaagcattttagaacatagaatcagcgtacttaccaaaagctggtgacagtggaccctcatcccttaattgtttgaagckctcaacttttagatattgcaatagaaaaacagaataagaaaatggtttttactctaactttatttcattttttgctctgtttatcttttcctttcttcaggaaataatattttgggggaataaattcaggaaagacaccgattcaaaaaaattttcattacatatttactgtttggtgcaaacgtatacaagagctttgattatctctaaagaaaataaatgggcagggannnnnnnnnnnnnnnnnnnnnnnnnnnnnnnnnnnnnnnnnnnnnnnnnnnnnnnnntcatgatttcagattttagttagaaaacacatgtatttgtagaaaggtccttttgtgggttgagttcttccagttaaaggtactctcacaatgtctgactctgggtctatgcgcagctcacaggatccagacatggaatgactcaccaggagccctccgaacaaaccttaccaggagaggtttaacgagattctggtgctttgcacgggagatctctttaagctgaaataacttatcctgacaaaggggattgaaaacattccattcattgccacagagagaacataactggaatgaaaacccagatacgaggcagagaactcaagctagacagaaagtgaacatcaatatctcatagtcactccccaggttaacaagaaaactggcagacatcccaaaacacatagtggggaaaagcaaggccttccgtagaaaccaagtgtcacgttcagattcagcccttaatactaaacattaagtgagtaatatttaatttatatatatttatttgatcatatttaattgcatctataacgtgcttaaatgcgccagacattattttacagagttggttaatatgaactcatttaagtaattgggaccctaagcaagatgtaggtatcacagtgtagaccacgtgggtaggccagagtaggatgcacaaaaagagtgtcattaatgatttccacaagtgtttgttaaggatttactatgtgccagacaacctattaggcagtggtcaaaattatttccttaggttcatgggttaagggttatcagcagaaccacagagaggaggaaggccactcttattccagaacagtctacatatctttatggtcttaccttgatgaattgagcatagttctcactattggctcagttattctttattcagtcattcttatgtaaagagctgagttcaggaacctctttaagtatcgtaatgcatagatttaccatggaggcacctaagctgactttagagtcagggagctcatgggaaaaacccaggtaagaaccctgttacagaaggctgaggaaattaggcttatttagtctggttcacctcatgttgcaaaatttgcatttcacttgtaaagcaagatgagattgtgttggtgctctggaagaactccgtgttagcagggactgaatggcaacatggaaggaatctttggtgtaatcgttaagcaatgctatattgtcctttttactactgttctgtattttactttactctttttttttttttttttttgagacagggtctcactctgtcacctgggctggagtacagcagtgtgatctcagctcactgcaacctccgtccccccaggttcaagcaattctcctgcctcagcctcctgagtagctgggattataggtgtgtgccactatacccagctaatttttgtatttttagtagaacagggtttcaccaatttggccaggctggtcttgaactcctgacctctagtgatccatccgcctcgccctcccaaagtgctgggattacaggcttgagccacagtgcccatgctgccttttacttttctaatggatgaacatacagagtacagaaagaatacgttctatcatctcattagttttactaggaattattcagtaaggattgtttcatataatgatttttttcttggggatttcaaaaacattatcaagcaacacacacaacacttcacaaatacacctgtttcaccaagcaaagggtacttctgtataaatcaccttgagaatcttttcagcagcctgtacttgagtcaacagaaatgaattttccctcaattcaatcattgtggatagatcatgatgtattgctgtgctgttcccctgctcctctgtctaatatggttggcaaattaccttgaagatctgtcatgaagagagaaaaaagcatcctcattcttctcttatcttcttattcatcagtgaatttcagagtttggtccagctttttttcctgtgaccctttgtactggaggaaggcttattgcttctttgacaraggagcaaaatgttatgccagaatccattcgtaagttggctcttacaaaattagttaataatgctcacttaaaaaaataccagtgagcattaattttggacaacagatatgctggagcaagtttaatcacagcataatagaatttaaaaataaatatatataatgtacttaatttgcattatttctctctatttcatggtgataggcatctaagtagctctgcagtcactcagacatgagcagctagaagggtggagaactgctattgatcatctgccacatgccaggcatcgagcctcatatattatctcattaaatccttgcaaaggcccttgcattaggtgctgttatcaccatgttacaagtgaagatgggcagttaaggcttgaagcctcagtatgaaaggtcacatakaccagcattgaatccagtctactgaagacatgggggacatgttcttacttgagataaaagccaggatgagatctctcttgatggcaggcagtgagctgactcatcctataataaatcaatcagccaaatgacaggtacatattaaggtga

SEQ ID NO: 13325 - DNA, 46089 bp, Homo sapiens
caaaccataaaaacctcattcttctaggtagagtttctgtcttcacagtggtttttaatgctgattcataatagaatctcttttaaggagctacaaaatatatgttgggtctacagaaaagattgttgacatgagtggaagataagctatttcagcatacatatgataactataaacaagaaccaaatggacattttagaaccgaaaattccactctctgaaatgaaaaatttatttggactttcttaagagagattgaacattacagaagaaagaatgagtgaacttgaaaagagatcaatagatatcattccatctgaagtgcaagggaaaatgaaactgaaagaaaacaaggaagcgagtctccgtgacacgtggtacaatatcatgcrgtacacacggaaccagaaccaagaagaaatggctggaaaagatgaaagaaaaaaaaagttgatatagtctmaaatgtagtgaaaaaacatcaacttatagattcaaaaagttcataaacccctcataaaaataaatgtaaagaaaaccctacctggacacatcatagtcatcatacagagcaaattttgtgcattcacaggtaacaaagatatgaacgacagctgactcaaaacaatggaggctcaggatgtgtgaaatggtgaaagaaagctgttgactcactattcacactcattgagaatatcctttaaaaatagtaagtgaagacgttgtggcaggttgaactttccaaatttcaccacaacaacaaatgtaaccagaataaacaatccaattaaaaagcagagtttccccaactaggaaaaaaaaaagcaagctgaaattattaactgtctaaaatatatgcaccttaaatataaagcttcagatagattgaaagtaaaagatggaggccgggcatggtggctcatgcctgtaatctcagcactttgggaggccgaggttggcggatcacttgaggtcaggagttcaagaccagcctggtcaacatggtaaaacctcatctctgctgaaaatacaaaaattagctgggcatggtggcaggtgcctgtaatcccagctactcgggaggctgaggcaggagaatcatttgaacccggtaggcggaggttgcagtgagccaagatggtgcctctgcattctagcctgggcaacagagcaagactgtcaaaaaaacaaaaaaagaaaaatcaatgaagtcacagacaatctgaaaaaattatcaaccaccttgacctaataaacattcatagaatactatacccaacaactgtagaatgttcattctttttgagtgcacatagtatgtttactaaggtagaccctattctgggcctacgaagagtcttaataaatttaaaaggattgaaatcatacagaacactttctttagttgcagtgaaattgaattagaagtcaataagaaatacaaaaaagactttcatatttgcagtttaaaccaccatgggtcagaggagaaagcctgtagaaatcagaaaatatttcaaactaaatgatgatgcaaaatatcaaaatttgtaggacataactacagaaggacatagagagtatgagtgctcgtattagtaaacaaaaaaggatagaaatcaatgatctaggtttccacttaaaagctaaagaaagaagagcaggctgggaacaatggctcactcctgtaatcccagcactttgggaggctgaggcgggcggatcataaggtcgggagattgagaccatcttggctaacgtggtgaaaccctgtctctactaaaaataccaaaaaaaaaaaaaaaattagccaggcgtggtggcaggcgcctgtagtcctagctactcgggaggctgaggcaggagaatcgcttgaacctgggaggcagaggttgcagtgagccaagatcacgccactgcactccagcctgggcgacagagtgagactctgtctcaaaaaaactagaaaaaaaaaaagagcaatataaacccagaataagtataagaaaggcaataatgagagaaaatctatagaatagaaaacagaaaaaccctgaaagtaataaagttaacayagacattatggctatttgaaaagaataataaatcattagcgaaactcatcaaagagagagagacaaaactaagttatcaaaataaaagagaggacatcactatgattgctaaggataataagggaatattgtgagcaactttatgccaatatatttaagaactcagataaaagagacaaatgacttgaaaatttttacttgccaaaagagacatataaaataatagaaaatctgaaaaactcatatctattataggatttgaatttattatcaaaaaccttcagacacatacataccccaaaagaaaaacaacaaaaattatcaccaagtccagatggtgttactggtgaatggtatcaaacattgaaagaagaaataatgctaatcttataagactctcaggaaactgagtttattttataaagccagaataatgagtatacccaaacttagaaagacattacagaawaagacaatgataaatcaatatctctcatgaatacagacacaaaaatatgcttaagaaagtattagcaaatcaaacctagcaatatgtaaaaaagataatacatcatgacaagtgaaatttgacccaggaattcaagttagatgcaacatttgaaagtcaatttgattaaacatttgaatagcataaaagagaaaaacaatataatcatctcaatagaygccaaaaaataacatttgatacgtttcaawgtgtcaaacgttattgtttattgttatatttcacattctattaatggtaaaaacagcaaagtagaaatgaaagggaatttgatctggtaaagggcattgtctcactccatttcctgctgctataaccaaataccacagactgggcaacttataaagaaatttatttcttacagttcttgaggctgggaagtccaagagcatgaagctgtcctctggtgagggtcaccacacaacagaagagcagaaggccgaagcaggcctaggtgagagagagggaggaaatcatgccaaactcattattttttatcaggaacccactcacatgaaaattaacccagtcctgagacaatagcgttaatccattcatgaagatggagccctcataagctaaatcacctcttaaaggccccacctccctggtcaacatggtgaaatcccgtctctactacaaatacaaaaattagctgggtgtggtggtggtgcgtgcctgtactgacagctactggggaggctgaggcaggaaaatcgcttgaacccagagacagaggttgcagtgagccgagatcgcrccactgcagtctagcttgggcaacacagcgagactcatctaaaaaaaaaaaaattggcgggcatggtgtctcaagcctataatcccagcaccttgggacgccaaggcaggcaggttgcctgagctcaggagtttgtgaccagcctgggcaacacggtgaaaccccgtttctactgaaaatacaaaaattagccaggcacggcagcatgtgcctgtagtcccagctactggggaggctggggcagaagaattgcttgaacccaggaggtggaggttgcaatgagccgagatcaggccactgcactccagcctgggcgaaagagtgagactctgtctcaaaaaaaaaaaaaaaaaaaaaattcaacatgagttttggagaggacattcaaactacagcaggcatctatgaggaaactataactaacatcatatctaatggtgattaattagatgtgttctaagatatggaataagataagcatgtctgctttaactatttctatttaacattgtactggaaatcctatccagggcaattcagcaacaaagatgaatagaaggtataaagattggaaaggaagaactgagacagtttttggttactgacaataggattgcttacatagaaaatcctaaataatctataaaataacaactagaaatatatcaatttagcagtaccatagcatacaaggccgatggacaaaaatcaactgtatttctgtatagttgcaacaaacaatttgaaaataagggaagctaaatcaattccattagcaatagtaacaaaaatagttagaaatatgtttacaaaagatatgaaagatttgtacatggaaagtttgcaaaatattgtcaagcttaagtaacaaatatctaaataaataaatttcatggattgaaagactcaaaattgttaaaatgtcaattattctcattcatctctacattcaatgcaatcccaattaaaattccagtaggcttttttaactgaaaaaaattattctatatttaatatatacggaaatgcaaaccatttgggaggtgggtagtagggggaggacttgaactgcctgatttcaagactgactatacagctcataattaggacaatgtggtaattagcatgagaatagccaaataaataaacggaacagaatagagtccggaaatggacacatacatatatatggtcaatttaatttcaacaaaagtgataaggctattggataaggaaaaaaagtcttttttttttttttttttgagacggagtttccctcttgtggcccaggctggagcgcaatggctccatctcggctccccgcagcctctgcctcccgggttcaagcgattctcctgcctcagtctcccgagtggctgggattacaggcatccgccaccacgccccgctaattttgtatttttagtagakgctgcgtttctccatgtcggtcaggctggtctcgaactcctgacctcaggtgatccgcccgcctcggcctcccaaagtgctgggattacaggcgtgagccaccgcgcccggtcgaaaagagtcttttcaacaaatggtaccggaacaccattaaaatatggagaaaaatgaacatcaatcagcgccccctttctcttacccactcctcagccccaaggtcgccctgggagttcttcgcaggcaggaccgtgactcgcgtggctttcgggaggctgattacccacgccccrtgcccgtgcagcgctgggtgcagaggaaccgctggaaggacctgtcccccgtgggacccccaccaagtctcatcccgtgtcatgtgccagatagtctcccgtggtttaaggactttcaagactcttaacaggttaggaaaatccagaagaaaggcagaattgggtccctcgggcttgcctgacaccagggacggtggagttgaggtgacatttcactggcatggagacctgaaaccaaaagcaggatgagccgggcacggtggctcacgcttgtaatcccagcactttgkaaggccgaagcgggcggatcacgagatcaggagctcgagaccagcctggccaaaacagtgaaacccccktctctactaaaaatagaaaaaaaattagccggacgtggtggcgggcmcctgtaatcccagttactcaggaggctgaggcaggaaaatcgcttgaacctgggaggcggaggttgcagtgagccgagatcgtgccactgcactccagcctgggcgacagagcttgactccatcwcaaaaaaaaaaaaaaaaaaaaaaaaaaaaaaaaaggcaggctgaatcactcgccmggtagtgacggaggaggccgtaaaagcctcttagaggccagaccccgcagtggcctctgtgtccttcattccgccacccatccgtccaccgagcgcctgctgggtgccaggaactgggtcacagaaaggctgaggtcaactcccgaccgagaagcctggcgctgggaccaagtggcaaaacgactccgaatgcagcggcatccacgcggcggccgtggttgaggaacagaagctgagagcggcaagggcggtcacagaggaaggaagttcagggttagccaacaggagccgcaggtgccccgaaaagggggcggggtcaggggtgccctgaactccgaatgcgaagttctgtcttgtcayagccaagcacgctgcttcttggattgacctggcaggatggcgccaccaccagctagagtacatctaggtgcgttcctggcagtgactccgaatcccgggagcgcagcgagtgggacagaggcagccgcggccayacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtgagtccccaccgcggtcctgcctggggaaaagcgcgcctggcaccgggagggggcagagagagagggggacgcggcgggggtgcctggcccgggtcacttgtggcggggcatgtccgggcaggaggagcccgtcgtcggagtcggaggaagaacggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtgtgtaaacttccaagccaactcccagccacaccagctgcgtgaaggggagcgccattctccccactccctgattccctccccacccccgtccttcttttcttctcttctttttttttttttgaaacggagtctctctctgtcgcccaggctggagtgtagtggcgcgatctcggctcactgcaagctccgccttcctggttcaagcgattctcctgcctcagcctcccgagtagctgggagtacaggctcctgccaccacgcccggctaattttttgtatttttagtaswcacggggttwcactgtgttagccaaatccgcccgcctcggcctcccaaagtgctgggattacaggygkgagccaccgcgcccggccctccatccttcttttcttagacaaattggttaaacacgcagcccggcaggaaaaagtaactttctctcctctgctcgttgtcttccgtttcgagtccactgagcacaccggcagcagtttccttccagccactttcttgcgcatcaacaggtacagggcagcgaattgaccaccacgaggcaggcagccaggagcggggcacgcccttccttcaggaggcagcgtttcctgtgaaagcaatcactcagtctggaaaaatgccaatgccttcagttctctttcaagttcattaaggctctaccaattgttctcatccagattccttctatgttaaggaaaaacaaaacgaaagctaagtacctgaaggataaaccagtcttacaagtgtcaggaaattttacgtgtttttgtttaacaaactaaacaaaatccaggaatccaatagcattttgaaatctccaaataattacagaatttatgttttaaacgtcagtttatgttaggtggaacccacgtttgactcttatttttaatacgcttattaaatggctttctttttgacaggctagtgcgattccaggtggatgtagggctcacctgtatagacaaggtgaaacatctgaatttggtggttttggaaatgtcacagtccgttggtgtggctataaaagaatacttgaggccaggcgcggtggctcacgcctgtaatcccagcactctgggaggccgaggcgggcggatcacgaggtcaggagatcgagacgatcctggccaacacggtgaaaccccgtctctattaaaaatacaaaaaattagccaggcgtggtggtggccgcctgtagtcccagctactcgggaggctgaggcgggagaatggcgtgaacctgggaggcggagcttccagtgagccgagaccacgccactgcactccagcctgggcgacagagggagactccgtttcggaaaagaaaaaaaataaaaaagaaaacttgacgctggataattttaaaagaggcttatttggcacatggttctgcaggctgtacaagaagcatgccaccagcatctgcctctggtgaggcctcaggaaacttccactggtggtgaaggggaaggacagctggattctgcccatcaggggaaggggtggggaggatggcaggaggagggggatgagatccggaagggasacggggaggggccaggttcattctaacaaccaggtgtcatggggaactaagattgacaactcctgggggaatgtgggagggggcggttatggcaccaagcctttcatgagggatccaccccaaaccccaacaggccccaccagctacattacggttcagatttcaacgtgagccctggcagggacaaaggacccgtagcagacaccaaggccttctgccatcccacaggaccytctcatcccaccatccctcagccttcttcctgtgcatttataggcaccttaacttttaaaattctgactgaagaacaaatcgcattggatgttttctatcagtacatgcaagtatctcattctttttaacagcatcataatatttagtgcatgggtgaaacacatggcgtgaaccacagttaattttaatcttccatcccatgggcaattgttaacattatgtcctgcttttgttttttctaattccagcagcattgtagtgagaacccttgtatgtgtcatatgtccatatgtcaatgttccctgaagtatcgggcagccctttagaagaggaatttttrggtacatgagctcatcaatgtagaattttgtttggatattgctaaattgtacttcgggagaagattgtgccagttttactctcacaccaagaatacaaaagtgtggccgggtgcggtggctaacgcctgtaatcccagcactttgggaggccgagacaggtggatcacgaggtcaggagatccagaccatcctggctaacacggtgaaaccccgtctctactaaaaattgaaaaaaattagccaggcacggtggcgggcgcctgtagtcccagctactcgggaggctgaggcaggagaatggcgtgaacccgggaggcagagcttgcagtgagccgagatctcgccactgcactccagcctgggcgactgagcgagactccgtttcaagaaaaaaaaaaaagaatacacaagcgtgcccgtgtccctgcacccttactacatggaactttcattctttgctactctaagaggtaaaaaatgatagacctcaatgttgtattttttgtttcagtgttattagagattttcaaggatccaggaattttttgagactgggagtagatgacctagagactccagattagaccgytggggagggagcagggaagactgcagtcgcacctctgcacttaggaaactgtggtcggctggggccagttcctgccacccgccatgcctgtgaatggagataatgtctctgtcctcagactgtcaggatgacatcagatgagcctggagctgagctcagtttctcaccccaggtcctggctctgtcaatgctggactggcccaatctctgtgccaggtccttccacctcgtctcgtctctctctttatcaaagtaggaaatgagaaattctgatggctctgaagcttagacactcaggctatcagagcccagagattggaggctgaagacagccagggttggccgtgctcctcttcagctctgtgactctgctgtggccccagctccttcctataaactaggtggatataaaagtctgcagcggccctgtgtaaaccacagtggtctgtgttggcagatgtgtgctgtcgtgtgggaggacaaatcacatgctcagggctggtgtcagtcactcaggactctggatccccagagcacctgtcctctacccagcagaggctgcacctgctcccacctgcacctccatactggctctctgagcttggggcagaaggttctaaggaatggggtggagcgccatggggaggggccgtggaggaacagaggagccagacttcaagttaggacaaagatgtcactgcagggccacagcctggcttacctgccacgtttccttccagttgtccttctggtgggcacccggcactggttgcagtttgaagagtgagcaggaaaggtctccatccatgtggctgcagatggctgctcacccagcccctactgagaggcaacagtcccagttctggtcctctgtcctgtatccaggagtgacagggcagcaaggctttagcttccaggtcggagatggggacagtgccatgccctgagcctgtgctgttgggcagttggtgtcacttagtctggaaaaatgccagtgccttcagttctctttcaagttcattaggacaggtgccctggggatccagagtcatgagtgactgacaccagccctgagcatgtgatttgtcctcctacacggcagcacacatctgccaacacagaccactgtggtttataaagggccgctgcagattttatatctgcctagtttataggaaggagctggggccacagcagagtcacagctgaagaggagcacggccaaccctggcagtcttcagcctccaatctctgggctctttgatagcctgagtgtctaagcttcagagccttcagaatttctcaatttctactttgctaaagagagaggtgaggtggaaggacctggcatagagattgggccagcccagccagagactgcacatcttcattcagggtattttcctaacccagggatgtggggattgttgctctcattttgtctggggagaaaatgagatttaggaggaggaagtccccagcatttgggacctggcctgcttgataatagcagctgcctgttggactgggaagggcctcttccggattcccaggcaggtatctgtgataatggggaaaggagaaagggtctgctttgtagggaagagcagggtgcactcggcacctcagacactcgcctgtggccaggaggggatgtgaatcatcacattttacagaggagaggaccaaagctcagagagggaaagtgtgtgcagctcagagggggaacgtgtgtgcacctggccacaggcaagtctgtccagagcactggtaggaatgagagaaactaggaatgaccactttaaaaacttagatgaagagaatctcaaagttaagtcattggagtttgttggtaatatatttgtgtggcttaggtcatgttaagtgcatcacaccctcgcccccatgtctgctgttggtctcagcactgggtggagggagcggggacagtcctgatgaagaggagaggggagcagcaccggctggggtggggcctctgccgctgcctcttcctgtgtggtttttcagggcttaggctgcscctctcacctggcttgtctgtggggaggagatctttgttctctggctgcttttaagattttctccttaacagtgtggtttcagcacttcgatggtggcaaaaataatctgccggagccatgtctgtagcatttttggtctccccttctgtataatagcagccgtgttttggcttctgcagggctaaggtcctctgagcagctgcttctccacatctctgccmtgcactyggccttggagctcctrgkgttcctyagcagagtccacaggrctcttyggggtcccmtccctgtgctgtagcctggaayctgtgacctgaggcggtgagctgaggccaccactgggctcacctcatgggcttggagggaaagtcactcacccaggaagtaggtgatgagcactttactctgagaatgtctgcgcctggtggtggtgggaggacaaatgagccctgtgtcagtcctgctccctgaagcccacagtctggtggaggaggtgtcactagggacctaaataactatcaggaagcaggggggccacctcccccaccccccacctccagagaggctgtgccgrctccagggatgccatccctccctacttgactccagcagttgcaaggccccaggtcatggtattggtggcttagaggatgtggtttcattaaaatcaacattgaggggaatgattgtactaacaacagcatgtgctgaaatacagtacttgcgtgtgccaagctctgttcttagcacttcatatgtaaatgaacacacttaatcctcatacaaccagactgtacaggaaccctcattgtcyttgttttagacmaacagcatgagactcagaacatttgttcagtagaggggctgggcaggaggatgagcraccctcggggcagcagcagtgattgggtcactgggttctgctgacctttcccaggggagtatttggtgctttttcatgaggcctgcattcacccagygctgggtcactgctgggggtmcctgagaagtcatgtaaagccacctcttatttccagaatgatagacatgtttagagaagaagtggcttcccccagaccatgaggctggcccgagactacaagacagatggcttgcttcttaacccaggggtctttttataccaaaagaacaaagaaataaaaaagccacgaaagactcaaaggaagcagattttcgaccacagccaacctcagaacaattctgagttgctcattttaagatcaataaggcatttttttagggtgtgtatgcctgagagaggaaatcagtgtgaatatcaaacttrcctctgaaacagcctaacacaatgctaatccgagaggaacaaggcaaggaaaccccctggtgaatgactcatctcaggaagaggcagggcagggtcaggagagtctatggaggagaagacctggaacaagacctctctctcttgctctctttctctctctccctctctctctctcwcacacacaaacacacacacaacctcacacccccatgagcccaaatctgtgaactgagaacctcacttctctgacctcaccttccatctcccttaatcagacgcccacaaacctcagagttgtgtcccagcatcacttgttttgactgccctccccgactgccttgacttcgtatctgcctaggaacctgsctgtgtggacttttccctctatgtggacctttccctctatgtctaccggtgtccctgccaccagtggcatttgtcacctctgcctgggcagcccctcgtgactcgggttattgatggctgtgcctcatctccctgggaactggaactgtcctaaggaaagggagggtcgtgcctttttcttgataccccacgattccttgcacagcgtttctaccaggcgccgacatgccctccttggatgaatgagtaacatgggttctaggaagcccgcaysaatgcagatgtgacgtcctcagcctttcatagacatgtttcatgtgagaggtgggaagaacagctgaacagaaggctgagcactgtccaggtccagagtcaccaggagctcgttgtcaggttttcacttgctattagtagagatttttttttaaggtactatttttagtgttaraagtgaattcaggccgggygcagtggctcacccctgtaatcccagcacttcgggaggctgaggtgggcagatcacgaggtcaaggagatcgagaccatcctgaccaacatggtgaaaccccatctctactaaaaatacaaaaattagctgggtgtggtggcatttgcctgtaatctcagctactggggagggctgaggcaggagaatcacttgaaccagggattcggaggttgcagtgagcagagattgtgccactgcactccagcctggcaacagagcaagactccgtctcaaaaaagaaaaaaaaaatgaattcatcagaaggcataataatcataaatgtgtatatgtctaatagtagagctttaaaataaatgaagcaacgctcaaaaggattaaagggagatcatgtcacccccttctcagcaactgatagaacgatcagatgaaaacagtaaaataacagatctgaacattgtcaaccaccttgacttaactgacatttatagagcatatatgcaacatctatgggagattccttctcttctatgaacatggtacttcaccaagatagaccacattgtgaactataaaacaaatctaaatacatttaaaacaaaataatataaaatatgttctctgatctcaatgaaattaaagtgttaagcaataacaatatctagaaggactccaaaaatgtgaatattaagcaacatacttataaataactcatagttcacgratgaaatcaaagagaattcaaaatatttctttttttttttttttgaattggcttctygctctgtcgcctaggctggaatgcagtggcgtgatcccggttcactgcaacctctgcctcccgggttcaagtgattctcctgtctcagcctcccgagtagctgggactataggcacctgccagcacgcccggctcatttttgtatttttagtacagatagggtttcaccatgttgcacaggctggtcttgaactcctgacctcgtgatccacccacctcggcctcccaaagtgctgggattacaggcgtgagccwccgtgcctggcctggagtttcttttggggatgatgatgaaaatcttcaaaaattgattttattgatggttatacacttctataaatatatttaaaggaaagaattacatcatatataaagtatatctcagtaaagttcttaaggattaaaagaagaatggtatcaaaatcaatgactcagaggtstgcattacttacccgtaaaataagtataaattaaactcaaaggtagtaacaacatgacaaggaaataataagactgaaatcaatgaaatagaattcaaacaataaaaggaatcaayaagctaagagttggttctcagaaatgatcaacaaaattaataaaagtaataaactggccggacgagatggctcatccctgtaatcccagcactttgggaggccgaggcaggcgattcmcctkaggtctggagtttgagaccagccggaccaacatggaggaaccccatctctactaaaaatacaaaattagccaggcgtggtggcacatgcctgtwatcccagctactccggaggctgaggcaggagaatcgcttgaacccaggagaccgaggttgcagtgagccgagatcacgccactgcactccagcctgggcaacaagagtaaaactccatctcaggaaaaaaaaaaaaaagtaataaaccaaactttaaaagaaaaaaagaacaacagcatgaaataccaatatcaagaattaatgatgggatgttattacaaactctacagccattaaaaggaaaatagtgggatcttatgaataactttatgccaatcaatttgacaacttggattaaatagacaaatttcttaaaaaacactacttagcaaaatagccacaagaaataaagataatttaaatattcctaaagctgtctatgaattggaattcattgtttgttttgtttgtttatttatttatttatttatttatgctattttttgagtcggagtctcgctctgtcatgcaggccggggtgcagtggtgcaatctcagctcactggaacctccgcctcctgggttcaagtgattctcctgcctcagcctctggagtagctgggattacaggtgcccaccaccacgcccagcatatttttagtagagacggggtttcaccatgttggccaggctggtcttgaactcctgacctcaggtggtcgcccactttggcctcccaaagtgctgggattacaggcgtgagccacggcgcccggcccccctgctcttccttttctaatttaactttctaatttaaaaaatctcccaattacagaaaagatgcaaaaattatactataccctttactttgaaccacctgagagcaagctacccacagaacgcacatcacccttatacacttgagtggatatttccaacaaataaggacattctcccgtataaccacaatacaatcctcaatatcagacagtaagcatcagtacattactaccagctaatcctcagaccccaatggttttcacttgtctttataatgtaatttattgcacagaaatcctgtcctgaataactatactgctctttcatctttttctgactctagtatttcatgggacattggcaggctgttttgggggacagtttgtaaagtgcctttttaaacctgaagttcattatttaatatttgattcagtatcctgctttttaaaaaatttacacatcacctaaccctcattagtaaaagcgtgtrtatgtctgtgtgtatgtgaacactgcccaatcacaggagaatatccatttttctcaagggtacatgaaacattctccaggacacactatatgttaggccacaaaacaagtcttaatacaattttaaaaattgaaataaaacaaactatcttttccaatcacaataaaaggaaattataaatcaatagcagaaggaaaactggagaatccacaaatatgtgaaaattaaacaacacttttttgctgtttttttttttttgagacagtctgtctctgtcgtccaggctggagtgcagtggcacaatctcggctcactgcaagctccgtctctcaggttcacgccattctcctgcctcagcctcccgtgtagctgggactacaggcacccgccaccacgcccggttaattttttgtattttttaatagagacgggttttcaccgtgttagccaggatggtctcgatctcctgacttcgtgatctgcccgcctcggcctcccaaagtgctgggattacaggcatgagccactgcgcccggcctaaacaacacattttaaaacaaccaatgggtaaaaaaataaatgaaaagggaaattagaaaatgtcttgggaggctgagctctgtagctcacgcctataatcccagcactttgggaggccaaggtgggcagattgtgggaggccccacccccctcaaaaaagaaagaaaatatcttgagacagatgacaggcacactaaaatctcagaactcaccactaaagaacttatccatgtaacaacaacaacaacaaaaagcagctgtaccctcaaacctatggaaattaraaaaatgtttcaaaagaaaatatcttgagacaaatgaaaacaatataccataagttacaggatatgaaagcagtgttataatggaaaatgatagctgtaaatgctcaccacattaaaagaagaaataaatgaacaatctaccttttacataatgaagtagaaaatgaagagcaaacagctgggcgtggtggctcacgcttgtaatcccaacactttgggaggccgaggtggacggatcacgaggtcaggagatagagaccatcctaacacagtgaaactctgtctctaataaaaatacaaaaaacgtagctgggcatggtggcgggcgcctgtagtcccagctactcgggaggctgaggcaggagaatggcatgaacctgggaagcggagcttgcagtgagccaagatcgcaccactgcactccagcctgggcaacagagcgagactctgtctcaaaaaaaaaaaaaaaaaaaagaggagcaaactaagcccaaaccagcaaaaaatagatcagagataacagaaatagagaatagaaaaactgcagagaaactcaaagaaactgaaagttgacccttaagagagatctataaaatgtacaaacctttacttagatggactaagaaaaaagacagaaaacttaaataaccaaaaccagaaatgaaagaggggacatttaaaacaactttacagaaatccaaaggattataaaaaatactataaataattgcatgtcaacaaactagagcacattgataaaactggtaaattactaaaaacacactacctaccaatattcaatcatgaagaaatagagattttgaacagaactatagtaaggagatagaatccataatccaaaacttcccagcaaagaaaagcccaggaccagttggcttcaatgatgacgtctaccaaacatttaaagaactaacatgaattctcaaattcttccaagaaactgagttggagggaacactttctaactcttcgtgtgggccccgcattaccctgataatatagaagtgatgaaaggaggcctccatgtcttgttcctgatcttggagaaaaaacctttagtctttcactattgagtaggatggtagctgttggcttttcatatgtggcctccaaatgtaagatctataagaattatacaactcttgtaagaaaacagcaattttaccttggggtatatatccaaaagaattgaaagaaagggcataaagagattttgtacaccygtgttcatagcagctttattcacaatagctaaaatgtgaacacaaaccaagtgcccattgacagatgaatggataaacgtaatacatatacacacaatggaaaggaatgaaattccaatgcatggtaccgaatggatggatcgtgatgattttatgctaattgaaatatgacagcctcaagaaaaccataaaatactgtatgtctccatttatatgaagtatgtagagtagttaaattcatagaaacagacagtagaatggtagttgccacaggctgggggcatggggacaaagagacaaagatgagcacaaacaaatggttgagttttagaactgggagaaagatgcaagttctgtctaattttggaggcttgggggaatggaatgtgagattgatcttgtaatgggtgagatctggaagccactcatgccagtccctgctttgtccccacaggtcgtacstagctcagctgcaaccatcaaacttcatgatcaatcaattggcacacagcaatgggaacatagccctttgggagagttgtgtccaccaggtacattctaagactgatctctaatcctttacacctctcttttccttaccctatrctatatacaaaaattatctcaaaattcatcaataacattccttttccatgttcttcaagttttctgtttcctacagtttctggttcttctattcaacagatacttattgatcctttgccaaatccaaggttatgaagctttatccccatgttttctcctaagagttttgtactttaactcttgatgcattttcagttaatttttgtaaatggcatcagataagcgtccaactgcattcttttgcatgtggctatccagttgccattcgttgaaatgatgatttttcccattaaatggccttggcatccttgtcaaaaaccaattgaccataaaggtatgggtgtatttttggactctcaattcttttccattgatctatatctgtcctctttccagtgccacacagtcttgtagtgagttttgacatcaggaagtatgaatctttcttttttgttttccttttccagaattattttgtttatgctgggctttttgaaattccatattaattttaggatcagcttgccaatttctaaaatcagctgagtttctcacagggattgtgttgcacctgttgctcagtttagaggttcctggcatcttaacaatgagaagtcttttgatcccaaagcatgagtttttttgatttatttaaatcatctctaatttttaaaataatgtttcgtagtttgcagactataaattttgggttgattttgttaaacttattcctagatatttaatacttttttatgctattgtggataaaaccttttcttaatttcattttaggattcattgtgagtgtatacaaatataattgatttttgtacattgatcttgtattctataaccttgcagaacttgtttgttattcttaatgtttttataatggcttccttaggatttcctctatataagaaaatataatttgcaaatagagaaagttttaccttttcttttccaatctggatgctttttatttctttttcttacctaattgtcctggctagagcctccagtaccatattgaataaaagtagtgaaaacagatatcttttttggagaacatctttcagttgttcaccattaaatataatgttagctgtgggtttttgtagatattctttatcaggttgaggaagttcacttttattcctagattattttgtgatttttatcatgaaagggtgttggagttagtaaaatgctttctctgtgtttttgagataatcatgtgacttttggttttcattctattgatataatttgttacatcaatttattykgggatgttgaaccaacctttcattcctaggataaaacttatttggtcctggtatataattcttttttgttttgttttgttttttgtttttgagatggagtctcactctgttgcccaggctggagtgcagtggcgcgatctcggctcactgcaagctctgcctcccgggttcacaccattctcctgcctcagccttccaagtagcagggactacaggcgcctgccaccamgcccagctaattttttgtattttttagtagagacggggtttcaccgtgttaaccaggatggtctagatctcctgaccttgtgatctgcctgcctcagccttccaaagtgctgggattacagtcgtgagccaccgtgcccagcctataattctttttgtatgcttktggattcaacttgctagtattttgttgcaaatttttgcaacaatattcataagaatcgttagtctgtagttttctttctttatgaggtccttttctggtcttcatattaagctaattgtattagtccgtttatatggtgctgataaagacatacccaaagctggcaatttacaaaagaaagaggtttaattggacttaacagttccatgtggctgcagaagcctcacaatcatggcagaagacaaggaagagcaagtcacatcttacttggatggcagcaagcaaagagcttgtacaggaaaactccaccttataataaccatcagatatcatgagacttactcactatartgagaacagcatgggaaagacctgcccctgtgattcagatatctcccaccaggtccctcccacaacatgtgggaattcaacatgaaatttgagtgagaatgtatccaaaccctatcacccctggcccctcccacatctcatgtcctcacatttcaaaaccaatcatgccttcccaacagtcccccaaagtcttaactcatttcagcattagctcggaagttcaccgtccaaagtctcatgtgagacaaagcaagtcccttctgcctatgagcctataaaatcaaaagcaagttagttacttcctagatataatgggggtacaggcattggataaatacatccattccaaatgggtgacattgtcgaaaacaaagggctacaggccccatgcatgtttgaaatccagcagggcagtcagatcttaaagctccaaaatgatctcgtttgactccttgtcttacatccaggtcacactgatgcaagaggcgggttcccatagtcttgggcagctccgcccctgtggcattgcaaggtatagcgcccctcctggctggtttcacgtgccggtgttgagtgtctgcagcttttctaggtgcacggtgtwtaagttatcagcagttctaccattctggggtctgaaggacaatggccctcttttcacagctccactaggcagtgccccagtagggactccgtgtgggggctctgatgccacatttcccttccacactgccctagcagaggttctccatgagggccctgcccctacagcaaacttttgcctgggcatccaggcgttttcatacatcttctgaaatctacgtggaggttcccaaacctcaattcttgacttctgtgcacctgcaggcttaacaccatgtgggagctgccaaggcttggggcttccacctctgaagcaacagcccaagctgtaccttggccccttttagtcacagctggagtggctggaatgtagggcaccaagtccctagactccacacagcacaagaccctggactcctaccaggaaactattttctcctaggccttcgggcctgtgatgggaggggctgccatgatgacctctaacatgccctggagacattttccccattgtcttggggattaacactcagctcctcrttacttatgcaaatttatgcagccatctttaatttctcctcagaaaatgggttttcttttctagcacattgtcaggttgcagattttccaaactttaatgctctggttcccttataaaactgaatgccggccaggcgcggtggctcatgcgtgtaatcccagcactttgggaggccaaggcaggtggatcatgaggtcaggagattgagaccatcctggcgaacacggtgaaaccccgtctctactaaaaatacaaaaaaattagccaggcatggtggtgggtgcctgtagtcccagctactcaggaggctgaggcaggagaatggtgtgaacccaggaggcggacttgcagtgagccgagatcatgccactgcactccagcctgggcracagagcragactctgtctcaaaaacaaaaaacaaaacaaaacaaaaaaagaattatataccaggaccaagtaagttttatcctaggaatgcaacattggttaaaaacaaagaaacaaacaaataaacaaaaaaactgaatgccttttacagcactcaagtcaccccttgaatgcattgctgcctagaaatttcttctgccacataccctaaatcacctcttcccagttcaaagctccacagatctctagggaagggacaaaatgccaccactctctttgctttctttgctaaaatataacaagagtcacctttgctccagttcccaataagttcctcatctccatctgagatcatctcagcctggactttattgtccatatcactattaggcttttggtcaaagccattcaacaagtctctaggaagttccacactttcccacattttcctatcttcgtctgagccctccaaactgttccaacctctgcctgttatgcagttccaaagttgcttccatattttcaggtatcttttcagcagctccccactctactggtaccaatttactgtattagtttttttttttttttttcgtgctgctgatgaagacattcccaagactgggcaatttacaaagaaagaggtttaattgaacttacagttctacgtggctggggaagtcttacaataatgatggaaggcaaggaggagcaagtcatgtcttacatggatggcagcaagcaaagagagcttgtgcaggaaaactcccccttataataaccatcagatcttatgagacttactcattatcatgagaactgcaagggaaagacctgccccacatgattcaattacctcccattggatccctcccacaacttacgggaattcaagatgagatttgtgtggggacacagccaaatcatatcagtaatattgtccttatacaatgaattggaaagtgctccttcctctgctgtctttaaaaagggtttctgaataattggtattaattcttcttgaaatggttggtatcattcagtggtaaaggcatctgggcctcaactttgtttttctggtgaaaacatatacatgtatttagaattagccagctggattcagtttagatgatcccaattttgttggcaacatccaagacatggtaatcaggagccagtcgaacatatgccttcttctctccatcaggcctaatcagggtgttgaaccttggccacataaacatcatagagcttcttcacaacctgtttgatctggtgcttgttggttttaacatctacaatgaacacaagtgtgttgttgtcgtcttctatcttcttcatggcatactcagtggtcagtggaagcttgatgatagcatagtggtcaagcttgtttctcctgggggtgctctccagagtctcagtatcttgggccaccggaaggtgggtgatgtatggatattctttttttcatggcagtggacacctttctacactgccttcttggccttcaaaacctttgcatcgcttcagctttaggaggggcaggagcttccttctttgctttcagtgccatcttgtgaaaacgacttttctttaggagtagttttgataactaagtcaaaatctttacttgctatatgtctattcacattgtctctttcatcttgattcagtttcagtagtttgtgtctttctaggaatttgcccctttcatccaaggtacctaattttttgttgtacaggtttcatagtattcttttataatttttttatttctrtataatctgtagtaatgtgctctctctcatttctgattctaatacagwcatgcctcagttaatgatgggaactcattctgacaagtgcatcattgtgcaaacatcatagagtgtacctccacaaacctagatgatatagcctactgcatccctaggctatgtgatatagcctattgctcttagattacaaacctgtactagtagacaattgtaacacaatgataagtatttgagttcctaaacatgtgaacatagaaaaggcccaataaaaatatggtataaaaggttaaaaaagatgatgtagttgtctagggcacttaccatgaatggagcttgcaggactggatcttgyctgggtgagtcagtgagtggtgagtgaatgtgaaggcctgggacattcctgtacactactatggactttataaacactgtacatttaggctacaccaaatctgtaaatttttttttccttccttcaatattaacttcgtgtaactattttactttataaactttttaatttttaaaactttttcactcgttttaacacttagcttaaaaaacaaaaactgtacagctgtacaaaaaatgttctttctttatattcktattctataaacatttttgtatttttaacttaaacttttttttacttaaaaatttttttsttaaaaactaagatagaaacacagacattggccgggcgcagtggctcacacctgtaatcccagcactttgggaggccaaggcaggcggatcacgaggtcaggagatcgagaccatcctggctaacacagtgaaaccctgtctctactaaaaatacaaaaaattagctgggcatggtggcaggcacctgtagtcccagctactcgggaggctgaggctgaggcaggataatcgcttgaacctgagaggcagaggttgtagtgagctgagattgcgccactgcactccagcctgggtgacrgagtgtgactccttctcaaaaaaaaaaaaaaaaagaaacacagacattaacctaggtctacacaaggacaggttcatcaacatcactgtctttcacctccacatcttgtcgcgttggaggatcttcaggggcagacacacatggagctgtcaactcctatgtcctctgataacaatgccttcttctggaaaactgcatgaggctgttttatagttaccttttttatttgtaagtaggagtacactctaaaataacattacaatgtatagtatcaaaaatacataaatcagtaagtcatttattatcattatcaaatattatatatagaacttcattatatgtgctatacttttaactggcagtgaagtaggtttgtttacatcagcattaccacaaacacctgagtaacgcattgacttatgacattactaagcgataggaattttcctcctccattataatattatgggaccaccgtcacatatgtggttcattgttgaccgaaacgtcatcatgcagtgcgtgactataatttgagtcttattttttccctgtgctaattttttaacacaattagttgtgccaatatatcgatctatttaaagaactagattttgagttcattaatttactctgttgtttttctgttctccgtctcattaatttctgctctaatctgtattattttcttccttctgcttgctttatctatagtttgctcttctttttcgagtgtcttagagtggattattaggttatagattgagatatttcttcttccttaatagacatttaggaaggatatttcttcttccttaatagacaatttctctgtaaacttcagctacgttagctgtatcccataggttttggtatgttgtgtcttcattttcattcgtcttattttctgatttctcttttgatttctttttagaccagttggttatttaggagtgtgctatttaatttttatatagctgtgatgttccccagtttcttcctgctattgatttctaattttattccattgtggtaggagagtgtattttgtattatctctatccttttaagtgtattgaggtttatcttatggccaagcatatggtttattttggagaatgttctatgtgcactttaaaagaatgtgtatcttgttttgattgagtagagtgttttatagacatctgtccagtctagttgttaatagtgttgttcaagtctactactttcttgttgatgttctttctagatttttttggtatgaattcctataggttaaggaaactatgctttgcagtgtggttttcattgcaagtattttctcctactttgttttcatcttagtcaagatttcttccatgcagttttcttcctaattttyatatagttaactttatgcaactttttagtttctcgwgagactgagaaggtcctttctctctccaaacttgtaagaaaaatttctcrtgcagtacttgtgtgatttcatactttacagttgacaccttgatagacctagtctctatttccttatagggagagcataagcaagaagctttattatttttcagcagtaaccttagttgccccagcgccattactgaataatcayatttttatcatcgrtagtgtcatcatcataacacatcagcaaggaagtttttccttcacagtggcacggtggctcactcctgtaatcccagcactttgggaggccgaggcaggtggatcatgaggtcaggagatcgagaccatcctggtgaaacctagtgaaaccccgtctctactaaaaatacaaaaaattagccaggcgtggtggcacgctcctgtagtcccagctactcgggaggctgaggcaggagaatcgcttgaacccaggaggcggaggttacagtgagccaagatcacgccactgaactccagcctggtgagagagcgagactccatctcaaaaaaaaaaaaaagcctttattatttttcagtagtaaccttagttgccccagcactattactcaataaccacatttttataattggtagtgtcgtcatcgtaacacattatcaaggaagttttttttccacagtttgggttttctaagagtatctttcaatatcagtaaatatgaatcagaggagagggataaataaatgggcactgaaaggggagagtgaggtcacctgaaggggcgaagccctggaggtgaaggtcgagcctccagacatgggctcccgctggcgacagctcctgcaggctgtcacctcagtgcctggagaccctctgcaatccagggcagcatgaggtaggccttctttctgtggatcattctttgactctgtatagggaggaccctttttccttccattttcctcccatggcaggtggcatgggctgtatctgaagccttcccctcatcgctgtattgtttctgcgcctgtttgtaccttctactgaccaagagctcactgagggcagggattaggactttttgtgagtttccagggatgcaggtggcattgccctggtctctaggcytatgtggccattaatcacttaaaacacagccactttgaattgagatgtgcagtgagtgaaaaatacactctgggtttcgaacacttagtattcaaaataaaagaaaatatctcaatgttttatcttgtttacatgttgaaatgctaatgttttggatattttaggtccaaaaagtacattgttaaaattaatttgacctcattctctttttactattttaatatggctctcatagaatttgaattttgcatgtggtttgtattgtatttctgtcagcagcgccagtcagaggtgtgtatagatgcagaattgacgacaagaccaagccaagaagatgggatttctctgtctggggtctactgatggccaaaagaagagtttcctagccaccgccacgatcctctgggaactctgtggcaattcattcattggcttttctctcccttcccaggatctcatagatcagaacrtcctggagcctgtaaccggtgcacagagggtgtgggttacaccaatgcttccaacaatttgtttgcttgcctcccatgtacagcttgtaaatcaggtacagaatgtgtggacctcttgtccagaggtggagtgaggggcagtgaggtgggagtggtagccaatgtgagtcagggaaccaagttccagcccaacttggtcttcatcataccctgttccatggttatgtcttaggtccataaaatgaaacagaaagaaatcatttttataatgcatgccacctggtagtgcaaactatcagctccaagagggtaggggcatcattacagcacaaagaaggcctggctgagtggacagggctgagtttcagcggtggtacgggtctgctctggggccacgctccccctgggctgtgtgctcctggcaggttctcaggctcactcagccttcagtttctcaggcgcctccctcttcctcagcaggctgggtttttgggaagtcacccaagggctcctcttcttgcagactctctcacataccatgtgcctcctttgctactgaccatgcgatctaaatggtgctttttccctaatctgatgtaataaataatgaatcatggtccttttgtatgactccaagtgttggtgacagctgaagggtgggtrtcctgtgtgagcccragtgtgctggtgcagaatctggccctcagaactccttggcaaactgagttgagctgagctgagggggagggagttggggtggtgaggaaaggtcaagggacacgtcagggaaacacattcccaaaaccttgtactctgtcatcagatgaagaagagagaagtccctgcaccacgaccaggaacacagcatgtcagtgcaaaccaggaactttccggaatgacaattctgctgagatgtgccggaagtgcagcasagggtgagacaacagccaaggggctcccagcagcctcaaagaamccacagaagcaagaaccctaaaaagacccgagtctccttgtacccgtatctatcagccctgaccccatggtgcctccacccccataggtgtccctgagcctgtggcgtctcctgagcctgcaacctgcycctcctggtccatctgcctgtccccacccctgtcccctgcagtggccccttctcacccctccccagcactagtccccttggccaggctgacttgttcactaggcacaggaggccatgacttagggcccacaacagaggtacatgaaatattttatcttgaaatcataagaaaataatggtatagaatccagctggggttatatttatatttaaacaaattgagtcataaaatgtaatttttaatatttgcttttaattcaagaagacagaaatgcccacagcccgcaaaaatcataataaggccatgggtggagctccttcaagttcccatgaggacctgagcccacccagccagcctcacccctggcccctgatttctcaataagtcctgtctttttcctattttggttttggaagcaaagagtaattgctcttctctggtcctccagtgtttgctgtgattgagaggaaccagcagacaggtgggggcgagggctcacttgtactgtgggttaactggaggaaggggctcagcttgtggccacacgggcttgtgatcttcccctggagtgtgattcctcctaacgcaggcctyccctgcagcccagggaagattagtgtgtgcccagcacagaaggctcctggaactgcagctctgaccccagagcagggaggccraggggstraagtgygcatgctcagacccttccccagcctmaacaagggagcatagggggaccccctgcagatacgaggagactatccttcccctgacgccttctcagggacattgggcagggagagtggctcctctttcatcccacctggccagctttccatcaagagtcccccccctccctccctgtgtgtacccaggtgccccagagggatggtcaaggtcaaggattgtacgccctggagtgacatcgmgtgtgtccacaaagaatcaggtacaaagcccrctggggaagcyccagctgcagaggagacagggaccagcagcccgagactcctgtcttttcctgtcttttctcaggcaatggacataatatatgggtgattttggttgtgactttggttgttccgttgctgttggtggctgtgctgattgtctgttgttgcatcggctcaggtaggtgctggctgagggcaagggctctgggcactctctgccctgccttcttctgttcccacagacagaaacgctcacccctgccccaagtcctagtgtctctggccgggctctatcttcctccttgtgatcaccccccatcctcccatcctgtgcaaccctagggccctggtgtcatccrtccctctcccaaggctgggggtcccctcatctcccagccaagtctgggaaggcagggccagttcctccactgktcaggcccatccaggcagggggcagtcagctcctcaactggatgacaagagtcgagacgagaagtggttgtgggatttatgtagctttgttcagagcaaaacacaragcagaaaacagtgatgttccacttgtttgtttttagcctacttccctttatgctccccgctcctgaaggatctcccgagttagcagggcctcatgtggatccccaggcccggggatctttgtccagtgtcccagcccccagcccacccctgcccaacactgccctctaagaaggagtgctgcatgggccyctccctggccactaagggaaccgtcttctcttctaggttgtggaggggaccccaagtgcatggacagggtgagttgatttctccaggagctgggggcatcaggggctcaggaactgcttcttgcccacagtgtagtccaggtgggtgggtmcccgtgctctcatggctgccctgagtctctgaagtggcctggatgctgtgcattgactatgggggacacaggcccttttgagcatcatacaggctggtgggccattctgtagccctgtgcttcctacagcccagrtgagacccttaccccacagcctgtaccctggggatggggtgagcccccaagcccagcaccagggcctggccccagcagcaggtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacmacgagattctgagcaaygcagactcgctgtccactttcgtctctgagcagcaaatggaaagccaggagccggcagatttgacaggtgtcactgtacagtccccaggggaggcacagtgtctgctggtgagttggggacaggcccctccaagaccttgtaggcagggggtgaaggccatgcctcggctctcctggtcaaaggggaagtggagcctgagggagatgggactgcaggggacggggctgcgtgggaaaaagcagccaccctcacaaggggacaggcactcttccaaatgtctgcttcttagtccctgtcctgtccttgccatgtcctcagaaactggagctccagaggaatagagtgggggtcacagggtttgttgatgactgaataaggctgcacggtctccactgtgtgctcctacagaagttagggagcccttgctcataacagcagggattttaaatttactctgaaattattattgcattaaacatatttggatctaaatctctgcccaaatttctgcatatggttgtatggaggattccaagaagaagcacaatttccaagtcagcctgtaacagtgctgcttactgtgtacacgcacatacacgcacatgcacacacatgcatgtacacacatgcacacacacatgcacrtacccacacatacaggtacacacatgcacacagccccctagtgttggtttgtaccagttcatgtattttsatttgacattgaagggctttttcttttctttttttttcttttttttgctatttaggaaaacattgttttaaacgaacatttctttgttttcactgtttttgcgtaagatcagtgtcttgtctctcagagtctttatgagaaggcctgctctcctactcatgcttttwctcacattcagacagtagattcctaatttcttcttgcccctttttgttctaatattttcaggtgtagaagctttaatttttaaccagtgaaatctgtagatacttttaccttttcattgctcactactgtagaaagaccttttgccaacacaagacgaactcctctaacttcttatggagatatttttttcaatgatgtgatttttgcatataactttataatctaaatggaacttgttttgtgtttcagtgcaaagcgaggcactccctgaatygttctagtcactgtctggtttttccaacccctttgagctgccgattctcccatttccctctgctttgggtccctccttaatcacaggttaaatgctcatctagacaatgatctccttccacctagactgttccattcagttcctttcttgcattagtacccatttattctaaccaaaaatgtaattaaaaaaaaaagaaggcaaacattaaaaaggtcaataatctccagcttgataaggtgctttgacatgaacaaatagtttatatatttaaaatgagaaaatttaaactatcaaaaggtactcagtaagtaaagagagcatcctccactctgcagtgccctgggtctttttcctcaagtaactatgagatatcatttcttgtgattctttgtccaaatctatgcatcagtgtatgtgtatacaaaagacattatattattaacgaatggtccccaaccttttggcaccagggaccagttttgtggaagacaatttttctatggactgggaggtgaagatggtttggggatgattcaagcacattacgtttattgtgtactttatttctattcttatcacattataatatataatgaaataattatacaacttatcataatgtagagtcagtgrgagccctgagcttgttttcctgcaacgagatggtcctatctgagggtgatgggagacggtgacagataatcaggcataagattctcataaggagtatgcaacccagatccctgacgtgcacagttcacaatagggtttgcactcctataagaatctaatgttgccactgatctgaccgggtggagctgaggtggtaatgccagcaatggggagtggctgtgagctatgtgggaccagaggtttttcaccatctccatggtgacccaagggggaaagtgatgtgctgcaggtttccgggctggctgatggtcagrgtcagtactagactgcaggacccctgactcagaccaaggcattccccactgtgtgttacagggaccggcagaagctgaagggtctcagaggaggaggctgctggttccagcaaatggtgctgaccccactgagagtaagtgttktgctcctggagatgcagcagaaatggtgggaatagggacggtgtcctaactggtgtccccattgctgagagtgctcttccagagcattccatgccagaaactgggggtcctatgctatagaccatcaagaccctaaattgtcttctcccatctcttcttcccactctacctcatcctttctgcaccctattaatgacactagccactctgtctatcctcttctccacctcctctcktctcctttgttgttcaggagaacaacagccctgaggggctgccctgtcctgcatggcaccactgacttcagtgggctaatagctctttatctgtgcctaagcccaatttgcagagctgttgtataaactacatactgattccaaagacttaatgcaagaaagaatggaaaatattccactcattattttgttaccgaaacaccaggtgttgggtctaggtcttggtgctcactgcacagagggccaatcactgagacaattagtattgacaaggaagaatactttcattgagtgctgtaggcaaggagatgggagctcagtctccaattcatgtcccctgatggactaaaactaggggtttatatagtagggataaaatgtaacaatgtgggccgggcacggtggcttatgcctgtaatcccagtactttgggaggccgaggcgggcgaatcacaaggtcaggagatcgagaccatcctggctaacatggtgaaaccccttctgtactaaaaatacaaaaaaaaattagccaggcgtattggcgggcgcctgtagtcccagctattcgggaggctgaggcaggagaatggcatgaacccgggaggcagagcttgcagtgagccaagatagcgctactgcactccagcctgggtgacagagcaagactctgtctcaaaaaaacaaaaaagtaacaatgtgtaagaaaacaggaactagggaggggtaaggaagcaatcaagatgaatgaggggtccagcatcccattggatgtagtgatttgtaagtttcagttctttgatactttgagaggcctgaaggtcatttcctgaaaaaggaactcagataaaacaaatgtaagatttgagctttaagaacagaagggtcaatttctatgtttatcaaaacaacaacaacaamaaaaaaaccttttgatggacmtattgggttgatttcagttctccctttctatttatcaatcccacagtcacagagagtctggtcctggatctttctggctgcttcatggttgaggaggggcatcatgggaagcttcacataccatgggtgacctcatggccacccaggaatcaaaggttaatttmatactaaaagattgtgtttcttctgaaacacaatctctctctctcggccccacttccaccaaagacaaattatagcaggaccaatgtacctgcaaaataagtttagttccatatacgtggcctgattacccacacaaagtgcagcaaaaatcactgtccacataggctctcctaagttggctttgctggaacctctcacgaggccattgcaatcaaagccctgagaaaataaccattttatccaactgtgttccattgtaaaagaaaacgttgttattaaccatatgtaagcaaacacattgccatgaattaatagtcacaaataatttaaaaattctagagaaattaggcagagagagaaatatgcctcaaattctgtttacaaaagtatactcaatatacttaaagtatacttaaaggctataaatagcaaagaagaaaaaagttctccagactggaaaacaaaaccaaaagaatcagcaatatttcaaaccaacaaaagccatacgaattatttcagtcctctattagttcagtccactcaatcagctcctgcccagcttcatgtttggttaacaatcacaatctttatgaacacatcagtctttcttctttttttgttttgagacagagtctcactctgtcacccacgctggagtgcagtggtgcaatctcatctcactgcaacctccacctcctgggttctagcaattctcacgcctcagcctcctgagtagctgggaccacaggtgtgcaccaccacatctgggtactttttgtatttttagtagagacagggttttgccacgttggccagtctggtctcaaactcctggcctcaagtgatagacattcgcctgccttggcctcccaaagtgctgggattacagacatgagccaatgygcctggccacacattggtctttcagttactgcactggaagttttctctgtaatccaatgacaacaatttttaattatatgaaaaatttacttaaaacatcccatttacatttactcaattctttcatttttaagtttatccagattgcttctgaaaattgagatattagacaccatcatttaaagttagttaatttctttgtcagccatttttttaatagccagtgaacatcaggtgctcacctaagagcttcaaagttaaatatatagatattttcaccaataagtcagaagactcagctgttttcattaaaccaacaacattaatttaatcttacttatcaaaagcttgactcaaagatcattttgttttggttgggcttgtagtcttaagtttttgtgccaaactgatatctcaaaatatctrgcaaagacaaatataagcccagacaaaaatgtatgctgacaattctgaagacacttctgttttcttattttaccaataattttaaagctgacttgtttagtaaggatttacttaagtcacatgaacttgaaaattgcttggaattatttactttatttatgagtactcttttacttataagtcaatttggtagacacaacatgtaacttaataataaatgtacatacacataaacacatctagacctatatgcacacacaaagatccaatagcttttacctttgaactctctccatgagacagtaatacaaactcaccagtctacaaatatgttcacatggctgaaatttgttagctccaatagataattcagtgaaggttgtgaacccaaattttaggtaaagcagtttccatggcagtttgatttttaaaggccaaacctctgcagactccaaacagcatcgcagagaacaccacctaraaccaactaatcaggcccaatgctgcttagaacagcaacataaaagcctggatacaggaactccatcctactttctcattcagcagcaaacttcagtttccaagcaatattggagccaaacagtattacraaagaataccaagtttactgaattccaatttcccatgactctagcaaacacatagaaataatcaccaaaacataatacaactgctgcagcaacaaacaagctccaagagtgtccagactgaaacaggcagggtgcttcctctctccattggttaggtttgatcaacctgccaacaaaaattgctttcaaatttctcaaattgagaggagccagtcgtgctgcctggtacccacaaaagacactcacttgccctgaaacaacacacaattacaaacaagcctccaagagtgtccagactgaaaggcagagtgcttccctctcacagtcacttgggcctgttcaacctgcaaatggaaattcctttaaaaatttctcaaactgagaagagcagatcctgctgtctgggcccacaaaggacaatcacctgtctggatgcaaatgtcaaatttcaaaggcagttcttcggaagtaatcaggaatgtggttggggccggctgcagtgggacctgagagagactgaaactcacctccagccaaagttagcggggcaactgcttgggagggcttctgagtctcctggcccatggcagcagagccatgagcaacactttcccagccagggaaccaaaacctgttaccaaaacctcaggggtttggtctaggtcccgctgctcgctgcacagaaagccagtcactgagatgatgagtattgccaagaaggctttaatagggtgctgcagtggaagagatgggagctcagtctcaactgtatctccctgaccaactaaaactaagggtttatataggaggcaagaaatgtaacaatgtgtaagaaagtaggagctagaatggggcaaggaaacaatcaagatgaatgaggggtcccacatcccatcatggtctggatgtagtgatctggtgagtttcagttctttgctactttttttgagatgcytgcaggtctttcctgaggaagtaactcagataaaacaaatgttaagtttccagtcgttaaggaccagaagggtcaatttctgtttatcaaaaaaacctttctatgggacaattgggtcagtttcagtttttgtatactcattgcatattaaattatattttacacatattcagtaccacacattaaaatgaatgtcacttttttctttttatgttctttaaatgaggctgttagaaaacatagcttggtactcctggccccttctatccctgtggatggtggtgtgcagtgctttgcacacacatctcatttcattcaatccctggtagtcctgagatctgggcaggtttgctctgtcttcaggtttgcttcttggtcagggcctgcttgcccccacctagctctgccccagcctcagggagggcagaggtcccctgccccagaccctgcactttccacagatgcagaagtggccaccctgggacatgctcccatgacaagcgcagcccaggcagcccgcatcctctgagctcccgctgcagccactctccctccctccctcgggctctcacccactttgctttctgcctccgtagggtcaatccatcctccccaggtgggttctcagccctctctgagggcagattctctggtgaccttgacgcccgtcagcgccttgggggccacagaggccaggcagtgtgggtgggctctctgtggatgggaggtgggtgggcaatggagcaacaggtttgcccatgcagggggctctccaggttctctccttgggttctgggcytgatgtgggatcctctgccccttctgaactgagtcccaactcatctggctgtctctgtggctttctccacccagctctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaragagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgyaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaagaaagaaaagaattgcttccataaatggagcattttcttagaaaaactggagcccatctaaatgtttttcaaggtcacgtgatctgagataatctttagtaaatagaaagctagtttaagtttcttggtttaattaaaacagacaattcttaagagttgtcaacattatttacagttcacacatacaacttctacctggatttactaatcaaaacacttacgtgtggccgggcatggtggctcacgcctgtaatcccagcactttgggaggccgaggtgggtggatcacagggtcaggagatcaagaccatcctggttaacacggtgaaaccccgtctctactaaaaatacaaaaaattagccgggcgtggtggtgggtgcctgtagtcccagctactcgggaggccgaggcagcagaatggcgtgaacctgggaggctgagcttgcagtgagccgagatcgtgccactgcactccagcctgggtgacagagcgagactccgactcaaaaaaaaagaacacttatgtgtctttaagatcataaaactgtaaattcaactgaagaacaaaatgcacaaggaaaagataaatttcttgatatatatgaaacacaagaaagaaaaagaagattgaaaagagccatatgttttcaatgtatgtttctttgtattttgtgtgtttttatgtgtttatttttgtgtttttttatgttatgtgatgtttgtgtatttttgatatttttataagatgtctacctccttttttttttttttgagacagagtctcttgtcacccakactggagtgcagtggcaacgatctccactcactgcaagctccgcctcctgggttcacaccattctcctgcctcagcctcctgagtaactgggactacaggcacccaccaccaaacctggctaattttttgtatttttagtagagacagggtttcaccgtgttaaccaggatggtctggatctcctgacctcgtgatccacccacctcggcctcccaaagtgctgggattatgggcgtgagccactgcacctagccaagatgtctacttttaaatatttttatatttaatttttggtaacttaaaaatcttatattaacctaagttaaatgatggttatttgtattagtctgttttctgttgctatcactgaatacctcagagtagggagtgggtamtttataaagaaaataaatttatgtattatggttcttggggctaggaagtccaagggcagtcaacaggccaaatctagggagggccttcttgctaatgggctctgatatggtttggrtctgtggccccaccaaagtctcatgttgaattgtagtccccagtgttggaggtggggcctggtggaggtgattggattatgagggcagatttctcataaatgttttaacaccattcctctcggtactgtccttctgacagtgagtgagttctcatgagatctgattgttaaaaaatgtgtggcacctccccattctctcttcctcctgctctggccatgtgaagtgctgtcttcctttgccttctgctgtgattgtaactttcctgaggcctccctagaagccaagcagatgccagcatcatgcttcctgtacagcttgtggacctgtgtgccarataaacctcttttctttataaatcacccagtgtctggtactaatttatagcaatgtgagaacaaactaatacaaagtctctctgcagcgtcccargttggtgcaggaattatatggcaaggggactcactgagagacaaacagccttttacaacagagtcacactgtattagtctgttttgcattgctataaagaaatacctaagcctgagtaatttataaagaaaagaagttaattagctcacggttctgcaagctgtacaggaagcatggcagcttctgcttctaggagacctcaggaagcctccaatcatggcagaaggcaaagggggagtgagctgtctcacatggccagagcagkaggtagagaggggaaggtgccacacacttacaaacaaccagatctcaggacaactcactcagtatcaggagaacagcaccacaaaattgtggttaatcattcatgagaagcctcccacgacccaatcacctcccaccaggccttacctccaacatctgggattacaattcaacatgagatttggtgggaacacagatccaaaccatatcacgcacaaattgcaattacttcacactcacgataacccattaatctgtgaaggattaatctgttcatgaaggcagggccctcatgatggaatcacatcttaaagcccctacgtctgagtactgttacattggggatttagttttaatatgattttcagagcagaaaaacattcaaaccatagcaatatgtattgaatatctagatcatttccaaataagatattaatatgatactgaaacatttattgctgaacataaatttagaacttactttgcctacctattacagaagaacaaaagatatttgggcctattaaacctttcctctgccatttcctgtcctgtgtcataggactaggaatcgtgtttctagaaagtatgaaatcgtgtgcttgcaaacttggaagaaaacagttcatgactgcataccttctagttctctagtgttcactggaaattaaagacactaaaagttaacaattcttattaattaatcatattaatgtaattggaatttctagaaatattaggggaagcaactttatacgcaaagcataacagaaaaataaggtgtattttttctttgaaacctatgaaatatactggccaggcacggtggctcatgcttgtaatcccagcactttgggaagctgaggcggtggatcacctgagctcaggagttcgagaccagcctggccaacatgttgaaaccatgtctctactaaaaatacaaaaattagccagtcatggtggcaggtgcctgtaaccccagttactccggaggctgaggtgggagaatcgcttgaacccaggaggtggaggttgcagtgagccaagatagcaccactgcactccagcctgggcgacaaagcaagactctttctaaaaaaacaaaaatgaataaacaaaaaaactatgagacagaaaagatgggtttttgttaaaataaaaaataatattgttttagtttgaaaattattcaaaggttgtttcaaaatgaatcaataaaaaacataaaactgaatggatattgtcttagtctattttgtgctactataacagaacatctgagactgagtgatttacgtaaatatgcagattgattttttactgctctggaggtttggaagtccaaggtcaaggggcccatatttggtgagggccttcttgtggcctcatcacctggtgaaaggtggaaggacaagagggcatacatgggaggaagggaaaatgtgcaagagggggacaaactcacttttataaccaatctactcctgcaataacgaacccactcccacaataatgtattaatccattcatgtgggaagtaccctcttgatctaatcatcccttaaaggtcccacctccccccactgttgcatttggaattaagtttccaacacatgaactttgggggcacacaaaaatcacagcagaaataaaaagttagagaaaacaagagagaatcatatgtgctcaagttaattaaaccgaatgaatttattatagtacttttaaaaatgagcttaaatactgagtgaactgacataaaactaaaatttgaatttctctgttaaaaggacaaaataggctgggcgcagtggctcacgcctgtgatccctggactttgggaggccaaggcgggtggatcacctgaggtcaggagtttgagaccagcctggccaacatggtgaaaccccatctctactaaaaatacaaaattaaacgggcatgatggcaggtgcctgtaatcccagctacttgggaggctgaggcaggagaatcacttgaacccacaaggcggaggttgcagtgacctgagatggggccattgctctccagcctggacgacagggcaacaccccatctcaaaaaaaaaaaaaaaagcaatacagaagkttacatgaatgtaaaaaaccttttagatctcagtctttctaaacaattaaaaacctaataaaggcaacaaatgagttattattattattactattattattattttgagacagggtcttgctctgtagcccaggttggagtgcaatggtgtgatcacggcwcactgcagcctccacctcccagggctcaggtgattctcccacattagcctcccragtagctgggactacaagcatgtgccaccatgccagctaatttttgttttttattttatttatttatttatttattttgagacagagtcttgctctgtcaccaggctggagtgcagtggcgcgatcttggctcactgcaacctccgcctccctagttgaagcgattctcctgcctcagcctcccgagtagctgggactacaggcacacgccaccaagcccagctaatttttgtatttttagtagagatggggtttcaccatgttggccaggatggtcttgatctcttgaccttatgatccacccacctcagcctcccaaagtgctgggattacagggtaagccaaggtgcccggcctaattttttctttttggtatttttggtagctgtaaggttttgccatattgcccaggctggtcttgaactcttgggctcaagtaatccacccaccttggcctcccaaagtgctgggattacaggcatgagccactgcacctggctgggaattattttgataaaatgtaaaatattgtttcttaggctggttacgagaaagggaaagaaaaacctgcagtctgactgttcctccttatggaaaacccatctagaaaatgctagtgttttctattgatagacagttcaggactttttgcttcctagttttcactaaaatttaaagttactaaggataacaattgtagttagtgtataattctgtacataagatttgccaaagatgtgttcttattaagaaaaagaataaattagtctaattcagaagttatctaaaggttaattctaattatggacttgcaaaggttatttattaaacaaggtagaaaggaaccagtaagtaggggagagagatgtgaagtaagttatggatttatgggaggcgtggtggctcactgtgggaggctgaagcaagtggatcgcttgaccttaggagttcaagatcagcctgggtgacctgccaaaaagctcatttctaacaaaaaaaaaaaaaaaaggaaaagaaaaaaattatggtgaagatatatttttggtaatgaaggttagaaagaaaagagaataactttgtatgagaaaaagtcttgtatgatgaatatatgaa

SEQ ID NO: 13326 - DNA, 61718 bp, Homo sapiens
ctggggaatgttggcatgtaagctattcacagttacatagttttgtgttctgtttattgtcgtaacatcagttcttcctgaggtttttcagtagagtaggcttgggccgtggcctactgtagtcccatgtaggatgtcaaatatggttttgttgtgaccactttccttttctgtgctcagggcagacattactaatcaatcacaggctcttttcctaagccgggttgtagctttagaatcctcaatattctgttttggccctgaggaagggcaatccatcccttaccaatgggttcattcatccactccttcattccacaaatacgtagagagcacctacagtggacgggtaccatctcctaggtactggagatatygcaaagaaaaggccatatgtccattactatggagttcacattcttatgggaaataaaggaaataagcaagtaaatgaacaagataatttgagacagccataggctctatgagacaactaaaacagggtactgtagttgagaagaactggggtaactactttggacagagagagcagagaaggttaaggatatactttttgtctgggagctgactgaggagaggcaagtggtttcatgaagagcattccagagatggggcagggcaagtcaaagacgccaaagctgggaataagtttggtttgttccaaggacaactaagaggccagtgtggctggagcagagtaacgagcagggagatgggtagaagaggacgaaaagcacagccgaggaaacaatcaatagattgaagagacagcctacagaattgcaaaccatacatctgataagggttttatatccaaaatatataagcaactcaaacaactctatagcaagaaagcaaataacccaattaaagaatgggcaaaggatctgagtagacatttctcaaaaggagacatacaaatggtcaaatctrtgaaaaaatgctcaacatcactaatcatcaggcaaatgcatattaaaaccacaatgagatatcacctcaccctagttacaatagttgttataaaaaaagatgaaagataccaagtgttgacaagatagagaaaaaagaaaatccttgtatgccattggtgggaatgtaaattaatatagccattatgaaaaacaatatagaggttcacccaaaaatttaaaaatagaaccaccatggccaggcatggtggctcatgcctgtaatcccagcactttcggaggccaaggcggacagattgcttgagcccaggagtttgagatcagccttggcaacatggcaaaacctcatctctacaaaaaatagaaaaattagccaggcatggtggtatatgcctgtagtcccagctacttggggagactgaggtgggaggattgcttgagcccsagggacttgagactgcagtgagttgagattgtgccattgcactccagcctgggggacagagtgagaccaggtttttttaaaaaaaaagaaaaagaaaaaagaatcaccatatgactcagyattcctaattcctattacgggtatatatccaaaggaaatgaaatcggtatgccgaaggaatatgtgcattgtgttgtttactgtattaccattcacaatagccaagataatgattcaatctaagtatccatgaacaaacaaatggataaagaaaatgtggcatatatccactatggaatactagtcagccttacaaaaaaaaggaaattctgtcatttgtgatgacatggatgaacctggagggcattatgttaaatgaaataagccatgcacagaaagacaaatactstatgatctcagttatatgtggagtctgaaaaagttgaactcacagaagcagagaggagaacgatggttgccaaaagatgagatgtgggagtggaggggtggggagatattgcttgaaggatgcaaaatttcaattagatggaggaataagccaagagatctatagtgccacatggtgactatagttaataacaatatattgtatttttgaaaatctcagagtagattttaagtattcttctttttctttctttttctttcttttcttcttttcttttcttttttcttttttgaaacagastcttgctctgttgccaaagctggagtacagtggtgtgatctcagctcactgcaacctccgcctcccgggttcaagtgattctcctgcctcagcctcctgagtagctgggattacaggtgcctgccaccatgttggtgaatttttstatttttagtagagacaggagtttcaccatgttggccaggctggtctcgaactcctgaccttaggtggtccacctgcctcggcctctcaaagtgctgggattacaggtgtgagccaccacgcccggccagattttaagtcttcttaccacaaaaaaaataagtatgtgaggtaatacatacgtttattagctcaatttagccactctacaaatgtgtatatattttaaaataacatgctgtacatgaaaatatatataattttttgtctgttaaaaattaattaattaattaattttaaaaagaggagggcagggaatacttgtgtattttgttaactggacaaatgaaactctactttcatttgctcattaaacaaatacttgttttgtgctcagcatgattctaggcactgggactactgcattttggtccattacttccttgcgcacaaaaaccctttcttttcaccacgaatacactatgaacatgtttttttcttcagtgytggcatctcttgattccttccctccaggtctttgtgcgagttttactctttaaaccccagatattgtcatatttttctctgttaaacttttccaaacaactcaaaatagggtaatttcttcttcttctgaatttctctgacaattattctatgggtcatttattaacacagcataatcaaacaacttatttattttcatctttcttgatcctttcttcagttggatgttgtctttgagggcagaggttgtcctctatgttttgaagtctccacacagctcrtcgttgccttgcccgtagttgtagctcagtgaaataaaaatmtgtccgtagaaggtgatgtctgtgactggtgagcygagagcttgtggggttggtgttgtatttgrgtgcatgtgaatcagtgcatctcctgctccattggtgttaaraggctcccatcgtcctgggaacacaataggaaagagaacaggtgggaaggcactggatgaaggaatgtggagaatggaggaaaagttgatcagattgttgacaactttcagtgttgaaattgtcaccaaaatcaaagtcagtaaataaatttacaatgtccttttcttcaatgcatcaataacttcaccttcctgttcaaagcacagcaagtaattaatctcttatttgcatttgaaacccaagtttcagatgtttgaaggtggttgtaaaaaataaaaaccaaaataaagccaaaataaataagcagcagcactaggccgggcacagtgtctcacacctgtaatcccagcattttaggagrccgaggtgggtggatcacaggagrtcaggagtttgagaccagcctggtcagcatggtgaaaccctgtctctactaaaaatacaaaaattagccaggtgtggtggtgtgcccttataatcccagctactggggggctgagacaggagaattgcttgaacctgggaggcagaggttgcagtgagcagagaccatgccactgcactccagcctgggcgacagagtgagactccgtctcacacttgtggaacccagaacttagtaaccatgaacagaaccttaataaacagaaagttctggaaataaagtttaatcatcatgcaatctttatcactgggttaaatgaacaatcatctgggaacatgtcttggaatgcttaaagctttgagatgcatgtgcctatgtggcagacaaatttcaaatgtgaaacgtttagttaacttggtcttgctttttaatcactgctttaaaatttaaaaaatgctgctggtcaagtaaaaatagcaatagataaaatctgccctgagcaaacagaccatacatcaataaatgaatacttagcttaagcgattttccatgagacccatgaagcatttctaattgaaacttaacaagctacaacccaacagacactccaatcttcacttctagaagggaaatgtgatactccatgtagacgtagctttttaaatttagctggaagacagcgtgacagtgaagttgtgtgctgtaattttttaaaattgctgaagtgtcatggtttgctatttcgtatttattgaaaaaatgtaaatgctatatttaacagaatggcagtaastctgtttcaatctgaagacttaatcttactaatcatggtaatatatgctggctggagttgggaatatttcataaaatactggaataaatttgtgcttatatttcaggggaattaataaaagcaccttcatctgcaacatttaaaatgttattgcctttaaatttgtattaaataatgcagggaagatagatcactgggggagaatggatgcacctctgtgaggatcttggtcattcaacacacgtgtacgggtgaggaaactaaggcacgacttactgggtagggaggtagggatattagcaagatccttcacttgtctgggctttctgtctttgagtcacctttgcgcagtttttcactggacttcacaagcctctgaggcggcagrgcagacaggacatccttattttatagaggaggaaacttaggcttacagaggtttcctgccccaaatcacaaaggtggagcctagaccttctcagtctccaccaactgtatttcggttagccacaatcctatctacccacatccaaatggacacygtggctctgcaacttctgtcaaaagggctctttggcaacaggaaaaacgtcatggctccattgtattgtagaggatgggaatgggtgttccggctaaattctccctcccctttccctccacagctcagatggcaaatgtgcgacccagggacctcccgctccagcagacctgtgcgcacaactttgcacagattacctgctaagtcagagccgaaaggtaacacagatgccaaaggataataaaggtgaatgagatttactcaaaattggaaacttggtgtttggtttttcaggagaacaatcaacgactgtgatttgaagttcaccagggtattctgagagatctaatcaaagatagagtgctggtttgaaattattaaaaggtaacagtaaaagggagagcaaaaccccagtcccaacgcaacccataaatctactttgtcttcctcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcgggraaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccrcccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtktctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggayacgttcacccaccaccccctggcacccccgggagactcccggaacgccagtckgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacagagrgcctccacaggggccaggggkaagtgtgggaactgagtctcccccagacgaggcttcacttggacacgtgtatgtggtcaccgggggaaactgagcagttctgacttcccttggaaggcgtggaattaggagagaaatcccttagtgggcacacgagtgagtgccccttggagtccatctgtggaaaggaagcggtgataggtttccgcagtgaggaaagaaactcctttctctgggtgtagaggaattcctagaggtgagggcggggaggatttgctaggagtaactgcaggaagagaatgagcagggtggatgaaagaaacacgtttgttcttaagccgcacagatagcattactctctggagmtgtcacgagttcagtgttaatccaataagatctgtcttgcttgtggcacaagttcacactgttgtgaaagtgtcaaaacacaactcccggagagtcagatttaaactgtgtttggaggtcccttctgcggcagggcagggaactgcatccaccaatcttattcaccggggtgtgaagaccgctttatacaatctcaaacaaagctagtcatagaaacacagaaacaactgcagggtgatatagattgttctaccacatctrtatttccacagtgctctctacagttgaaagggttcctcacttatgacattgttagcctgataaaattaattgtaacacccttgtgcaaaatattttattaattttgacagcaggaaatattgmtatgccatggtaaagttgtctcaagtatttcttcctccttttttctccttagtgttcaaatttaggcaccattgttttggggattcatttataatcatgtcagttgttagtacactttgtacagagttttgtatcacaataaaatattttatgtacatgtataaacattttaataaaagtgtttaaatgtacaacttttggtacccaattctgatsacttgtgggcctactggaagacttatttttaaatttagaattcagccacatattctgaacaaagtcagtactaaaaccatttctaaacacttttaattaaagccatagataatatggscagagcagtactgggttattgaggtgacttagtgctctgagctgctggtaatgttgtaataatggctaaattagattttatgtcagttccacaaaacctgtttgctgctactggccataaaagaatgttggatttgtttggaaacacattgtgatttttgtgatttcatacttatgtatgtcttttcataaggatgttttagagcggtgattcttatactttttcaayccttttatggatctgaaaaacyctaaagaccaccagtgtatggctggtgatagaaaaactatgggaagaatggtctcactttttgaagaaaacataagcaagttatcagttcatactggaagcaaataaatggatcakctggaggatctaatagatcatgcccataaaatctttactttagatttaaatcctacaagttctatttttagagtccctaggataaacttgcatatacaaagtagtcaattgttattatagtgacttataggatcattttattataagataaagacttgcgtgctctctggtgctctggtgttttaaataatcaacatgttttagatmtttttgcccactcatggccctctgattaacttctcagttatatttttcaatgcttacacaaaaaatttgccaaacactaaccatccttcctagaaatgcagtggactttgtatttagggaaattagtaacaggtgaatgctccattttgctgatgttgcaaacaaactgtyagttggtgtaaagtattaattttgctttcacatttcttttggtttggtgtttagtcattcttgtatcttatttagaagcgagttcccattgtcaaagaaagtatcttgaattaattttgttgtatgagatactttcattctgttttcaatgacctttctcggtgtgtatataggggttgsgggaagcgagaatagaaaaatttgagcttacctgaaaaagataaaacattctgcagattttgataaaagggcattttagctggggcttagatattgctgctgtacagatataggggccagttgtgttccgggatctgatgttggtgaaggataaagactggctagcacccttccctcactccctctgtgtttccactaacttacaaatgggctaaggagatcccctgggatgatgggaagcttgacccctcctagagagtcaagaatcattgatggcctggaggacaggaggcagaacaaacaaacagcaggacaaataatggaggccctgctcagaatggaggtcttggtgttctttgtgggttcctcatactggagtgagccttggcaaaaatggtgtgtgtgtgtgtgtgtgtgtgtgagagwgagagagagagagagagagagaggagacagragagaaggagaagaggggagaggggaggagggacagagagagagagaggtctcctacaragagcttggagctcaggctgctttgctcatttgagtgtaatccaggaggatgcaccttttctctcggacttgaagaccaactgctcagccttcacagctcttgaaacaaagttcttaatgtcccctgaaatcagcactagggactgtagttggggagttcagccccagcagtgcctctgagtctttgttctgtatrtgggttctaagaggattagaatcaagttggaaatacacgtgttcccatttcccaccttcaactcccctcaccgcctgagattcttgcaaacatttgtgcaaggaacctgtgaaaaagacttctttcacgtaaggaagtagggctaggagatattaatctgggcattgttgagcattagcatcagtgtgcaggtctcagcccatctgtctgcaatgtttgttgaarccatcacttcttgtcccttgaatccttcctcaacttggatttcaggcyctggctctcccttgcttctcctctcagctccctggcgattccctcttagtctcctttgmttgttcctcctcaccttgcctgtaaatagtggagggctcagggctctgtctagattcactccaggccattgctttgaatactgctgcatcccgatgactggagattttgagtctccacccaggtttccccragcatcagactggcatagacaaccgccttctccacgtggatgtctaatgggcatgtcacatygaacacatacatcccaaaccaaacccctgcttccccttctctattatgatgactttttactcttccagttgttggaccccgaatcttaactactcccctttttcatgtcttgtttctaatccatcaacaaatcctgcagctctacctacctccaggatgtgtccagaatcaaaccacttctccccttatctatgactacgatggaggtgcaagacaccatccaaccttgcctgggtaatgggaasagcctcactgctggggttcttatttctgccttgccccctgcagtgtgccatgatggatgctctacagggtgacattatgtgtggacaagacagagtccttgctttttcaaatcccacctgttcttctggagccagctaacacgctcccttgggccccatgcctgaatgccatctcttccttctatggcatcctgcacaggacttcrctttgctcagatgcctcctcccgcgctcttccctttatttaaccatttgtctccattttaccccttcgctakctggggtaatcctgttcccttcatctgtatctctgaaaatggcatcttgccctcccttggtgctcagaaggtggcttctggtttaccgaatagcctgatttcacctttataaactcatgctactagaattttctctccttgtcagtctttctagccactttccaatggaacagagactaccaaatcctaatctgataaggaaaaataggtaaacataacgtggcagactctgacatctgcagtgaaaatttaaggttcatcatcaaatgtatgattccattgtgaaaatgtccagttaaaagctatctgtagtcaccatgcagcattatgaagaagttttcagaataagggcaggtggtaaagtctcctggccagctttaggagtatatattggaaggggctttgttagctgattgaatttttattccccaagtaattagtatgagcgatttgtctactgtatatatgctcaaattacatatactatgcacttttgagaaatactttacaagtttttctttcattaaaatgtrtttggggccgggcgcagtggctcacacctgtaatcccagcactttgggaggctgaggcgggtggatcacctgagatcaggagtttgagaacagcctggccaacatggtgaaaycccgtctctactaaaaatatggaaaattcaccagacgtggtggcaggtgcctgtaatcccagctacttgggaggctgaggcaggagaatcgtttgaacatgggaggcagaggttgtagtgagctgagatcgcaccattgcacwccatcctgagcaacaagagcgaaactccatctcaaaaaaatgtattttgtacataactagaataatcaactggattgaaagttaatataaattttagaatactactgaattcaatagtgcatttagtcagaaatagttaaaatatctcccaaacagcttgaatcactcctttttgaacacattgttttttgaaggttacrgtcaagtccaagaaaaaattttaaaataggaaaagaattaatcaaatcatttcaaaatcatagcastgttttaacaatgccaattattttgagttgaagaaaagaaggaaaatgtaaactatgcattcaagtaatgtcaatgcaccttctcaggtgcaaaatgaatgaacaattaactgtgccagctgaatatgtagcaatcacggcttttgcacatagaagccttctgaattatcttatattctcaaaaatatcattgctctaaactagaattttattataattaatttgtgcaaaagttgtctttctttcaatgaatgttrtctttttraggcataaaggaaattttaggtggaggaggagaatagaatacatgcttactgggaggacaagtaataataggtgagtaaaaacacacagcttattgaattgtctcagatccacattttctccagaaatgcaaagttatacttgaaatctatatttaaacagataagcagaatgtgacttttatatgctctattttgatgtattctgagtatgaagataacctgaaggatgcctttttcccctctttatcttggggtaaactcttacttacccttcagagacttgactcaaatattttcattctgcaataaccacaggtagaatggatcatttactcagttgtggctctcttaagagcacagactacctatcatatttatttcaaaatttgtagtgcttatctcagtgcttggcacagaggaaagaaatacaatttttaataaaggcataagtggagaggtaaaatacatatttctggtttcaacgtgtccatattctttcttgtaaatggaatattgygcttgcagtctgctctcacacaatatctgggaaggagttttaaagagtgaggaagaacagtaaagattttcctaggcaratacgttatgtgacctttgttgatttccagagcacataatatcccaatttcatccagtggacaggaaaagagaggaagagggaaaaggtggcctctcaagtgcctgacctggaagctgcacctatcactgtcccttgggcagaactcagtcacatggtcaaaaggagtctgcaaataattgtcccctgaggagccgggtgctcagtgaatgattctattaagttgaaatcagatgggaacagatcatttaggataaccagcaggctctaccacattgcctaactcccaggcatattgtgagaattaaaagcaccttatataygtcaacgtgttttgaaaaaatacaaaaagctctacaaaagtgagctataaatttatcattaataataatagtaataatagcaaaatacttgagaaatggtcctcttgagctgtttagaaggaatcatacaaatgcattagacatggtagcctcacttaactacttaatttgcctcttctttgaaattatttcaatagcatttgaccaaaaactatcaaatcatttttgaaataacgtatttttacataaaacacattatcaaatatctttctggatccagcttggtggtaaaaagatacatactaaagtttatgactgatataactttatatattgactaaaccaaagataaatattgattgaacttttgtggccccagtttcaatagatttttttattaacattttttgtttgaagtacagatgtcacgtcatccatgaaccggtatcattatagcttgataaaatactcaaactgaaagcagtgatgtacaytaattttaaatataatggttaagcaaatgttatttccatatctataagtgcattttatttgataattagaatgttagaatcagaaggaatttggaaaatcccaggttacacttctctccaggacgaactccttacagtggctctcctggggtcagctagcttttgcttgaccctttgaagcaggaggaactcagttccactcaagttgcccccttgattttctctttcatattgaacctgctgctgcacaggactcctccgtgactgtctctttgccttcctaaatctcaaagaataaagcaagtcactttttgacaagacatctttcacatatttgaaaagacatctttcacatatttgaaaagaccagtacgttttgttcttcctagaattttctccttcatgctaatgtctgctccaagaagacatggaggtgactggacatttagtcaggaacatttcttgagagcttaccctgtggcaggcaggtgcaatgttgaattctgagaatatgaatgtaacctttgaacaggtggctctgtcttctgacgtttcaggataaggtggaggagaggagaggggaaagtcgacctatctccccagcggggagggtttagggttgtctgtgggacctgcctctgtctcatcatccatcaccattgtcctgctgatgggtgcagaggactgaggacragtggttggagttctccctgtgccggaccctgtagagagtccagagccctggctcccaaaggaggcatatttgtagggctcttttcgtgagggtccagaggacggctgcaaagctgcaggggaggatgggggcatgggaggcaagcccgttgccctgtcagagcctcttggggatgctgctcttccccgcctgtcctctcttctctttgatktctcatcatgtggtcctctttcctctgccttttcctctcttcggtgtcccaagttcttccatagagacctgtgtccccttgttcccatcaggcctttatgccagccctgcacaggtgcggggacagtggtaggggcgtctcactcccgrctcaactacattctcccagaaattgtctgcagtcaaacacaactcagcgtggacattgctcaccaaaggtatactgcttgggctgcacgagagattcagttttctcctatctatctggcatgggctgtgagggggctcctaacctagggggcctttttactccttcctggccagagctgccatttccaagtttctgcactgtcagaaaagrgggataaggtaagattcctgccctcatgtcacagattagtaggggagaggtaattgtcaaataattacagtaaaatgtataaatgccttaagagaaataagtacttgcttaggaacctatttcaagaaaggagagataggttagcgttttggggaggtagtacrggagcagtcagggaaagcaatacttgtaagatcagaggctggcaatctttttctgtagagggctaagttttggactttgcagatcctacagtgtctgttgcaactattacacagttctgtggttgcagcatgaatgcagccatgggcaatgtgttaatgaatgggcacagctgtgtttcaataaaactttatttacaaaaataggtagtgggccctgctgctgggcttggcttgctgggcacacaaagtgagaagggcattgtgcctttctaggaaacatcccttgcaaagtcagtrcaggtgagacagtgtggccattcccaccacagcatgaggtcttttgaatggctgaagcgtcaggtgggaaaggatgaggagctgaagaagaaagcctgggaatttccaaggcctctcttaacatttgctgtgcagaaccaagcagtgccccaggtgttcagagtaggcttcagcgattacatttcttgttagacactgaattttgttcatgccgcccaagattgcattaacaattttggctgtcaccttaccgcggactcaaattagtttgcagtcagctaaaacctctcaggttttttccccccagcttgtgaattgctgtgaagccaaacatccctgtcatctctttggtagtttattttcaaactttcaatcttattaaatttcatctccaatgtgcaaagataagaggaagtttaccgcwgatggtggtttattctttaaaactggacatcagctaaatgtgttaaggtaatccgttagaggaatgttggtacgcttatacagtggaatactaattggttattaaaatgttgatgtatgattattaaaaggcagcccatgktatgtctcytctgtatgaataagtatgtaaaaagtatgtaaagattactgtayagttcatgggtgggactgggctctctctagcctctgtccttcattctccctgccagtgccttttcccttgcagtgtcccttccctggctgcatactcaagactggatttgcccagccaaaccccattaactcacagaagcaagaggaaaaaaataaattcttattagttcaattctccaaattgggggcggtctatttcacagcaataggtaactgacgtaaaaggaaaggaaacaatgaagtaattccagaaaatttcctatagctggwggacatgcattttcatattgaatgggaagaatggggtgggggggtcatacctctgtgttattgcagggtcctggctcctagggacctaggcacctcttcagtcagtgaattatagcttggaaaattggctaagtcggggaactgtacaaggggtcatcactttttatgtagccatgctctatgaaccatctttataactccctggcttctggcagttaagcaccactcactatctggcctctgtaatttcaacttctgaccatccccrtgggtggcaacaagcccagctctgtgacacctctgctaccagcagccctggcctggagagcggtgcccccactgaatgtctcagtgagattggcacccccatgagcatattcctgagggtgcagtgaatgctctttctccctacttgggacttctgggaaacactgtcctctggtgggttgtttgacctcacataatatactggttcttgcatgccagcttctctctgcttcttgattcttttatcagctgttagggcaacaatgtcaggcatttccgcctgctcagcattgggcatccctttttacaggcttctcagagccaccctagcagcaactttaccgcgtctcctggggtccttgctggatcgtgaaaacatacttccggagaaagtgttccctagataatgaattatttcttgtcctgtrttaagttccagttccttggtcaaggaccccagcgctactcctcaggatttgcagtgcatgctcaatcttgaagcaatgttgggatatagtatcttttcttctctatcaggcccagctgtctccaggtgggttatactaggatttaatcctcgttagtgccgggtcagctcctgaggggtgcacctgttgctttttagggacgaggcctcttcagcataaagaagtgctatctcttactagggaagaatgggccacctctgtaagctccaaatattcccaggtttccccaaccggggccttgaccttggcataactgatctgccttggctgagcatttaaacmtccctaaatctctgcaagtctatcaggtcctaggcctgctgctaagtttctctactcttccactgtaggagagaaggctgtggctcttatattgagcctttaactgtttgttattggccctcagtttctcattagctctctgtagagtctcaatacaatatatcagaaagcattcaattccatctccttgtaggcagggaatgcctaaatcattgcacctacaatgacattctccaccaggatatttcccaggttactgctgttgaaatatttagcaattgaagcaccatttgtgcaaggggactatctgcccctacacaacactcagaatggcattctctttgctttccagaaagtgaatgagctggttccccaacccctcttgtgttagtttgagtcctgaaagaagtaaatgtcaagataggattagatgtacaagaamtttattggggaaagaattgtgaaggataaaggggaaggagctaggggaggcattgaacctttggatcatgatgtgtgtccaacaactatgaaggagagtgggcagggagaaggatgggctgggaagagtttcagttggcactgtgggtctcagaacaacccaggcataggctgatggggacgccttgagccaatgttgcccattggcggagtccacatcttgctgaaatgggcctgcattagttcccctgccatgtttagtcatctgggagtagccgatgagaatcatgatcttaggatcaactgcaatggcagattcaaaggggtagcaactgatggcctcagtcaactgtgctccttatagcaggaacactgagcagtgcatttcttggccatcacaaagactagtgaggagtgcccttcagagaagggaatgaaaattatttccagcctagaatttgatacttatctaaactgtcaatcattcatgagagtcaaagtcccaaaaaataaatcttccataaaccctttctcaggaagttattggagggtaaccgccacataacatgaggaagacaaggaggaagacatgggatctatgaaagggcaggtctaacccaggaaaaggatgatgaactgtagacccatgatgtcagatgtgcagcagactaagatcagccagtgcagaatgggggagattccagaagtgtgtccccccaaaatattggaggctcatgtgacttccctggggaagtttctgctgagaggctattggaaattgagggaagaattagccacagtcccaaagaaaacagagccaatcaaaaagcaatgcaattatgaacttcaaagaaaacaaaaataagaaggaaaacagtcttacttactacattacaaggtccagctgtgaatgatattcatgttggcagaataatgtcaataccaaatgtcggttaaacccaaaactattgtataactaaattgcctgtgtaagagagctaaacccttatctagcataataggaagtcagtggatacttcctgaagtgtggatgtgtggagatgtaaattccaaaagaaaacgtcttaagagtcaaaagtggttgcctctagagaggagaactgggggaattgtagggcaatgtaggacagggaactgtgatttttcttgtaagttgttctgacattttaaaccatgaacatatattacttgtatttttaattttaaaaagacataaatattttttctatcactttaaatattaattttgctagttatagcacatatttatagcattacactctgtagagctcttttggattcaagttttggagaattttcaaagttttagattaatgcctttgtgagttttcatccctttgatgataacaagttacaaagaaatagggttatgaataaaccttgtgggatattgttagtcaccttctctcaagtcgatctgtcccatgaatcaatgtttcaaacaytgaccagcatttgatacttaataagcaacgagtaagtttttgttgaaccaatgaatactcttaaaatatattttttcaagtggcaacagtactatcttatttgcactctacttttctttttgaccctaagaatgtcacaaaaatgtttagcaactgtcaagattattacatacagagatgactattgtgttctcagatatgctgtatgtcttagytcatyttgtacagctataagagtagctgagactaggttatttatttatttatttatttattttttgagacggagtcttgctgtgttgcccaggctggagtgcagtggcacaatmtcggctcactccaagctccgcctcccaggttcacgccattctcctgcctcagcctcccgagtagctgggactacaggcacctgccgccatgcctggctaattttttgtatttttagtagagacggggtttcaccgtgttagtcgggatggtctcgatctcctgaccttgtgatccacycacctcggcctcccaaagtgctgggattacaggcgtkagccaccgcgcctggccctatttttttttttttaaaggaatttatttcctcacagttctgttggctgggaagtccaagggcaagtctctggcatctggtgagagacttcttgctgctttctcccatggtgraaggtgagagggcaagagagagacaaaaggaggctgaactcatccttttacaaggaacccatgcctgagatattgaacccacttctatgataacagcattaattcattgatgaggacagagacctcattgcctaaytggcctaaagtgagacctcttaaaggtctygcttaatactattacaatggcaattaaatttcaacatgagttttggaggggcaagcattcaaatcatagcaccatataatacaataaaaattttctgagctargtttggtaaatttattctaggaatccatgttgtctcctagttatcttcccttccatagtactgatgcatttttgttaaccattacctaattttgcttgagtctattatttctgaaattcacattatcttcccttttaaagttgagwaaattttcattcttcaagcgccttattttctataatctctcaaagtaactgatggctgttgcatgatcataagtgcaaattattttgctagaccacacttggagatgatgaatttggaatggcatgcagactcccgacatcaggagtcttgtctcctgcaataatcaggaacccaggcttaaaagggagcaggtacaacagaagggcaaggggtgacaatgctggtgaaagacatttgaggaaagctatcaacatgaaacagaataaaataaacagaaaagcaaaccagggaaaataaattatgcaggaaattaaacacatacacaaactgaaacaggaaccatcagaacatataaaaaattcttgaacatcagtaacacaatagttgaaacaaaatatttagtaaaatatttgaaaagtaaggtcaaagcaatgctgtaaaagtagtacaagatgataaagaaatagaacacatttttgaaagggaaaaagmtttaaaggatattcataaagatccaacatcagactaatagaagttctggaaagagagaataaggaaatacaggtcaggaaatttgtaaagaaataatataataaaatgscccagaactgaagaacatgagcttttaactttaaagagccgactgagytcctagctcaatgaatgtatagacatgtaagggtattgaaagttcaccttcagtgtcatgtttcctaagaagctaatggaagatatgcaccagcaaaattgtagtaaatacataggaagaaatagtatatagaaaaagtatggtttcaatccataagaaataaaggaaactcccaggacgagagcagctcttgacagcatytagtccaaactggacttggaggctggaaacttctagcagggaaggaagagctctgggtgaaaaagtagactcaacagaatagatacgatcatagaaaacatgatagagaatcactaacacattgaaaaaatcacatatagaatattctgcacgcttaataatgaggtcattatttattcaagggaaaattaaaagctgtttagaaaagggaaatgttatagtgccctatttggctctaaaatgaacatttatataggaatcttcatgtaaatactaacaatgatttaaataagaacagacatttcggaaaataagggaagaaaatggggcatgtaaaagagctaactcctcattatcctaatgaattattaaatttcacaatagcatagtatttagaaatatgatagttattacgagaagaaagagctaaaaggttgccagtggggagcaggagtgagggttagagacgggattgggggagatgcttactgttttcatgataagcctttggtactatttgattttaaactatataaatgcatttattaatttaaagtaatttaaaaaacccataccactggataatgcttgataatttctagagtcmtttttttttgtattttggggcaggtaaattcattgagagacccagagagtttagctractttcctgtgggtaccaagggtcagagctggggtcaaaactcaggttttctgaacccctattcccagtgtacattccatgactccaggctgcctcccgcattgcacaggttacatctaggggtgtgctagcaaatgcctagaccatcctcgtccacatcagcatctgaaatggacaagaatgttagtcatgacttgccactaacgtctttaaccttaattgacatctgagagtgtcatcattacatcattacaaaaacactaacccagatacatctgttcccattactatttctgcgtaattcccccagacttaattgctttaaataaccattttatttggtttacaaacttatgggtcaggattaggggagggctcacccacgcagtttttctctggtccgcagtcatctgaagcttgaacggggtggggcatgcaagacggctcacacatgtgatccgcggttgagcctggctgtggaccagagcatctctgttggcctcgcttacacaagtggtctcagattagtagcctctgtacatggaaactagcttmcctcccggcragcatcccaagagaactaggaggaagtggtatggacttcttttyttyttcttcttcttcttttcacttattcttgatatcatgtagcttcatttctatcagagcagtcacatgcccacagattcaagggggagggtccacagatccgccaatgggaggaacagccaggttatatcgtaaaagatcatggggcatgggagatacccatctattttctgtaaaaaatacattttgccacagcatcactggctttccagctcacagtgatctgcctggaatgcctttttccgtctctccaggatctacatctttcaatataaggtttagaaactacctcctacaggaagacktccttgatttccctcagcaagaaagaatctttccttcctctgaatcgccattgcattaaaaaaaaaatccatcttctggcgttttcactttcagacttatactgtaattattctatgtacctatgtttgacccctcacgatgcccagcataataatttgtctattgagtaaatatttgcttaatgaaataatcattacatgataactcaaatagcagtcctgaaaaagtgcatttcaattcagatctctcttttttcttccttcacaattctcatttccgaaaaatgaaakaagccagaggatcctttatgaggagttacagtataacttatgcgtggctgtttcctgtgtttactgctactcagtgagaaatacgggagatgggagagtgaaaaaccatgtcatttacaatttgattaaaaagctttttatcttttcctttcacgtttaagccttgccgttttaaaaatttccctttcgtcacaggggatcaagcagcagttaacgctgcagttccctgttctggaaacactctcaaaggtgtttcaacacattttgtctcaactctgactcctgccccgctgccccacgccatccagccacactgaaggtcttgcatttgtgccttggggcattatttttttttactcttctccctgcctggaaggttcttcccaacctgccctaccgccatagccacagaaccaacccttcactttccttaagtctatggtcacaagctccttctcaaaggaggcacacctctaaccacccccatttggtgayttcctgtctcctggaggcccccggaactagtcttctctacttccagcaacccactttacgagcagcggagaagactgactacttctgggggcctcgaggagacaggaagtcaccaaatttacaggtgctgtggatgaaactgtgtgataatgaatttattgggcttgtttttttagcttctgaatagaagaaccaataagatcatttttttaaaaaagataaaaacagacaaacacaaaccctctagtataaaagcatttttttttaaaaaagatgaacacacaccctcagattgccttcttttgaaaaggcaatctgagattccttatgaaatccccagacagaagctgtttctttgaatttaatatgctgtacactgtagagccaagaggcttatagagtgttaattaacaccccttgtcaaacatttgtaaatgaatctggctaaagctcaaggaaaccaggtttttctgtgtgataaaatataatctttggagattatttatgatcacaaagggagactgtacagaaaattttcctagacttggaaatgaggcaggattattggtgtccatctggactgaggcctcaggcaggcctgcctagttaatcccattctcctatcctcattctctgggggtgaagaaggcagtgcacctttgttcaatttgctgcttaccatggattagggcattttaaattctgtaagggtagtttttaacttgtagaaaactgatagcgatgggaaggattcttgcctaatagggacacaaacggattttgttctgtagagatgtaaatgaaaagatgaaaatcacaacacatttaatgaaaggaaaataaagactcttgtgagtgccaccaaaaaaaaaaataaataaaatgtatctcctctccgtggcaccccaggccttccttacctcactctatttcttcatagcacttattgccttagaacattctttataatttacatttattatgtttgttgttggttgtcgctcctcctgctaaaatggaatctccgtgagggcacgggtttttctttgatttgttccctgttgtgccccaaagtgctagaatcatgccaggcacacaatagatgctcaataaatacttctggaatgaaaatccccctccacktagaccagtgagttccaaacttttttgatcttgacccatagtaagaaaggcattttccatgttgaatatacaccattgaaacaaaattttcacagaaaaaacttaccattattacaggcagtgcactgtgatatttcctaatctcttctattttgattttcaaaattgctgaggctactcataggttgatttcacaagtggagtttgtgttatgaaaaactttgacttaacaccatgtcgaaactgctaccacaaaaaggcaaatgcgaaagaagggggaaagagcaggccgatgactttccgctatccaccactccataaagcrtatttcattttcctgtaattgtatcctgttcaatgatgtagaaatcctcacacactcacatgccactttttctttgggtgaaaagcgttctctactgcaagatgaattgagttatttcaaaagcaaagagctataaatgagcctgttaaagaaagtctcaaggagagtctgttggcatctgctgttgataacttaaagcaggagaattagataaggaggcagaagtagaatgtttagaaaataaaagtgaccattatagaggaaaaactgcttgtctcagttttgttgatattggagagtagctctttcatgagggtattgtggaattattggcaattatactaatagatgtttactgaaaaaatcctatttgactgatgaaccatggaatacttttgctgaccttgtggaaaacatcacttatctgagttccttatcttcttgtctcttttttctcatctagcctatgcctccctacctgttccctcatggttctcattttgttgctattagaaaaacagagatacaaaaaccaggaattggaacccctctgtgtctccagtaataattctgtgattaatgggttagatggattctggtcacaagctggatattttgttaacaacctagcgtcaatgactkggaatgattttcrccgcagcatgatttagtattgaatagaatgatttaactaatgttaattagttctgtacagataaattaatgaagcaagaagctcaatctctgatttattgatgtatttacccagtgtaagttatgaaatcttttttatttcatttgaaggaagtttttatttaaatacaaataaataagccctttattgtcacctactttggaaaagtccagakaaaacaatcttaagtaacaaaactccaaaattacaacatgattttcaaaaactaccctgacctttgtcttgcctggttgttacagtgtacttttaactaaacggattcttatagaatctcaagtttggttatatttgtattaaggaactctatatttgcatttgaccagccctaactaaaacaagcttaaggaagaaaagggactttacgacaaggacaaaggattgaagaagaactccagggactttagatgttaacaactgtatttgtcactaaagtaaccattactgtcaaggtgggttctccttctccctcactaaacacatgcacacacaccacacacacatacacataccacatacataccacacacatgcacacacaccacacacacaccacaccacacacacagaaatacacacagacatacacacatgcacttatgcttgggtcagtttggcttttatcatcccagagagtctcttcccatgtcagcaactccagattcacttcctctcctaatataggacagtcacatgtctctattccagcaaaacaayctcagggaaggtatctcattggcctggcttgggtcattcaacttgaagtacaagaagagaaaacagtattcttttatttttatagatttcctgtaaaatcagtggataatggtaaaaatttcatgacagcaggtgttttaccttatttatgtttactatctctagaacccagtatgatagttcataataaatgcttactaaaacaattatcaaactgtacacttaaaaattaaaagagtaaattttaagttgtgtatgttttaccacagtaaaacaaaataaaataaacctattattgatcttattgtctatttctcaaaagtagcatacgtcataatttcatgtgatttctaaaggagatctaatctcaaacttagttcttagagtaaaataaaaggttttrgcaatcatatacagcagtagactttaccttgaagatttaacaaaggtttgaaagcaaaatgctatgatactgaatataytaatgtttgagggcttgtgaaaaggtcttaatataggaatcatatatcttcttttagattgtgtcttggggaacattgggggtcagtttttctatcagtgttagtatgtagtaagtaatggcatacatctaagcttgagattttgctcatttctgtattcttagcacttatrtatccaacatataataggtgttggataatatttgttgaataaatgactaaataaatgtcttggcatragaattatgccatctacaaaaccgtcacttttaaaaaaaacaacaaagatttttgaacctgtagatccagccagaaagcaagaaatatcttcacctttccagactgacttattttttggtctagctgtgtactatgcatgagctgtcaactttaatactttattttttaatgcctaggtctagtgagttacaatgtgatgtagactgattgaattaaaggccccaatgttgtcctctcttcattgtatccatgccttttgtcatgtaactttgcagtgtcctctactctaggtgtccattcagcttatcctttgactctggccttcttctcctttgactctggctttatccatgtgacttwctttagccaacaatcataatgctggcaaacactgagaaaatgcttattagtgtctgcttagtctcttgcttctctgcaattgccatgagaaaatgcccaagctagtacactggaggatgagacatgtggggcagaagcaacctgtcccatttgtcccagccaacaccatcctagattaaccagatgagaccagagcagaagacatgttcagtggagcccaacccagctcacgaataatatttcttcatgagcatgtgagcaatgtgtaactaatgcaccatgctctttttattctgcacttccaaacatctctcagattgccctgttgttttgcttttcagtagtcatcacctttgtccagaaccttaattgtatctgcattttggcagtatcctgccarttttccacatccagctgttcacattctaatgcattctgcaatggatgattttgagcatatgactgatcatcactgtctcagaaatktatgctaatctattgtgacctattctgtcaaatccaaataactttacattcaaaacttttcatattctggccccatactgtctattgtaatcttattttctaaaagccacaaactattaatcctgtagcctaattaggttgatatcatcattttcacaacacgttgggtaaattcttatatctgttcctttaatcatagtttccatgcttagacactccattgccctccctaagcaccagccagagtccactatggggggatattttaaaggctcttttcccctaacccatctgccccagaggtggcacaggctagaaaagatagtccaattatttggcttaattatttggatcttacagtttttttgggagagttccagatgatttgatgaaatgcaacatggtcaaaaacattttggtggagaataatttaatcaactagaccatttggtgaaaaataaatcccagttactagacttcccagtattaataattttggtatgccaggaatttttaaaacatttctaacaaattttttcagaaatcrgaatgactgaaakgtataacaataggaaattaggaaatcaataagtaatcattgaaaagtgagtgattgaattagttggaacaatctatgccatccatcctgtgggggaaaaaatgaaaacagctaaacaagcagagcagacatcatcaacttagaaaaacaatatagtaaataatttgaactagaaaattttccaaaattgaaaattccagttttaaaaaatttgtgttttcttattcaaaaagcaatacatatttcgttacataaaagtcagaaaatcagagaagcagaagaacataataaatrcccactgtcctactcaatagagactataactgctatctctgtacaaatcctttaaaatcctgtcttatgtrtatttattttacatctgtacatatgattccaaaattaggtaatactgtacgtggtctatctatagctaactatagtttgtaatttaataagctatatttgtccatggtgatcatttattgctcataaaattaataaattataatttatttatcaacactgatcatttgttgctaataatttatttcatttaatgtcttattcctgggttattttaactaatccctattgttagccctttaggttgtttcaactaatttaagaattataaatggcccatagtagttacttaataaatatttgagtgaaaggataaatgaatgaataattccacattattggatgttcaagttgtttccattcaactttattgttgtrggggagtataatacaatcttggtgaagagccaccaacttaggaagaactatgaagaagcatgttatttactcctgcttgtgggtggggtgcattgggaaaggaatgcctaaatgcacgtggggagccaaacaagacttcacaggggagatgggaattgagccaaatttggaagaagtgagaattttcagttgataattggggaagatagtactaagagtaagtggggttcattaggaactacttcttagaagaggcaagtccagaacagaaggcagaaagggatatggatatgaaggaaaagtagaatgcaacttcagggctagtaggttggcatccaacgtaggtacagccctggatgaggagtaatgagaaactgacctggctgtagcaaaacagctaggctgggaagtgatgctgtttacatttatatgcgattctactggtcttcctgttactttgtagaagrctgtaaggcttggtgctcagagctagaaatgcaacttatttgatttgctaagaagtccaaagcaggtaggggtgccaagctgctgcctgttcacacatattcgtctaactgggtgtcagggaaagcagatatgagcccccttgcattggttaaatcctgagcaacttttaaggawctgcacacagagactactggctattttttgtggataaagttgtagatagttatttttgggaaattatttatgtgttctattaggtggttgttttgtgggaggctgtttgaaattctgtcttaaggaactgcagcttataaaccatagtgctgatagaaataagagaaataatttggtctgcgagcacaaacatcaggctagttggcatgcttatgtaaacaccacacagtagcagtgacttttaaggaagtcctcagacaatgtaatcccaatactcttcttgaagttgaggtaatagggtgccagaaagaaaaagaaaataaatctctagtgccttctaamattttttcaatcctttgacctttttgaaaacggtcacctttaattcagaactaaagtaacatctggagggcccttttcttagatagggagaagacataaatgagctatttgaattattttctgcttatgggctgcatttcatttcttccaccattggtctcagtccatttaattaagattatttgtaggattaaattaatcctttaagaattattccatttcaatttttaaaaaatctaatgaatgatagataacaaaaaryggtccattcagtattacccctgaaacatatttgggtgattggtgataccatccatgtctctccaacttcagcttcatatactcagckgagtaccaggcatcttcattgaaagctagacttgtgacctaaatagaacttgatcccttcccttccccaactccttattttttgttttctttgagttccttgattcctcttcccctcctcacatgcmacatgtaacatccaattcatcagcaggttctacagattctgccttcratratagcctaaatctagccacttgttactatcttttttggtccaaaccatcatgatcttttgcctggaccattgcaatagttgtctaactggtatccttgctcccattttgtcctcctagatcctattttccacgtagtagccactgatttttggaaacttatcaatcattacccagacacaatgagtacatttacatagttgtttgattccatttacataaagtcccacaatcactctatgtactgggaatcacaacagtggtctcctatgttgagaattgattaagagtcacaaggaaacaaggagtaatattccattgtattaacagaccacactgttcatacattctcctgtaaatggacatttatgttgttttcagtttttttgctattgtgattaaagctattaggttggtgccaaagtaattgcagtttttgccattactttttaaatggcaaaaactgcaattactttggcaccaacctaatactgtaagtatctttgaacttaccaatcaaacattactacaacacttgaataagaaacacttccatagcatttacaattctaagtgctttccatgtattgacttagttaatcctcacaaggatataaccatgaggtgctattactatccctactttacagatgaggaaatagaggcacagacttcagataatttgcccaaggtcccacagctaataagggggcagaattaggaaagcctggctgagtctatgctctcatcacttgctcaactctgcctggaatgcccttcccgtaccctctaccgcctctgcccaatcctccgggttctctgctccttccacacacccccatctcaggtcccagtcttttktagcattcttcactttttctgttacagatcctcagacaatgcttccttgaagaagacttgcctgtctaaactgccttcccatcccaatccctgttaccttctatcctttctctgctttrttttcatttgttatctctcttcttcccaakaatgtaagctccataagaacaggatcatattttgaatcccctagaaaagtgcctagtgtaatatttgttgaatgaatatgatccctgcaattaaaagctaaatatatatatttttttaactaacagattactgtagtagtttcaaagatgaatttatgtttcggagaaaatcagtattctcttgccacataaattgtaggtaattatatttctatacctgaatagctttgccaatgactaagatattaatctattatatatttattaatctatagatctttaaaattgatgcacatgttttataagcaatttgatgaattttgatgactacatacacctgtatgtgtatggatatctgtaacaaatatccaagtaaagatatagaatattctcattaccccagaaagtttctttgtgacttctaatcaattctcacctccgtaggaaaccgctgttgtgattcccatcaccacagactgattttgggactttatgtaaatggaatcaaacaactctgtgaatgtactctgtgtctgagttctttcaatctacacaatctttttgacattaatccatattactgcctagaagagtagttcactctttgcattaatgaatagtattccattgtataaacaaaccacactgtttatacattctcctgtgaatggacatttgtgttgttttcagttttctgctattgcgatttaagctactataagcatttttttttaattgygatggggtttcgctcttgttccccaggctggagtgcagtggcagcgatctcagctcactgcagcttctgccacgtgggtccaagcgattctcctgcctcagcctcccgartacctgggattacaggcatgtgccaccacacctggctaagtttcgtattttcagtagagacggggtttcaccatgttggtcaggctggtctsgaagtcctgacctcaggtgatccacccacctcggcctcccaaagtgctgggattacagtcttgagccactgtgcccggccagcatctttgaacatatcaatttgtaagttttatcttaatattgtacaagtctttkggggggcttatgttgtcatttctcttggtaaatacctaggtatgaacttgctagattatagagaaaatctatctttaattttataagaaactgtcaaatagttttccaaagtggtggtactatttatactcccaccatcaatgtatgaaatttccgttgttttacgtccttgccagaatttgttggtagtctttttttttttttgaggcagcatctcactgtgttgcccaggcatacaatggtgtgatctcggctcactgcaacctctgcctcccaggttcaagggattttcatgcctcagcatcccaagcagctgggactacagaggcgtgccaccacrcccagctaatttttgtatttttagtagagatggggtttcaccatgttgcccaagttggtctcgaactcctggcttcaagtgattcgcccgcctcagcctcccaaattgctgggattataggcgtgagtcactgtacccagcctgttgccagtatttttagttgtaggcatcttagtgggtgtgagtgctcgttggggttttaatttgcattttcctgatagtgttgatgttgaggacatttctatgtgtttactgagcattggtgaagattstcttgtgaaatatctattcaaatattttgctcatggtgggaaggggagttatttttcttttactactgataggtaggcttacgtatttatttcggatataattattttgtcaattatatactaatcataaacaaaaactgataaattggacgacgtcaaaattaaaacctgctcatcaaatgttagcgaaatgtaaaggcaaatcacatactgaggggagatattttaatatatgtatatttatatagtgctttctgtgttctaagaagtattttcctactccaagataaagagactattctcttacattttgttctataagttttatagttttagcttttagctttggatctatgatctgtctcaaatttttatgcaagattggggtttaattttttcatacacttttccagttgtcaaggatcatttgttgaaacgtctttcctgttgccacataattgctttgatgcattcgttagaaatcagttggctgtgggtttattttggaattttctgttctgctcctttgatgtatttgtctatccttatgccaatatcaccctatattaaataattatagctttataataagtcttgaaatcaggtaatgtgaatgtttcaactgtgtttttcctttttctagttattttagctgttttatgttcttattgtatatattttagaatcaacttattcatttctacaaaaagtttattgggattctggatgagatggtgttgattcagtaggtcaatctggggaaatctgataacaatattgactcttccaatccatgaaaatggtatctcattctttatttacatattctttaatttctgttagcaatgtgttataattgtagcaaacttgcacatcttttgttaaattattttctaagtattttacgattttggtaccactgtaagtggcattgtatttaaaatttattttctgtttgttttctgttcatatataaatgcaattgattttyttttttttttttttttttttttttttttttgagacagaggcttactttgtcacccaggctggagtgcagtggcgtgatcagcactcactgcagacttgaactcctgggctgaagggagcctctcacctcagcctcccaagtagctgggactatgggtgtgagccagtgttcctggccaaatgcagctgatttttgtattgacattgtattctgccaacttgctaaattaacttattcgttttaatagtttttctgkttttttaaaaatcttaggatttctacacagacaatcatgtttttaatgaacaacaaagtttgtttttttgtttgtttgtttttcccttttcaatcaacatgccttttatgtttttatttgccttactgcactggctaggacctccagtacaattttaatagcaatggtgagagtgtttaaatgtactcctgtgtatattttattcttttggaacttattataaatggaattgttttcttaattttctttttggactgttcattgctattgtacagaaatacaactgactattgtgtgttgatcttgtaccttgcaattttgctgaaatcgtttattttttgcaatagatttttgtgaattctttaggattttccatatgtagaatcatgttatctgtgaatagggatagttttacttcttttctaacttggatagttttttccttcctaattgctctggcaagaacttctagtacaatgttagagagcaatagtgaaagcaggcatcttcctttcaatcctgatgttaggggtgaagctctcagcctttcactgtaatgttggctgtggattttcataattttttgtttgtttgtttttttgtttgagacggagtttctcttgttgcctgggctggagtgcagtggcgygatctcggctcatcacaacctctgcctcctgggttcaagcgattctcctgcctcagcctccagagtagctgggattacaggtgcctgccaccacaccgactaattttgtatttttagtagagacggggtttctcgatgttggtcaggctgctctcgaactcctgacctcagdtgatccgcccrcctcggcctcccaaagtgctgggattacaggcatgagccaccacgcccggcccataaatgcttttcttaatcatattaaggaagttcctttctagtcstagttttctgagtgtttttattatgaaagactttcagatttttgtaaaatgcttttcctgygttaattgagataatcatatgggttttctccccctttactctattgatgtaatgcattacaacgatttttttwaatgtttacccatctttgcattcctggaataaatactagttgattgtgctgtataattcttaaaatatgctgctggatttgttttgttagtatttggttgcattcttttgcatctatattcataagggatattgatctgtaactattattttcttgtggtggctttatctggctttggtatcaagataatgctggccacattggctaagttagaaagtgttcttycttctattttttgaagagcttgaaaagagtcgtgttaattcttctttaaatatttggtacaattcactattaaagccrctagtcctgggcttttcttagtttgawagtttttgattactaattcaatctcttttacacctagattagattttgtattttttccttagccacttttggtaatgtgtgtgcttccgggaatttggccaggtcatctctgttatctaatttgctggcatccaaatgttcataatgttctcttgtaatcctttttattatagaaatgatatacagaaaaggtcagttaccactttcttttatgattgcattaatttgcttcttttctctttttttctctagtcagtcttgctaaaggttggtckgttttgttgatttttttcaaagaaccaacttttgattttgttgattctataatttttctgctctgtattttgtgtatatccattctaatttttattagttcctttattctgttagctgtgagtttagttggctcttcttttttattttcttaaggtggaagactaagttattgagatatatctttttttttttttttgatgtaggtatttaaagctataaaatttcctctgagcattgcttttgctgcaatttataagtattggtatgttacatattcagttagttttttatatacacatttaagcttttgctaatctaccttgtgatttcttcattgacttattgcttgtttgagtgtgtcaacaatttccaygtatttgtgaatattctagttttccttttgttattgatttctagtttcatttcattgtggtaagaaacaatactttttatgatctcaacagtttaaaatttattaagacttattttctggtctaacatatgatctatcctggaaaatgtatcatgtgcacttgagaaaaatgtatattctgatttttttaggtgggtggcatgttctattaatatatatgtctgttagctctagktgaattatagtgatgttcaaagcytccattttgttattaatataaccatgccagatttttaatgctgtccatttgcataatatgtctctttccattctttttcttttacatgatcactttatatttatagtatatttcttgcacacagaatgtaattgaaacttacttttctaaaatctactttctttttttttttttgagatggagtcttgctstgttgcccaggctggagtgcagtggcacaatcttggctcactgcaatctctgcttcsygggttcaagcaattctcctgtctcagcctcccgagtagctgggattacaggcacctgtatttttagtagagacggggtttcaccatgttggtcaggctggtcttgaactcctgacctcrtgatccacctgccttggcctcccaaagtgctgggattacaggcgtgagccactgcacccagcccctaaaatctgctttcatagcatctgtcttgtacttggaacatttagtccatgtgtatttgaatatttattgatatgtttgggtttatgtttacaatcctgctatttgttttctttttgttccatgtgttttttgttttttatttctgcatcttttggaaaaatcagattttttggtaattcatttttcttattttattggctttttagagaaacctttaatatctttgtgagttttagggattacattatttattcttattattattccatttagaattaatattgttaatcccattmaaaaatttgtttatttcgcttttcagttctagaattttcatgttttcttcagttgttgtttctctgttgttattctccatttgttcattatatctatcttttctttgaaatccttraaaatatttataatagctattttaaagtcctctgctaatcccratrtctgggacatcttggcttctgttgatattgaatacttctttttttccccttaattaagggtttcmttttcctgctttttcacatatctagtagatttttattatgctctgtgtgctatgaatgagatattataggragcctggtcaatattgtctctttttaaagggtgttgtatttagttctgccaagaagttaaattaccagatttacttgatgtggctttaktctttsttagagctggtctattcctgctttgttcttacttctcaggtaatgamcttcctgagtttcagctggatgcctgaagtgctcagctgcatttttctactctggctattctgaaatgcaatattttccagacctacccaacctttggtattcatctcccagacctgtggctgcttctctttgctgagcctcacaaaatcttgtcctgtgcatggacagccamggatccttgggaaatctyatgcagacttctaggtccttcctttgtgtagatttcttctctccagtacgttgacctgcttcagagtcctcatcattgctttcttccttttcagctcagcaatactgctgtgtattgtgtgrgcttcatttgcctcagccatacctagaacacaacccaaggcagaaagctggagtggacctgaggytcatcacctgtttccttccacccaccatttaaaagcagcttatttgtgtgaaactttttgttgggttctgtgggggataygwataggcaaatgacagggagcttataatttagccaaagagaaaatgtctatatgttctgtggaattcagagtattttcctcgacttccaaaattattttcctcgacttccaaaatttggggctactagctagttggtaggaaggaattccagatccatttttcttctagatttttttcagactccatgtttcaaaatctaratggaaggtaagaaggaagcaaggagggcatcacatacgagagagacttataccccaaagtggatcattagcacattatgagataatatggtattattctcagaggcctgccatataaaattccttctaatttattttttaatggtatgtgcctgaaagttttctgtctttcatgatcttgaaagcaaaataagaaccagagtagcttatgagagagttttcctgcttcagcccagaaaaatgttgcttctgtcctagaccctttgatctggttcttagtgccagccttcattcctctagatctgtttattgaatactggctctgttgcagagactttgctagaatctgagagataaaagactcaatgccttcaaaacacctacaatccagacacttaaataaatgcaataatatatggttaaggtcttggatagaggaccatcatagaaacacatagaacagacatttagtccatgctagggagagggaagatgtcaaggaatgcttcctggaggtggcracatctaagctgagttttaaagtgggtgtaagagtgaaggaactgggaataggyaaaacataccttagagagctgcacctccaaagcatggaaggctagataatcttagaacttcaagtggggttcaatgtgcctgggacttggatttcaggcagagaccatagggcaagttggagaacaggtgggcagggtgagatgaagcagagacttttaataaccatcaarcaggcctgccatccaactgctatsagccattttccctttttgaattttatttttttaatctytagagcaatacatgtttatggtaggaaatgaaaaaaatatatagatgggtaaaatgaagtgaattataccacccacaatcctgctgtaaaacaggttttaacaagttataaatccctccagatcaaagtgctactaaactctacttgctattttataacctttttctgttcagagtattttagaaacgtttttacatgttaaytgatattcttttgcattatcctgaataatggtatttctttagttatactatcatgtattaaaacattcatacatggtaaacatatttgaatattagacatttcaattgttttcaatgtttggctattaaaaatagtatttagatgaatgttcttggccatacagttaatracttcactgagtccttgtcaataactttattaaatcccawtcttaagacaacaagcctataagattaacataccaggaataattagaaagcattgcaagactatatgtaaccatctccctgttaatcatccttakttgttgcaacatcctaaatagygacyttcccacactctgcctcataatatttaatctgtcaaatgtaccatcygcaaagggagtgaactggctcgtgaagaggtggtgaagctggttcaactcagtttaacagacaatgagggcctccgtgtgccagggagggagtgagggaactccacagggagctcattctggggagggatgcccctcattatctgcagtaaatgatattagagaagtatgtgtgagactcttggtgtccagaggaggggcatgcagcacagtatgggggtccatggggttgcagcgatttcttagagacggtgccatgcmtgggatgaccaccaagttaggatgctgtaaagagtaatcaaataagtttcaacagggttttggcatgaggtgagcmgttaatccaaatgatatctgaaatgctttctaatgctgcaartgtattcctctgtaaaataatcaactacttaaaagacactctcacttgcattatgtcatttaatcctcacagtgtccctaygggacaatagatgtcattcccacttgtacagagcagtaagtgaggctcacaccggtcatagttagaggagtagggaatctaaacctaagtctcttctactccaaaccccaagttttatcagtaygtcacatyrctactgtgggctgaattccttagcaggggttgtttcctccacctgcaatattcttccttttggtttgttcatcctctagagagagaagggatacgcattcatggagatcctactgttgcaaactctgcattaggagttttacatgaattgtctcatttagtcctcacaacagtcctgtgaggcacaggaaagttagatttacctgcccaaattaaggaatgtggccaactcaagagtgacgaaggccaggtgcggtggctcatgcctgtaatctcagcactttgggaggctgaggtgggaggctgaggatcgcttgagcccaggagtttaagaccagccagggcaacacagcaagatttaatctctactagaaataaaaaagaaattagccaggtgcctgtagtcccagttacttgggaggttgaagtgggacgattgcttgagcctgggaggtagaggctgcagtgagccatgatcccatcacttcactccagtcagggtgacagagtgagacccagtcttaaaacaaaacaaaacaaaaaagagtgatggagcaggaactttatctgccatcagagaccatatatgtctttccttatggcccaggtcatttatcatgtccttgctaaacctcctcctctgagccttgttaaagtcctcaaggttagaagagtggtctataattataaaaaattccattgtatgacttcagctacctgcaaaactgaccgagattaatgcattctttgtttgctttcactctttcaytccctgttcagcgcttattctacagaaaggtgcctggtagatttaggacatgactgttcataggcctcaaatgcggtcaaattaggaaagtcccctggtttttggtctcaagaggttaattgctgagtactagcctggactgctcaatggattttatgtttaactgttgtgtttatttgtttgtttgtttttgttttgtgagacatatctttctctgtcacctgggctggaggtcagtggtgtgaacatggctcaccgaagcctccatctcctgggctcaagtgatcctcctgcctcagccttcctagtagctgggactacaggcacacagcaccatgactggttaagttttggattttttggtagaaatggggtctcactctttgcgcaggctagttgtgaactcctggtatcaagggattctcccaatgtgctgggatttcggcctcccaaagtgctgggactgcaggcatgagccatcatgcccagcctctgtttaactgttaacatcatgaggtttcctttcaatgaggaagggaggcctggggaggtgtgatggggaagatggagaagggtaggagacatcataaaactgacagaagtgtggcacgattaagaccctggtttcttagaccacataagcaagtgccactattcttttgatcaacatttgattctctatttccttcttagcatatagatagctgcttcaggtcgtgaaaaaatacatttagtgaaatgaaacatagtagatatgttcaccaagaaactaaaaagaaaagttagccacaaactatcttatttcattgaaatgtttggctgaacccataagaatgttgatgaggccattcttggatgcctgtactgaaatgaaccacgagaggaatatttaggatatgttgaagaggctgtttggcttaatgaacaaaggagtttctgcaggcccagggagtggaatgaaaattggcatgatcattttggagaatatatggagtcaaacagagaatttgaatggagttttcaaagaggatatgttaggggaataaaggctgataaacaacacttgtatttgtaggaaaatagggagagtaaatcaaggaattcaaagrgaaagagaaactcacttcaagtaggggagaaaaaacccctrtaattttcactcttccttgtaaataaaaaggaaacaaatgaaaataagatattagaagtcagtaagaatttatgggagtataaagttggttttatggatgcaaagcccttttcactgctgtacgaaactcctggctgcatgctaacaatggacaactgatttccttgcagctgtattttgctgttttttgctcttggcttggacctagcaccctgggtctgtgggaaaccagaactgtcccagagttctggagggtaggccaaggttagatgctggagtgggttctttaatttattgtactgattcttcttgggaagaaagaagattgcttgttagaattttagctacgagagatgactatgaaacagtaaattaactccaacgacctgagtcaytttgaaaactcccagtctcaggataaaaaatataatcctatttagaaattcctggtgtgatcacagatgtagcattggttcttttcatgaaacccgtaaattaaaaagtacataatccaaagtcaattaaatagtaagctattataacaaattcttttatttcattagcttttcaaaatgtggataactacacactcaacccaaggaatytacatttttccactgactgctaaaraccaatggaaataactctagtccccgtagcacctcactgtggggtgacctacctttgaaataatgtrttggttctagctgatttttatattgttagtcattaagttaggcttgatgagaaacagatataatytgakttggggattcaagtattatattgcatttstcctcacaactagagataaatttgccatggtttttctcttcataggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgatkttactgaatctgagaaaaagttcatcaaaggaactgctgacttttttgctctttsctttggacccaccttgagttttcaacttttggaccctcacatgaarttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaaggtatgattgtgggtaaagttctcatttcctgccaaaatcttctggaaaaaaatctctaagattatctaacataaatgatgtgaatttatatttttaaatcctaatggagacattcattttggcaatagtagaatgcattcatktaacacctttctcatttggagtcttgaggaacttgaattaatttttaaaaacccatttgtaaatgagaaactgggttataatatttgtaattacttaactttcagttattaatctagatttttagattaaattgaacataaaacaaatcccaggatatctagctctctgcacatgtttttcagttcttgttattttggttgaataaaacactttaaagaaaaaggaatgtccatgttttctagagaaaatagtataaatagatcatgcttttaaagccttcatttatttatttattgcatcagacacaaagctgggtgtctaggatggaaagtggtacaagacatctttccagccctgtagaatatctattataaataaggaactattttttcaaggtgctcagaaatccaaaaaacatattagataggccrattttgagggcatttatttgtagagttatataggtttgattagagtctttcgtcaagaagaaaaatcattggcttaccaaacgagaagcattacactttatttatttaagtaggaaacgctcagctgctcttgaaccatgatgcaagtgcccagcraagggtcatgttgctcttgtcccctcttccctttgcagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactayattcaagtaagtcagctgacaaaaccaatcagcagtctcaccaagccctatcactagtaagtagtgcttccttcctaggctgattgtcatggcacattgtccgttctttgagccaaaaacaattccttatgagtacactaagggcacaatttggaatgctgcacccttctctccaaaactcttccaatcttcatcttgtttaagttagatycaaagataaataaatttaaagcatatcaatatttaagatccgattaagacagtaaaaagataaaacactctcttttcatactgtggtttttgatcctttttaaggcagttgagttttttcatgaacaggatctaacacagaactccaaagcctctgagtttcagtggtgctgctgagactgaggcaggaacattaggcagagtcctccagaggcacaactgtgggctccacaaatgtgcagaaataccctaagaaagtaaaccctagatccaatgattcactggtcagaatgtcttttttagcaatagtcattgaaatgataygaaatttcttcagaatgatcaaccaatatttattgagcatcttctcagtagtaagcccttaacattctttcagayttcctaaattttgaaggggcttgttttccagcatttgactggatactctagtaagcacttattggatgtctagtgtgtccgaagccttgtgttagttgctcgggtcgcttggttaaggggagtgcaggtagagggtatactgagatgagtaagggtaacctttgctttcaaaggagcaaaggagtctactgagcgaaaacaatgtatgcacaaatgatgcaatggagtgaagcgggcatggtggtaagtaacaagggcggggctgggggattgctgctgatagagtcccaagtgtgaaaatagccctcaagacagagacagagttcagtgtccatagacaagcagttggctttgacatgttgggttatggtagccaattaattggttctgcaaatcacagcttgaaaggaaacacttggaagaatgtgaaatgggttgctgttttcttgtaaatatccaattgaaatcttttatttataaggaaataaattaacaccatccttagtacattttttgctggttgggattattcttctttttcagaccacccagttcattttacaggcagtctcagacttaaaccctcgccttccatttaaaagatgactggctcacgcctgtaatcccagcactttgggaggccgaggcgggcggatcatgaggtcaggagatcaagaccatcctgaataacacggtgaaaccccgtctctactaaaaatacaaaaaaaaaaaaaattatccgggtgtggtggcgggcacctgtagtcccagctactctggaggctggggcaggagaatggcatgaacccaggaggcggagcttgcagtgagccgagattgcgccactgcactccagcctgggtracagagcaagagtccgtctcttaaaaaaaaaaatgactggatgtgtcatcttttatgccaggatatgtgagcccaggagaaaggcttctgagctccctcctgctcgstgtgcaattttctgccctgccccgactctctccttctctcccagcctcctgctatttgaaatctccttatcctaatttccctcctcagagtggattccactgtggggttcagagaggatctgaggtgggagaagtgaggctggtgaggaagaaggggaggagaaagggaagaagacctccgtagccttccttcctcctcctctttactggggttggggatagatcggatggtccctggtccttgttctatctcttgaccttctgcctgctccctgctgagcacggatctctgatagcagcctgagtctggcaggttcagtcctttgtatgcggcacaatctcccagccagcattgctgtgcagatcatgggaacgaatgcagaacaagagtgggggtgtcggagggagccctacttctcctgttctattcctcatcagggggctgtgcgctggctttgggaattggtaaatagtgagaaagtcttaagggtacatcctatttccttgagggagaagagaaaacgctggtcagaagcaataagtatagcagtgaatagcaagggagatgggagataattccttttcctactacactctagaagctattgttttagaatctgacctaaggtcagccactaattggccccagaggtctctctctcagatcacacggtccttttttcctcatcagcttggggaccycacccctcctcctgrcagtctcctcctgtgcagaacccaacaaacacaaaattaagtcactctcaaacccacagcagatgagagcttctctggaagctccctggtggggaaaggctgcaattgctattttcttcttctggttttcacctcaggctttgtgttatattgacagtacccttctcaagctaactccctaactgacgtagtcaaaataagttctttgtatgtcagttctgaggtgtgtgtgttttcacttacaaacagtactctrcagctttaagacattatattaaagtcctgagaagtgatttttaaaccactgaacttcatcttttccctcctggctagtatttcagactttcagtgtttgaggcatgcatttcacctgaacaacttgaaaaataatatcctaagaagcacacaacctgactttaggctcattcacatggattgtcactttacttggacccactttctcggctgagaggtttgttttcccataaccacggatgctcatagttaatataaatattgaactcactatgtagtgaggacatagagcctctttaacattggtccctgttaggagaaagtttctcccataacatactaaatacatgttttaatagccgttccttstgaaaggtccaacttcactattttatttttttagtaaaatcttagttaacaaattaatggaggttaggtggaattttgccccaaaagtcctgtattttctttttttttttttctttttttttgacagagtcttgctctgtcgcccaggctggagtgcagtggcgtgatctcggctcactgcaagctccgcctcctaaggtcacgccattctcctgcctcagcctcctgagtagctggggctacaggtgcccgccaccgcacccggctaattttttgtatttttagtagagaccgggtttcactgtgttagccaggatggtctcaatctcctgacctcgggatccacccacctcggcctcccaaagtgctgggattacaggcgtgagccaccatgcccggcctgtcctgtattttcaagaaactttttttttcctccagaaatgataccctagtctttcatatttgttttcagatggactgaataaaagctgttgttttggaacaatcacggttaaaaaaaaaagttatgaatttagtcaactcagagctctataaaaataatccaaaaaattccttcaaactctgaacgcttcaaaagagcgtgcaaatattctgtccttcaaagctaaggaaacatgatttgtggggtgcatcacagtggaaaaatactctgacagcattcccacagcattaggggaagtgcatgtgtgggtgttctgcaagggacaattctccagaaaaggcaatttccctttgacatgctgtttttaatgacttttctttataaacacacttatctctccagagaaatagcagtgcatttgcaacaggcccgtaaaatgcaacaaaacctctgctatggtttctgacccctgcttttatacagagcatcagaccaaggaacctgttctaacaggattatttcagaggggaacacaggcttagggtgcagatcttccagctggatttttcactttgcattccctccacagcagacacatgaaggaatgattttgtgattttgattttataatttgcacacttttcctaaatactttttttaaatttttatttgggaggattttatagcatatgattgagaactataatcatcatcattgttacagaagaataatttagaaaaattttttaactacgttaaaaattccactatgggtggatgacaatattgttctttccttccacattctccctccttagactttcttttctttttttctattttttttttgagatgaagtctcgctctgtcactcaggctggagtgcagtgccatgatcctggctcactgcaacctctgcctcccgggttcaagtgattctcccgcctcagcttcctgagtagctgggattacaggtgtgcaccaccacacctggctactttttgtatttttagtagagatggggtttcaccatgttggtcaggctggtctcaaactcctgatctcatgatctgcccgccttggccccgcaaagtgccgggattacaggcgtgagccactgcgcctggcctctctctcrgactttctaccatcagtcagattgaatttgttaaattctgtcactgaccctaaacccaacaaaaggcaagagttatgtttatttagcacttcctctacctatagcaaacctcaatttagagcgtaattttaagcacaatttaattataaatatcttttcattttcttacttaactcactcagttttttaaatcttcttttttgagacaagatcttgctctgtcactgaggccgatgtacagtgatgtgatcatgacttactgcagccttgacctcccaggcttaggtgatcctcatacctcagcctcccgagcaactaggactacaggcccgtgccaccatgccgggccaagacggggtttggacrtgttgccccagctggtctccaactcctggcctcaagtgaccctcccgcctcggcctctcaaagtgctgggattataggcatgagccaccgcacctggccaactcactcacattttaagttttttctttttttcatctagttttttttctttttaaatttgaaagcctcatgacattaatgatttcttacattaaaagaaaaacacccaaaaatactctgcttacataacaccgacaagtagtgtgcaagactcattagcatttgtcatctgaagtgaccaaatccagacttttgggggtcacattaaagaaacagttgaagagttagaactatgggtaaagcgagtgtgcatatcagaaagtggaatattgtcttcctcaggagctgacaatttatgaaaaatagttcacattctcagctagaaaggcttctatttttgctcatattcctggctagttttgctgaaataattgctttgaattacttcctcaggactgcccaggtgacgctaatgtttactctgcccttcacaggtagataccactctgtctcagtttaccgacctgaatgyttacctgtgggatgtccaccacagtaaaaggcttattaaagtggatggggttgtgaccaagaagaggaaatcctactgtgttgactttgctgccatccagccccagatcgctttactccaggaaatgcaygttacacattttcgcttctccctggactgggccctgattctccctctgggtaaccagtcccaggtgaaccacaccatcctgcagtactatygctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggcyragagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacrtggctcaactcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaaggtaaggagccctagctgcggcwatctcctgaaggttatgtcaccagagggcatgacacttgattaaatctccaacatcaacacacactgccacccttggaatggagggctatccattttgtgcctcactgaaacagtccaagagatatctagcatttccccaaggataaaggagtgtagctaaaagtagaagaccagaaatccctagcccctactctggatctatgcaagcctagattcttgtcttccatcttggatggctccacagcagtcttaactgtttcatgtacataaagcagtacataaagatttaaccttgctgggcatggtggctcacacctgtaatcccagcattttggaaggccaaggcaggaggattgcttgagcctagaagtttgagaccagcctgggcaacatagtgagaccttgtctctactaaaaatcacaaaaattagctgggcacggtggcatatacgcctgcagattcagytacttgggaggagaggcgggaggattgcttgagcttgggaggtccagctgcagtgaatcatgatcacagcactgcaatctggcctgggtgacagagcaagacactatttcaaaaaaaaaaagaccaagcatggtggytcatgcctgtaatcccagcactttgggaggctgaggcaggtggatcatctgaggtcagaagttcaagaccagcctgaccaacatggtgaaaccccgtctctactgaaaatacraaaattatccaggtgtagtgatgcacacctgtaatctcagctactcgggaggctgaggcagaagaatcacttgaactggggacgtggaggctgcagtgagccaagattgcaccattgcactccagcctgggtgacagagcaagactccatctcaaaaaaaaaaaaaaaaaaaaaaaggatttaacccaagtatatcatagtagattgaattatgtaaaacacccatttaacaaccaggtccaggtttgttctctctgtgtagtaaatcaatcactgtgacacaggttttgcaaaagagaaaagatttatttgtaaggggaccaagcgagggggtgggagaataacttccaatcctgcctctctgaagacaaggcttaggaatatgtatgggttagggaatgggtggtctaaggcatggtgaagagtgattggcagggggggaaaatgaagtaacaggttagacacatgcacagaaaatggtggtgttagcatgatctgagggcagagttttgggccctctgacgtcaaaagaccacctctcaggcacttgtgcaggcccagtggaagggtcagtggtcttaactagtttgaactggacaggagctgccccaagttcttggaaaaacaactgaagtgaccattgccatggtaacctatgaatgtcatcagtaaagtagccagtgaaggttaagtttcagcatacaatgggacaaccttcagcttcatggaaaaaggaaaaaaaaaaaacacatacacacacgaaaagcaagtgaccaaaagcaagcaggacaggcagacctgatccaattaacccctgggtttcaaccctgctaaatgcagctcaatatttgtcttgataatttgcctatttggctttacataarataaagccttttctgatgaaatctaattgagtctgaagttgtattaaatggtatcggaaactycccagcaggaaggctacgtaaaagtggccgggcgtggtgactcacgcctgtaatcccagcactttgggaggctgaggcaggcagatcacaaggtcaagaaatcgagaccatcctggccaacatggcgaaatcccatctctactaaaaaaaaaaatacaaaaatttgccaggtgtggtggtgctcacctgtagtcccagctactcaggaggctgaggcaggagaatctgttgaacctgggaggcggaggttgcagtgagtcaagatggtgccattgcactccagcctgtgtgacagagcaagactccgtctcaaaaaaaaaaaaaaagtgatgtgttgtgtgcaaaatacgtaataactactctcctatccttttgtttttccagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactrctcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcatatgagtggttgctagctaatttttttgtaattaaaaaaacttgagttgactaagccacctaagatgtgatgggagcagtggagaaatgggtgtgactgcaagaggcctgacccacgcggctggaagatggtaggggtgggagggcgacccaggctaggccatgtgtggagcagagagaatttcagagatgagacagcgaaatacacaagagctgaaaaggacaaaacagaagccagagccgcgaagagaagcgacctctgagaaccatccagctaccttctaatgcccgcctcatgctgactctgagtcggtaaaacttcgcaggtagcttggggtgaacgaaaggagggcacctctaggatcagccccgggacactaggcggcggcgctggaggcggggacttcctggccctggtggggcgaagtgcactcattcctccaccgcgtctcagagcaccgcgttctttccactctagtcttcttctctgatgctttcctctcatgaattctggtgtacatataatacagaaaccatcctccagaatgcctacacctcttcttcctttgtgggccaattctacaggggcgctaagtggccgacttgtggttccccagtgtgtctgggctgtttcctacacacttgtattcgccctgcattcgcggcgtattcctttgatcccaggtggacttttatccgccgttcattttgccctgctttggaaggacggttttccagtttcattagtgacacgtcattttatctttgacttccacagtcartacttagaatctgrcttggtcctgttggctcatgcctgtaatccccacactttggsaggccaaggcaggaggatcaattgaggctagaaatttgagaccagcctgggcaacatagtgagacccgtctcwacaaaaacttctaaaaattagccgggcgtggtgctgtgcacctgtagtcccagctactcgggaggttgaggtgggaggatcacttgaactcaggaggttgaggctgcagtgaactatgttcatgccattgcactccaacttgggcaacagaatgagacctgtctctgaaataataacaagaagactctattagagccttggaagttttccattaaattatttatgatagtgctgttcaacagatacaagcaagccatgtatttcattttaaattttctagtagtcatattaaaaaataaaaaggcatagaagagataaattttaataatatattttattctttccagtatatccaaaatattgtattttcaacttgtaattgatataaacattattgagatatttcacattttttttggtactaagtaattttggtactaagtaattagattggtctatagcatatttgtttaatatttaatattgagcaatgctgctggaaatttgcacttggaaaggaacatgttaatttggagcatgttggccatcctggatgggaggacctcggttctagaggggaaggcagaggccatgtcttgtctggtatattttttacagtgtttagcgcagtatctcttacatgatattgttcaacaaatgttgattaattgaatacatgacggaataaatgataagcagaattagctcactgccatcacctgtgcccagagactggtttaatagagatcacctgtcagccagcaatgacgatgtgttagatgccacacagctccatcctatatattcagaggaaggaatgataacytgtcttactaggtagagaggcagtaaaacttactgctgtcctaaattgttgcctccagacaaatcactaagtgaaaggttgtaactttttgtcttccttatccacatgtctttcaactagtcagtaatctttctstctcaggctgagttctttatctgtaaacaaaaacagtattttagaggaaccctttatgtcatctccaaatacttagtttcctagaatgtgtagcttttcccctcagacccattgcatttttccatttttataaccactaaatattgttggagttttgctggttgtaggacatttcctggaacttgttttttccatatctttgtggttaaacacccattgtctgatatcaaggagaaagaggtccagaaaacccacagggaaccttgagcaaagggtggaaatgccactaataatggtgacaggacacctacaatatggtgaaatcttgttttacatgatttytgcataccagaaaagacttggtgactactactcaagtcccccgacctctgctttttyttttttttttttttttttttttttttttttacccattgggttagagaagaaaacaatttcaacctacatattattgagataaaaaggcagagaaagaaraacaagaccaggctcaaaatgaccttacagttgggtagttttgggtaacgcaatccttggtgaasytcagtttcctcatctttgaaatgggagtgtctatcttagcacagtgctgaacataggaaatattcaataccttgggtatctaccccagacgttatttttttcctaractcatacaacttacccttaatgtgcatgtgatttcttgttaatcaratattttgagctcaataatgtaaaactagggactattacagtcaaaatgattcatcctgaagccttctagttattttatttgtgactttgaatatacattttcatagaatacccttggtaaaactaaatttagaaaaacgaagccccacatttacttaataataccaaattaccttcttggattcaaattttacaaatgttggattgatagaattctgaagataatttggcagcagatatttctgtatcaatatgttgaaccatctgctcttttgaaataatctaatgacacagacaaaacattaaaatgtgtatatttgttatttggttggtaaataattgaaggctcattaatttttatgagattcaaaaatctctggtagactttctgattttagtataatttttcaatatgtttactttatggtaaaatgaattaatgttaagtgacctaatttattttgtatacattatcttcaacggaaacattattccttaataaactgctggaatagactgacctttttttctgtttaaaatctcaattgatcagtttataaaattcaatttcctttcgatattataccagttgttgtctaattatggcygtgaccataaattttgcctaagacatttcagttggttttccatgtgaatcaaagctttggataatttatatccaacatgttagatggcaaattcaatagtgttccaaggtcacagtattgcatttaaggcatattggttttataaccatattttttcccctttaaattatgagaaccacgagtctctggtaagtarccccaaggcttcaaaatacaacatttcaatcaacagggggcagtagtggtaagccagagaggacacaacagagatataattagaggaagatggatgggtcagatagagatattttattagtaaaagacgagatgagattgaaccaacttttatcccaaattggtaccatgttaaatgtccttattttacctgtgcctgttatgggcctaacaatccaccaaaacaaacacartgtggggttactacgaccatcatgttgacaggatgagctgcaagattccagcagtgttggcaacatggctgcactggttcactcagacagagaggaaggagctgagggaaaccagaaattaggtaatgggcttgcasccttggggagagccccagagtggagtagtacctctgaatctgcatgctctgggatgtgctgsctaaatgcagaagaccaggccttttcccctcccagcccacgctttcgaaagtgcctttgggggaagatggcggcagcacccatggcttggtaagggatcactcccgactgattctgacaccctgttcatggagaaccacggggctttgtggaagggtgtagtcaagggcagatccagtgaatataagaaggcgagaaagaccagtgcacaggcaattgaacgagaaacaggaatgtcggaattcgagggcttaggagtgaagcatttccagcttgcatcaagaggactgatgaargagaagccagccgttggaggggaagctcagggagtgttcctccaggatacgaggaaggtcgtgtacaaagaggctgaaaaggctggggatggttttagggcttgtgggagtgggcccagtggaggaagggaggaaagcraaggatagaggagaactgtaggcaacgaattcaagtgtgtccagaaagtcagagcatgcctgagttgagaaagtggagtggaagggcaaggcagtaatatgccagcttccaggaactacaacagaggccctgggcccaggttttgggtggagcaggctcttatatttattccaaattggtaccagttaggtatctggtacctaaaccaggtagagagcccctattttctagttctacttgcaaatttgctttataacccagaggaagtcaccttaacccacggggcctcattgttttcttgtctataaaaagagggagttaatcaggaccagtgcttttctaccttggttacacatcagaatcgcctgggatttaaaaaattcctcagactaatgaagtcagtttttctggggggcagtggagctagctcccaggtgattgcaatgggaagctgaaattgagaaccagtgatctaatcagtgcgttgctgactttaacacacatatgagtcacctggggatcttagtcaaatgccaattctgattctagaggtctaggatgggcccaagggtttgcatttctaacagcctcccaggagtgcccatgatgctgctcttctgtggaccacagtttgagtagcaaggggctaagggccctctgggttgattgagggatataatttgttctaatagggataacaagagacagagagaaaagaactattagtctgttgttactgaaatggtatcatagaaagcgtcagaatgcaacaagtgccatggatggaaaacaggtactgatttaaggttgccacaatgaaaaccttaagacatgatgtcctaacaaacaaattatcactttaaatgcataatcattgtttgaaacagacgtgttttttaatattttaagttctgtggtacacatgcaggatgtgcacattcgttacataggtaaatgtgtgccatgttggtttgctgcacagatcagcccatcacctaggtattaagcccagcctccattagctattcttcctaatgctctccctccccttgccccacccctgacgggccccagtatgtgttgctccccccagtgtgtccatgtgttcttatcattcagcccgcacttagaagtgagaacatgcagtgttcggttttctgtgaaacagaccttttaggtgcagatgactacaatttaaaatttttaaaacagacttcaaagtctaaatkaccatactttttaaaattggaaataactttaatataaaaaatcatgaaaaaaagtcaaaattatctgctttttttttcttatttttaacatgttggaagagtaactaaatcaagagccttatgctgaaaacatcctatatgctcaaacatcttctggtgatgtatattcaatatgagataacaaaaatgaaaaacagcagatctgtatgataatgcacataatattatgtgcatgtttactgataacagacaagatgtgaattaggagacaaatgttttaaatttattggaacttttttatcattaaaaatatattttaaaatatatgttgaatgaagacagaacgaagctagtcttgaagggagattgctgcgttgggcaggttgaagtctgaaaaaaataatagttctggaacaaactctctaagcctgtcatagacctgctctttctcacctggagacatcgtgagacctaggtttaattgccatttcttttctgtgtttggtgcatccat

SEQ ID NO: 13327 - DNA, 244196 bp, Homo sapiens
  misc_feature (1)...(244196): n = A,T,C or G, or insertion/deletion polymorphism (see Tables 1-2)
aatttatggtatacaaaaacagttatgtaatacttgatatgttttccaatttagagagttatgctttgcaatagaagtccctgcttagtacttacggctttcaagatgttcatgtatttacaaaatattgatataattatgattttatttcacctctttaacacattgaattccttttttttctttttcttcttggaaaataaaacatgactttgggttaattccagcagtattttatctttggaaatgcatataaagctataaartgattttaaaatcctaagagaaagagaaacctgaggtttggcatcaggataaaaattgctcattattatttatcttttttattcataaaaattcatccacagatataactcgatattttgaaagctttaggtacaatcaatggcattatcttttaattttaagctttatttaagagatttaaagagatttcattcattttaatatttaacttataaaaatataaatcaaattctaaaatgcayaatttataagagcagaattaataatgagagcagatgtgtaaaaatataaatgttttcacatataaaatctgtttcggtattcctagtttgaactttaagtatcccagacctcaacattaaaatgaaatcattaaaattgctacattcctatctcatgaagatgttatgaagactaacaaaaaaccattaagtattttaaataaaaggaattttcctatgctggaaaatgcattttgtttttaacaaaatactcttatactaaatgtttttttttggaacccaaccatttatattcatatgtaattttccagtctttgtaaattagactgtgaaagcttttgaaatartatctattgtttgtccagcatttgaaagtgcaataatttcaccataccactactggcaaaaagcataatattgggagggttactaaacactgaaaatctgcaaaacaaattaagttgaagttatttaatacagatgttttaaaaatcagatctatttcaatatttaaccatatttgccggccttaaatcttgtatttggcatttgttgtggaatgtataagactcatataaaaataacagaaatattgcatatgtttcagaaaagtatctggtgtgagtcttcagatttttgatgcasatgcatttggtttcagacttaaatgattaggtgcgaatggtggaggcataaaacaattacatacgatswctagaaataatattcacttcaagtcaagaatactgtcaaatggtatcagggtggatcaatctgtgaagaaatgatagaggtgagaaagaggatcctacttattttagaaataatgtaatgatgtatttggtatcttgttgccttttgttatttataaagtaatgtcaaaggaaaattagtggtacattctcatttaactatgaaaattaaatttaaaaaattatgaaattgttatgaataaattcttaaattatccctttaaagatgctaacatctctaccttcagcaaacttattttgttaggaataaccaatgtgratcaagtcaatactactcaagtgatagttggaacactatagaaagtaaaatatcttggttatacattagtagtgttgtggtacacttcctttagttaaccatttagaaaatggtttactaaaacatgtaaaatccattcttccacatctaataatagaggtattcctgctgccctayacaacttggtaaaaagccatgttacattttttgctgacacacattcccaggatgccctaagagcttagtaaatgccaaatgcattcatttgagaaaaaaagagatacagagagtaaaggtatgttgacaaaagtccaaaatatatctaagtttttacsttgaattactccattctctgtttcttccttctatctttgattggaaaattatgaaaaggaactctgatagcttcctgtgaatatagctaactaaaatatctttttaacagaaataacatgaacatacaaggccatattccttgtttgtttggtgttcatttagatccaattttattttaggtccttttaaacaggatacatctgtcatctctgagatgtctctttcaacactccaacagaagaaggtaaaaatcttcttcatctgaagatattgttgtataatggaaattgggctaaatttggattcctctaatgttctataagttatttcagagtaatgttgccaaaaattacccaacccttactgtaaggtttttgtgagctaggctagactatggaaataaatttctctgtccctcttccaccaccacgctacaatacaatggcccatctgtgaggtcagagagactaactttacttttaaacagagactaatttctagccactcatgtattagaaaaactrtaaaatgaatgtcagactgcttagtcatttccttctcaaaataattgacctaaagttyagaaaagggcaagaaaggcaaacctttaggcacagtaagagagggattacatgcaaaagcaattttgttttaaacattttaagtatttctggtgtgtgcaagagccctcaccccataatttctcattcaacaaatcatatttgatgatataattttaattaaagtaaaatgtttagagaaaatacctaatttatatcyatctatctatctatctatctatctatctatatcaaaaatagggggatgaaacatcagtatgagaaaaggggaatacatgccaagtgacttaaaagatgatgcactgtttataaaatcgtgttacctaatatacttcttctttcccctaattctagctgtagtaatttaaggattgttatagagttctgtcaatattttaatactatttgtattaggggcatccagctattgtcaaggtgtcttcagtctccctttggttgtagaggtcttaatgtttcaaacactggttctgagtccagctcccctgattcctagagatttgtgaagatgtgaaggatggtttatgagctttttacaatgtttcataaagttctgtgggctctgaagattgtttagaactttaagtttccttactttgacctcccaatccattgtcgaattattatctcagtttctctgacaagccaatatggacgaatggttaatttaaaatgctgctacagaaaaattactattttttctctacttttcaaakcctgtttttgaaaatcttgccaataataactaattctacaaagctgaaaaaataactttaaacatcattatttgtaaatgtgacaaaataggaaaatatcaccgattgtgcttcaaactaaagacttatgtcaggaaaactgcctgttttattatattttgaatctacacgtaaacaattagcaaggactggttgaaagatggcccaggaaatgatgccattggaagttcccctgtgtgaagttgaagttagctaaggtgcctctcttctggctttcccctgctcccattgttgtttagtattatcctttctttcactgagttaatctcctrtaaatccatgggctggttcctagggaggctctagatctggcatctagcaacagactacagggcttagatataattattcctcaccatgaatttgctrtgtttccttctagaggcattcattgagacccagattatgcctagctgggcagtggccagaggaattyagaccacaamgtacagagagcataaggtggtaataactctattcacccaagatgctttgcctgaaaggaccctttcacagcagtgagaaggtctgagttgtgaccagaaagtagggactgctagattgactgcatcatttctcaccttctagaacagtatcaggccccagaactctcaataaatttgagagctattaagagacaatttggaacaccatttgtacatgttgctacaagcaccgtaactctctctggctattgaattgatttagaattctggcagcttcacaaatacgtatttctaaacttgcattcatttcactattttacatttgagagaagatgtaaaaagtaatttttaaaatatctgaakagtcgacagaaaaatcagtttgtacacaagtttggaaacagccaatatatacaaaytttccatctgtgagacgatgagggataatgaagatggtaaatacatatatttttactgtaagggtcttaatttgtaattgtgcatttcaggttcaaatgcaatatgatattaaattattttaaccaacagtttaaggttgtaatctgaagaactagttgatgatatttctctgcagctgatatgaggcatcccaaacattctgccaacagcattacaaatgtcaagtatttttttacctgtgatctaagagatagcttcttgataaaggagtagttctttgttatggagagtgatatttatattgaaggtattttctagttgctttcttcagtttatatgtctctgttcatgctgttatacccctataagggctcaatctagtctttgatcacctttcttccaattttaaactgcatgaagagatttgatgtaatctgatagatcatgaggcatattttgatgactaatagaaaactgagttcctaaagattagtggcagctgtagaattgaacatatrtacccagtaaacttagttgagggcctttaagcatttaaatgacttaaatactcaaagtaggccctggccaatgcttctagtctttgtcaacagaaaaatgtgttcattcatccaacccatctctattgagtggctaatgtatgctggcaccctgatgggcactgttccagaaaatctttgagagaaacatcttaggaattattaacgaacaaaaaggagtcaatagaatggaatgattttaacgtggaaaaagtgacttgggaatctatattccaggtgtaagaggattactttgaggatgggttaagtagagagggaatttagaaacctgccctcttcattactctcactgtggagtgaccacgtttttggctcccgaggctgagggccagggccaggcccttaatgaggagctgtgggccgagcctcttggagatttctgctagttgctttcctcgccttttctacacactcctcagtaccccctcatccaggatcagaacagaatcagctggaaaattaaattactcaccctcttaatgtcagytcccataaattttttcctccttctccctcagagtacagttcaactcttttaagaggaaagccactgaatgaacctagtgctgaatttaaacgtttaagagataaacctgtcagtttcagatctccaaagaggacttccctacatgctctaggttttgacttctagggtccctccattctatcttcattcctttcttctaattattgggttaaaaaaataaaaataaaaacacttttcagagtaggcagcgcaatgagtccactgkttccacgtctgccatacgaagcagatttttgcacaaggataaggttaccgctgccagcccaggactccagcggtgtggccgatcaggcgctggcctcctcccctctcccgccgaccagcgagaggctaacagacgggtgcaagtagacaagtagctgtttttattgaatacagaagctccttgaaaactccgtgtgctccggggctctcctgcaattcctttcattcccaaagtgctggagccaagcacgcgtcccccgtaactccctcccattttttctcggggatttggtaggcgaggagggaggagaggagtggggagatggggggtggttggtgggctgggcctgctcggagtcctcattcttgggctgagggaggcgggggcgggcttggggccgccccagagtcgtgtgattgggtctgaccctcagcctgcttgtcagtttcgccctgggagggggagctgggagcagggaggggagtgggcggaggagggggctgcccggagccactcgtccagcccactgacggcatgaagcctttaggggcacacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgawaccttggaaaggacgaagttggtctgcagtcgcaatttcgtgggttgagttcacagttgtgagtgcggggctcggagatggagccgtggtcctctaggkggaaaacgaaacggtggctctgggatttcaccgtaacaaccctcgcattgaccttcctcttccaagctagagaggtcagaggaggtaagaaaaaatggatttggggaggtgggagattgccgtcggtcctactgcttctgcgcccctccccccactttacccttcytccccgctcttcaagaaaaaaaaaaaaaagcaattcccttaaatacaatccagattgtagctgctaccaggttggaattggaaactggagaaagagatgaatgtaggcgggacaataaagggagacgaggtaggtagcaggaaaaaaagatctgtcaggaggagagcctgctgaaaatgcccttcaccactttccagcctctttgaaaagaggaaaaatattaccttgaacacaagggcagttatacaaagcttttgtttgaggcacagtctttagactgcccttggaacacatctggtttcttcagattctaactaatgggaatatctttttaagggtgagctgaggagaaaatataaagggtataaaatgaaccttgataaagttctttgtctgcaaccaagtgagaagcaggctgttttagttttggggatataagagaaaccaggggggtgaatctagaagatyaggaacactctgtgtgtttggggggcgggggagggtcaatctattttaagtggacaaaaattggcagattattaggaataggttcaagatagggagaacacttyyccctgaatttcagtgactccccccaccccacccctccgcttcttctrgcaggttggacgtgcagttctcttggagaatgatgaaagtcgccaagcaaatggggtgggggcggaggactagggattgggagggaaggggagggggtgtgggtagggtgggaggaragaggtaaggaacagttcctacgtggcaccaccaaatattcaatggccagacctgctcggaagtctgcaacccwgtcagtacccacggagggagagcgacttcactcctcccctccgccttctccctccctctttcccccgccctttcccgaaaaggcatctggctggagcggtccgttaggtgccttagaatcgactggcaggcgaaagcctttggaggtcagggagcccagacagcttagagtagaaagcaagctttgtgaggagtgcagaaagaagctgggggataggaaggagggtgactgacgaggttgggtcaagggagataaaaatggtcaagcccaaatgcgtaggctttagcagaaacttgagtgtggccctgggtctagatgccaagatctgagctctccctaatgagagtcagccctcccggaggccgatctctgmgaccaggttattccttccacacgcttagtggctttcagcttcccgagtagcaggcagcgctagattattcccttgggtgacttttcctgctaaatacagtgaaagtcctattaggactatatttgaattttgaaaggagttattatgttgattaattatgttgattcattcatttccacattttcaaggatagataagagtgtctttgaaagtgaaatccatcaaaaagtttgtattttacttttggtacctggtcaccggttggattggtcaattctgtcagcagttctgccctctgctggttttgtttattatttagaattcctgcgtctaccgtgggacatgaggcctctgtaagtccctcttaactacagtggtactggaaaaggacctttgattaaggaaaaatggatatgccatttctttttcagcatgtcacacacgcatgtaaatgagaatattgtaatggcagctatttattgaaaattataggaactgagaatttcttcggtgatggatgaaatacaagctccgagagacacttttgcatggattcagggattattttactgaagctatttatttttattttccacattgagcctttctgtrgmgatatgtgaatattttttaatatcaaatttctgtacttttcatgcataaattttctattttcagtctagcaacatacctgaaacacttttaaacagcatcccagtaccacatcaaataaatggtgggaaaacaactttccctatttttatgaagccaagtaatgatagaaatagcaaagtataaggattagattttgttgggtttcttcttcatgaaatgccctgaaagttaagtggtagtttagatatttatattttaagattttgttatgtgttttatcaagctgtttagtgctcatttttcctgggaggccacatattaacataaatccacttttgtaggcattcttatcccttaattaacttcaaaaagggaataatagtatattaatgcttaaaaagaaaacattggctacaaatcctgaatcaccacacaagggaaaaataaacccagtgtccacttctgataataacctttagatttgtggttgaagtaagattttataccaatttctaaataaagatattatatcccagcatcatactatgacattgatttcattgaggtacagtgataagatttggatattaagcacaaagataatttaaaacagatactacttttatataaaattaaaacattaaaaccttaaaacatctgagttcaaaacaaagttagactctaaagaaaataatatagagaaatttcttggaagtgaatggattaaagaaaatttatgacttcatacctagtcatattattttactttgaaaaatcaaactataacttggaaatatttattatactcattaaaaatcaatccttgctgtgatttagaataacaaggttaagtgtgatttttataaatatttatttacattaacttcaattttatgtttcatatatatgtttatttttaaagtaaatgatgtatctcagcgatttattgatattctttggcagttagtccattacttactattcacaggaggtggggtttacctggaattcatagtgaccacactatgattatcttaagatagatgagtttatgtaagggttttaagtaagagttagacttagctataatgaagcactaaaaaaaaaaaatctaattgaatcactttttactaattaaaattacatttaacctttggcagttaagccaatactgtatcttgtaaaaggctgatcaaactgggaactttggaagcttgtcaggaatcgatagtgagccctgaagaagtgtagttttgagtgcccaggatcagcaggtgaaatggtcctggcttccagagtatgtgctagtccaacartgcaaagagatcgaatttgtccatttggttccttaatcagaaatcagaaactcagatatgcttctgataagaaatgcagtgtttgctaaactcattaatattatgtctttccatttgttttttaaattcaaaattgatcaggactataatagagaaagaatatagactaaagagaaacacctttctgcatgctttacacacatagcttcagtttaggtggcacagattcttttacctagttgtccattagttttgaaattaagtttcttaatatcttaaagtgacaatttgcttcataattaatrcttaactgaggggatactttatagaagttattctctaaaaggtatttgtatagttttaaacaaagttatgcagtagcaaagtgagaaatgtatttgcataacataattggtaaaaaattaatattttttcggttttttattttcttcaatttgtgactaaaatagaaccacatggttgttcrtgttaagttatccttaaaatacagcaaagcaaacatctcttttcaaatttatgggttggctttctagctaagaaaattgtataaagagtcacctttcttttctaaaaatttgctttttcctaggataaattctcttcactctgattaatttagtgagatgctggctatttcatgataacaaggatttaaatcaagtttggttgagagtctctgtgtaatacaagctgaatttttaaaaggttaaaaaaagrtgtttatataagatttttaaaagagaatgctagcactagaaattatagaaattgctaatcaatcttaccttctcaataaatgaggaaactaagacacaaaaagttgtcagctgaatactcttcctcataaaaaatattcttgtaatattcaaggtttttctgagtagagtgaagatctgtaatggtgatcaaaagaattttaaataatagaagtctgagacaatggaatgagaggagagaacttagtagtgcaagttctaattaaagttttattttggattgtcaaaacacctgaaactaatgtaagtaccttttagctcaggaaaaaattgacatttaatttatgggaagtactcactctcaatggactaccattgtgcaatcaacaactattacaaatttaattaccatatgtgaaattacaaggaagtaaaagagaaagaattcgatatattatcgctatatttatttccagaagtctgaaattattagaccatatatttgctagagtttagattagtgagaaggtagatatagtgaaaatgtcttatataaagaaatttaaatagaaaatagttacagaatgaattttttaaatactctatttactacctttgaagaaaggtaatttttgatcatttgtattcttaattatgtcattttataagattacatcaaagtagaaggcgtaatactctattcattgctggattaagaacatagttttgtatgctctctaaagttgttaatagaagactaggtccaactttgaatttctaagaagcttagaaaattatatatttatttcaaataaaaaatggcaaatttctgatattttcaggttaatttcaattgattggatgacatatattttatgtatacatatagtatgacttttattaatgtcagataatcattatgacacacttgtgtgttgtttgtttaacagttttttttwaaacaagtggcaaactgaagaaaaaaataggagagaacgtagtagtgcaaattctaataaaggtttttattttggattgtcaaagtatctgaaattacataagtatctgttagcttaggcataaatgggcagttaatgtataggaagtagtcactcttagtaggctaccatgatatctgttgtgttgtcaacaactattacaaatttaattaccacatgtgaaattgcagggatgtaagggaggaaaattttgattttctatytcaaaatttatttctagaagtccagtcttcaactagtattcccaccaaattaagagtctttctgtttttagggaaaagcaatacatggccatagggtcctgaagattatactgtgaaagcatttatcatgagtttttatactcacaattaactataccattttatgtaaatatggagtttaaaaaatgctgagatatctccatcrttgtatacaatttttaatgattatgtttaggtatttaaaagccagaattttattagatacacttttattttctccttacttttggagaagtaatcaagcatggatggcgtgatcattaggaattcaaggcaactgcaagtggggactgagcgttggtcagcatttctgcttttactccttcacttccctcatgtaatactggggaaatgtgacctgagttgggagtggtgagaggaaaccaaactttttcttttttgaccattcaagttttgttccttagcaaagaagagagataaacgctgatgttataaaaagttgcaatgttccctaagttctttcactaaagagtcaactttaaatgcagttttcagtgtagctttcagtatacactaaygcactttctacatgaggacatattccttctaaattctcttgcaatttaattcaaaacctaaaggtattttttttccattttaaaatactttctgttttagaatgcatctaatgtatttctttctccttccttcaaaaccctaatatggttttattgatataggtaagtgtattcttttatatgttcacttgtgtcagaactcaacatgaataatactagcttgtagcaaagatgaaagacaattttaaagtgatttagtgagtaatatctatttatcagttgcagtctttggcctactactaacttggctagtggttctttagacattggctgatcaccagacctactgttatctggtaaaataaactctttgcttgctgcgcatggaattagagacagtgctattaatttaggagaaagaacttagagaaaggaaaggttatcatatttcagagtaagagaccagcttaaatacgacttgacaattgagaactaaaacaaacctgtgtaaaagtgctttagcacaattaacttttgcaatcccctcaaatcttcttttttttttttcttaaaaagcatttctttcttattttaaccaaatttaattgctcttgaatggctctgtactgtacaggcaaatgaagctccctattcatagaacttgagtgcacagagtatcaggggaagcttccttcctctgtttgactggtaaactgacatccggkcttaaaggagtgaaccttaractgtgtgaggtagttggctttccttcctcactcagattttcacatagactccctgaaaggatgactgccagaaagagcagtagctkgctaataagaactctagtgcattttcatacttggtgctcttaggtagctctgcacagaaagaaaaaaatgtaaatattgaagtggtgtctgtctttcctttacttctgtctttagagtctaagagtggagctcaacctactgctgactgttactcttccttttgcatgcaaatgaaacttcaattatttcactggcttttaggataagtttgttgtctaattgggttagagtgcccttcaggatgtggcatatctttatgtccaggctcaagaccagccatttcccacctccccaagcccatttccatttaccttgcactttagtgatgttaaacctcttgcctgtgttctcccctatctttgaacactcaccctggaatgtctatctcattctcttccatcagcaaacaccttctcctactttatacttcgaaatttaartaaaatatcatagctccagaaaacttttccttatatctccaggtgagccctaataccaaatacatgctcagtatgtacaaggttctgtcatatgcactttcatagagaatcttatttaattgwgacagttttcctggaagtaagctgatatcaaaatactgattttacccatgagataactgaaaaacagagaagtgaaagattttgcctaaagtcacacagctagtaagtagtagacccagaatttgaatgctgccaagctttctccaaggcccttgcttttggccacttgtccatgttgactttgctgggtgttctaatgcttctatacagcctcctaggcttatcttattattatggtgccctggggcctaatattaatgtacacatcatgcagctaaaccacagaaaataccaggtcattgggtgaataacytgactgccttcaaggagaaataaaaagaggttctggtaaaaggtgatgttagaatccagatagctcttcagcctgcacttaagttcagtggtagagaccatattactcttaccattttatggacaaacctcagcctcagtggtagtggaggattgaaaggggagtttctgggagccatcaaatattagttttgttcctttgattaacttaaggagaagctgacagatgtatctgttagtattcaaagttccagttgtggttggcttggtttcattaagtaaaagaactcttatagatcattgcttgtcctaatcaggatccattataaaggtcatcaggacttattctacttttggggattggtgtatggaagttctcttaactgtcttcagcataaaaaatgtcagagttgattatccaaaagcttttttggagtgtaatcaactgagagaatgtaacatcattattttaaaaattactcacttatgtcagtcttcttctaggagttcctgggtgggtagtgactgtgatctagttttatttgtgtccccagtgtctaccatggtgacaaaatacacagcattgatatagtaactatttaggttaattatattctttttttacccagaagactggaacaagattaaaattgagttagcttggaatggtgtgaactgaaagtttgaggacctcctcagattatgctgttggtagtgacatgagtagtgactcctcttttttaaattcatttgctaaaagtaaataaatttcaatttacctctagctttttcatatggaaaacagttctgcattctctccaaaggtgccactgaatatttgtagctacagagtgactatattacctccaaaactttgttttgttaataccttaagatatgtagtggtattgaccgtagcataaatcatcattttacttttctactagtgaacaagaaagtttaatctgagaataatatcaatctgtaaaatcgatcattggaaatagtcctctcatatattcattattgaacctttcatctcagattggtatgctattggggattagttgtctgactttgcttattagctattagaaatagcagtttatccatatataatatatatatatatatccatatatataatgtatggatgtgtgtgggtacatgtgcatgtgtgtataaataaagtgctttatgtttatttcaataaactcattcttcaagttagaaagtaaattatatgttttatgtatattggaattattatattatgaagtaccatctccaaacaagaaatatatagagcttcaaaatgcttaataagattaatagacaatagttgtaaaattcttttggaatatagttacatagtttttatactatattgctatccatggtatattttagttacactaaaatcactggtataggtatgtttatctgatttatttcatctagaacagaatccatctagaacagaaagcatctagaacagaatccaccacatagtaggcatttggtaaaactttgctgaatgaagtgagggcgttgttgacattgctaatgacttgattgtccataacctaaccacctgagatgtgatatatagctatrtgtatcacctactctcaatgtctatggaagtatcttgaaccaatttctgctgatattattgtgatttcctgagactatcagtctctattttggttctargccaacctatgacctctaccctaagcactctcccactttgttatttctgaaagtaaaaatcctctttgcttgagatttagatattgtctccctctagaaataactttcttcaagcattgaagattggggtagttagcctggcataacattataaagcacactatacttatccaaaactcaaatacttatctcaaaatatttttgatggtataatgaaagcaggaaatacatctttttcactgatgcaaaacattctggcatctgtcaccatatctagaggaaaatagatagccagtaaatattttttgaatgaatgaactcataagcaagatattttcaataaagtcaagaggactggggtccgtggcttagtatcataattatttccaatcctaacgctggaaattttgatgaaatagattttgtatgacatcaaagcatagatgctttataaagtttcatagataatgttgatgcagaagcaggggtttacaaaccttctgtaacaggaaaccaatatataaataaatagaaatgtatctggcttgtataactaggcactggaagtcgagtgaaaggctattcatcataatgtacaaattatttgataaatatgctattgctaagcagtagtggctctgcaataactgagttgaggagatcaactaattacaatatagaaaatgctttcttttaatccttctctccagagcatgtaataaactaaatgccaataaatattgctcttctcagtattaaagtcaaatggttatattggaagtataattttagttttataatacatcttttttttaacagccttggctatttgtaaattagaaatgctgtacttttaaaatgtcatactctcaactagtttttgttcttttcttcaccatactcagagttgtgatgccatttttgctttccactttcaggtcaagcttttatgatataaaaaagttcaggattgagtctgttcaataactgtaaaagttaaatgactatcttctatgttaatcactgtgttaagtgctgtggctacacagacaatatgatgatctctattctcatggagtgaaaagctaattaatacctgcaatcattcatttacttattcaacaaatatctattaaatccctattaaatgctcttcctgaattctaaactaattcattcatttcattgccacgttcgacaagtacaggttaaaagctcattatatgctaaaggtagttggtgggcaaagatagttataatcctgcctcgtagtgattatggtctacttgaggagacagtaattaatcaaatagtggtacaagtaaatataaaactacarctatgctagatgctttgaaggagaggtgtatggttcctggagaatacaaaacagaagtttagtaaagtcgaagaaaacttccctgagaaagtaccaattgagcattgattaattaactaaagtgaagaggaaagagcattccaggaagtgatgtgaaggcctttatgaagggaggatgacaccataagggacttgaagaaaggacttgaaaaatggcagtatgtctggagaagmagcagtggggataaaacgtgagatggtgctggggaagaaggcgggggacacataacacaagatcataaagatagatttttctgcatagcatggaaacatgtcactaattaaaaagtacaaggaaactgccaagttagcagggtcagtgcatacttcgatatcaacacataactaggttgtcccagttgattcctaccattggatcctctgacagtcagtgaactggggccatgytgttttttctggaatagccaaccctactgtcaaatcacttggggttctcaacagtaattagtacatttaagtcacactttatatggagctatggtcatgtagtcttgcaaaatatataagtaaacttccacttcataagggagtatgagaaaaatgttaaaataaaatctgctataagacaaaaacataacttagcatttctaaaccttatgtgactgttcttgttattaaccaaagtatatcagcttttagaacaaaaattgcaaacaatgatttttgtttcttaagattaatatatgaggtcatgatctctattttgattatttgagatgaccaattgtttattgtcagcatttttttaagtcttaaarttctctttcagtggaaattattcaaatagaattttaaagtaatcatgtcattgattgattaattgtagctctggatagcattggtaggctgtcaactcctaaagttttatttctatcctgctttaccctgaacttcagacttgcatacttgactgcctactcaatgatttctaacagtatttattaagtcatctcacatttagtatacccaaaactgaattgcagaactcctctcctgaaacctgttcttctcacagccttctccatctcacttaatggcaacccaatcaatcatgatgttccagctacaaatcttgaactaagctttactcattttctctcttatctccttttctacctatcagcaactcctatctgctccactttcagaatatatgtagaatctgacccttactttctgtctcagtctaagaaagcaacattttatatctggaaaattgcagttacttcctcactgccgcctgattccactcgagtgagcctagagtttcttctcaacacagcagacccagtggtctgaaagcataaaatgaatggaaactatctgcaccttcctctcaatttttctgtaaacctaaaactggtctaaaaaaaaaagttgattcaagtcatccttctmccctaaccttccaatggtttttaaatctcatttagaataaaatccagtctccctgaacattccacaggacctatacagcttgttatcagtgtatcctcacttttacttctctgaccacagctctttcactcttgttttgtccatgcagtcaatcttttttatagcagtattcacatattcacatagagtacatagaaagattttggcttttatataatacagagtttaaaataactttacagggaactaaatttcttcaatctgaagttcagctatcttttttttttgttaactttccatgctctctatccaaactgaacaatattttctgttacacaaatttacatgagaaaatatccaatgtacaaatgaagggacctgagcaggaaagagagccaaaatattaggaagtgggtatgggggataattttttgaaaaaagatccctttgttgagacatatttgtctccttgcatttctttcaacattctgggccaactattgtctcgggttctttgcacttatttttccttttgcttagaattctgttctgcaagaatagcaggatagaggaacttcctatgactttctagactttgcccaaatatcattttcttattgaggccttgcctgttctttttatttgatattattttccaggcctttgcaaccctccctataatctttttatgattcattttttccttagtactaatcaaatatttttcatatagaaaatgatggtgcatttaaagatactgagtttgtgttaattttctatgtaaaatgtaaaattagataattttagagtataaatgttgccttaaattatttaagcttttagatgttagcagcatctaggtcatctatatccaataattcccatagtttgttattccattttatgcagtattgacatacatacatagtatagtcaatataagagccaaattctacacagtaaagcattttttcttatttgatggacactatgcatgttaattcaggtgttctgagaaatgacagctgtgtagaaatggtaacggcattttgtactttgttttgttggtttaagagagccatggtgatggctacctagaaagtagtattgcccttaatcaaagataaattcagaatcatgtattttatgtagagttgacttttgaccaacataagagtaagaggagccaactccctgtgcattgaaaatccatgtataacttttggctccccyaagacttcattactaatgcctaccattcatgggaagccttattgacaaaataaacagttgattaatacatattttgtatgttatatatattttatgctgtattcttacaatagagaacagaaaatgttcttaagaaacataaggatgagaaaatatatttagtattcattaaatgtaagtgaatcatcataaagattttccttatcatcatcatcatcttcaygttgaggaggaggaggaagacaaggggctgatcttttctcagggatggcagaggcagaagaagtggaaggggaggcaggagacgcagacacacctgtgcaactttagggctatacattgtaattggtgtctgactttttgcttttttgtatctctaaaaaatgttttcatatggtaccaatccttcytccactgtttgctttaattttagttaccatatcatagaagggtctatgtgataaaagaaggcaaaagcagtcttgaataatcagaccacttctgccagattgtctaatgtcaatttgttttctgacactgcctcttctatttcttcttccccatcttctgacactggtttggaagcattcatcctcatcaagttgtcttctgctaattactcttgtgtggtgtctattagctcttgaatttttccaagatccatatcttgaaaccctttgcccccacacctccacattttttttccatatccacaatctctttcctgatttcctttattggctctgctgcaaatcctgtgaagccatggataacatatggccacagttttcttcaggaggaatttattgcttcaggcttgatggctttcaaggctttctctgtaacaatgatgacatcttcaatggtgtaacccttccagactttcatgatgttctttctatcagcgttctcttccatagcattgacagtgctttccatacagtaccatgtgagtgagccttaaaaatccttatgaccccatgacacagaggttgaattagagatgtactttggacaagtagaccacttgaacacctttgtcattgaattcatggggttatgggtggccaggggcattgtccaatatcaaaagaactttaaaaggcggtttattactggcaatgtattttccaacttcaaggacaaaatatcgacagaaccactccagaaaaagggttcttgtccaagccttcttgttgtactaccgaaagacaggcattcctgtttatcttttcccttcaaggcttggggttagcaactttatagataagggatgccttcctcataaacctgactgaatttgcacaactgtagaatttgcctgtttcttcttaccttaaatcctggtgctcacttttctttcttactaataaatatcctttgtggatttttttttccagaatagggctgtttcatatgcatgaaaaaacctgttcaggcagctattctttctcctcagtggtttttctaatggtatctgggaaatggtttgctgcctgttcatcaacgaaaggtgcttctcctgttatcttgacatttttaaagcagacctctttctaaaattatcgaaccaccctttttggcattaaattcttcagctttagattcttcaccttgcttttgctttaagttgtcatataatgacttcactttttcttgaatcatattgaacttcatagctayataatggctttctcatagccaccctcacccacataaagctgcattttcaatataagattttaaaaaagatgttttgcaaaagttcaaggcttttgcacttactggcatagatgcagtgatggattcatggatttcctttcttttcttttgtctttttctgtttttttttgtttgtttgtttttggaacaatgatccttatgctggactcatttatcttgaaatggcaggcaaccacagcagacctcaatctacagtacatatcaagcaattcaactttgtgtatgtatgtatgtgtgtgtcatgacttttctctgcttcttgggagtatgtgaaacattaatggtacttcagataggttccctggtgcttttcaaggtttacaatatcgcactaaatgtgatgaaaagcacacaagaaacatgagagatcactttttacagagataggcaatttactagagagatccactgctcatgtggaaatgatatttaagcagatacttgccacatttgggttcaccacaatagcaacaggaggtggctwacaaatgattacagtagtacagaatgcactacacttaatcttatgcagttttcatttattgctgcatctttatgtttgtttacatttctctccactatgaatggtgccatgtgtaatggtgccatgtatgatctgtgtttgtgtgcataagatttgacaaattttgactttttatactttatttgtgcctattttatggtagtaaaccataaaagacttgtatctacatatattttgtgcattcatgacatacttaactttttcttaatgtttttgatatttttagcctactttgttcttctggaaggtttctcamattgtcacaaatctccaaaaatgtgttttaaatttatgtattgaaccatattcatacataactggacctatacatttcaaattagtattgttcaagggtcaactatttmtctcaatccctaaataggttagaattataaataggcaacaatgggatgctgatacaattgattttgctggaagtcacactttttcattaattacacttcagaatattttactatgtatttttattgacctttctaattatgaatttcactatgcagttcattttgttttaaactggaattttcctggaattgtaagaaaatacatttacatttgttcactggatttctattttctgaaaagatagtactaataggcttgttatgtgtttggtttgatgaaattaactctaaaattcctaaaactccaggttactgatatatattgtctttcttatgtcattctcagtttggtgctcttcactgtttgaatatgaaatacgcagtttttttcaaggtgcctatcaaaatcttaagccattttatgccaacatttgtttatttatagtattcgtgtgtatattagtgtatatgtggagaaatatattaagtaaacagagcattattaatgacaacacatcttagttgattataaaacccttcggggaaaattgaactctaaataatattgtggaacacttcccatgtcctgtagtaattaatgtaaactatacaactgtaagggcttcatatataatcttacaatttactaatgtattttagtagtttatttctttaattttgcacttgtgttgactacaaagattagattgtagcatacaagtcaaacatctggtaatttcatccaaaaagggttctattgagggtaggaagtttatgtratttttattggcattatttgtgtsacatcatcatttaaatatgaacttctgtatcttttcaaatatgggagtatttaagtcaatgtgcttaattttctaatattttatattcatatataattcatggttggtatgtggaatatatgtatttacaataaatgaaagaacagtgtcagaggaaagggtctacaatattacatttttaaatctttaataaatagcttagatgaggcccgctgtgtttaagctatagttatatcaatttctatgcaatgcaaagaaaaaataatgaaaagagaaaaatgctaatgatatcagtgtattaatgtccatttgtactactagggggtaatgaagtgctgagcatgaaaatatagatttaagatctatttggttgcttaagctaaattccaggaaacctcctgaggttgtttgcatctggaatacaatatgaacatgctgaagagattgctaagcagtacataatttttatggatgattttgaatggacatttagagatcaaaactgtttagtattctactcaactgcagagaactttcccaaggtagtctgaggaagcagataacaggaatcaatttaattatagctctagggaaatgtggatggtattaaagatgttcagaaaggtagacattttcatggaataataattttagataatatttttattgaatatgtattatgcattagacaccattctatgtttaaaattccttacagcgtttaattctcaaaatgagactaaattgagaaaactaagtcttggagaggtaaatagcttatccaaagtcatagaaataataactactgaatttggattagttgttgggcagttcttactgtggaaactagttatcaattgttgtttataggcttgkcatgtcccagtttttagactctttcttaagagccatcatgattttgaaatatagcagaatattagtagtaggaaaattataagaaataatcaattttctatccttttctcttttgtcagtcctacatctcactaccacatgctcatagtagcaatactggttttttgactgagtggaagatggctgagaactttcttctgtattattttatttttattagttccataatggtatgcctcacatatagtctgtgatgtgaggtatgggttgagaataagtgactctcaagaagttgggaaaatatctacattaggaaggctactttattattgttacttattttattttattttattatttatttatttatttatttattttgagacaaagcctcgttctgtcccaggctggagtgcagtggtgtgatctcggctcgctgcaacctctgcctccaaggttcaagagattctcctgcctcagcctttggagtagctgggattacaggtgcatgccaccatgccaggctaatttttgtatttttagtagagacagggtttcgccatgttggccaggctggacttgaactcctgacctcrtgatccacccacctcggcctcccaaagtgctgagattacaggcgtgggccaccacgctgcttcacacctatattcttcccacacctgaatcaaacaatggcaacaaacaaacttggaaacctcttcaagttcttggtaaaggtcacttccaatcctcttcctttcccatctcaaactggtaggaaaaatgcttcaactatgagacagcttgtggctactcatttattcatccattaaacatttctccattgattatttactgtgcttcagctgctatgtctttgcaatttgatagtgaatatcaatagcactgatgttcactgtcagagggtttacagtgtatcaagggaggcagatgttaaacaataaattacatgcttaacagagagagaaaaatattagctgatgtgagtatgtaacaagaaaatcatgaccataatttagacagatgctgtgcctgagagcatacagcctagagccaaagacataattaagcaagcgaacaaaatagtgtagggtgatctaaggggaaatacaagacactgggatcatataaagaggtcacatcatcctcttggatgagctaagaataaatctcctagaataagtcatgcttaggtttacactaaaaggttgactaggtctgaagccaccgagtttcaaccctggctgcacattaaactcatctgggaaacttaaaaaatatggatgtctgtacccaatcattctagtttattagttctggggtgggttccaggcattcataggttttataaactcttcagatgattctattgacaggattgaaaaataagtcaactgtccttaaccaattgaggaaggactggaaaaaatctacagataaagacagcaaggtacattttagaaactgaaaattattccagttctagtaataaatgtcaggatgggcgagtcgatagtttttattggagatggctcttggagtttgtggcagtgaatgcatgatgaagatatgatttttctccagtggtcctcagcagccatggtgcatccagggataatctggagagctaaattttctccgtgtccatgtctccttgggcaagcatggctggtttccttgaactctttactctctttgtatctgtgctaccatatctgctgtttctttccttctcttcttcactraggaactcctatttatccctagggactcagcttaaaagggctaggtagtagatattttagttgttgtgagcacacagtctctgttgcagctacgcaactctgttgcagtacaaaagcagctatggrcaatatataaatgaacgggtgtgactatgttccaataaaaactttctttatgaaagctgaaatttcatatagttttcatgtgtcacaaaatattgtccttttatttttcaacatttaaaatgtacaattattcttayatcatgtaccatataaaaataggcagcaaggaggtctatgggaggtctatacccacaggcacagatttccccaccatcattcgaaggcattgttacaaaaaccaatttagttctgacaaaaaaaaactctttgaagtaaatatttttgttattctcattgtactgatatagaaacggaggcccagagtaattaagtaatctgtccaagtcacacagatgctaagaggcagaggtggacttaagaagcagttttgctctttaacackgtaatgatgcggttcactactggtcatgggagtgtgcaaagaagcttagagaaggaattagagatgaaacaatcaaagtattatgagatgtttcatcagtaatctatatggatggtgaaggcaacaagggagaaaggatcaaagacttgggatcaawctgatcagtgaaagggtggtggtgtttaagaggtcaatagactacaataaaaagtacatattaggacctaaaaaaatttaatttcgacactagatagcctgaggatttcagaggaagttccttccatatattttcacattatcgtgtttcacattcaaccaacattttcataatctctgtgtgtttgtgtgtgtatacctgttccttactagtttgcaaaaattggcaaagacaaggcaaataattttaaaaaagtatgaaaggtgctataatagaggttagcagatctaacccagcttagggagacagagaatgttttctgcagaagatgcattaycaggtatattcttatccttcaggtgaggtggagctaagtgtttgaaacagagagtagggtttataaaggcccagaagcaagccagagaacatggtggattctggaaagactgagtttagtatggtagaacactgaatgaggacagaatgagggactcatgagagctaagactgtacattcagtgagcttagagtggtaggataagtgggagtgtccagatatccaagttgtatattcaaggaatgtggaaatcatctgagagycagtggggttctttgaaggaatttaaacatcagagtgacatgagacatggatttttggaagcttaatcaagytggtggaatgaagaytgatgggaaaaagtatggaacccagttaagtggctattttagtagcacattgggctctgatattctattctcccgtttaataaacctataggtattcaataaagracaggaaaatataattgaacaaaacattgtgctgaattggatacatctgaattgcatacacatggtttgtgccagcagttggcaacatagagataattaaaatrttaaggtcatttaagaattgctttgaatatggacattttacttttttcatatatcatatttagccataaaattacttcttttaatctttgaacagttgcagttagcaaaatataaagaatagctttcccacatatatgtatgtatgcgtataaaacagtagaatccatttaatgacaatttattaaaygcaatatctatgaggattatgagatcaaataacaggcagaatttcaaagtagcttaattcattatttagttcacttkaaataaaataaacttaaggacttaattaatggagttttacttttttgtaacttgaaatgcctttttgggaaaaaaaaaaaggcttggttgatacctttattwtatgtctctacttgtattgttttttgaggagtgaacacttggataaggtcatggtgttaaaagatacgttgttgccgggcgcggtggctcacgcctgtaatcccagcactttgggaggcygaggcgggcggatcaggaagtcaggagatcragaccatcctggctaacactgtgaaaccccgtctctactaaaaatacaaaaaattagccgggcgtggtggcgggcgcctggagtcccagctactcaggagrctgaggcaggagagtggcgtgaacctgggaggcggggcttgcagckagccgagatcgcgccactgcactccagcctgggcaacagagcaagactccgtctcaaaaacaaacaaacaaacaaacaaaatagatacgttgtggactttgcagtccattttatgtattatttacctytgcccaattgtgattatgacagtggggatgcattttgkttttccttttcagaaaaattacagccttcatagatgtgttcatgtctatcctcaagtctttattcagttctactttggagaatggcttcagagcaaaaatataagataatttaagcagataaaatgctgtggttttcagaaacattcttcttcagagtcatttatatactagaacaagtaatgagtttagtttaaaataaatatgaacatcaggaatcaattagctggcccaaataacataaacatattatatgtatgttttaagtttatttttgcagagtttttattttggggtatagcagggtgagtggtgaagtggaaggagcatagagttggtatttacacagatcttaagagtaatcttagtttgttctctggttctyaaatctcaatctgcacaggrsggataagaacatatggtttgtgagggttaatccctgtaaagaacttagtccagagactggcacatattaggctctccctggcagttattatgattagcattttcttagttatgaggtaagagaaaakaacacatataaaacagatatmctattggcttaaaaacatagccgttgcaagcaggactagtgcaaaaaaatgttctcaaacatcattataatttttatatctcaggcatgctgaatgatatttggccagcatatggtctactctgaatgttttgcttgtttttgaatataggtatgaagccaatagaatataagtcaagcaggtcctcaaatactgttgttttgttcaactcgttcagtgataatgttgataagaaaaaaaaaaagtccgttcccagtcagggccactatgtggcgattacatgttctccctgtgcctccgtgggatttcactggrcactctggtttccttccacatccccaaaatgtgtacagagaattgctgtctctaaatggtcccagtctggttgagtgggtatatgtgccctaccatgagatggtgtcctgtccaggactrgttcccgccctgcgtcctgaatgtttgggttgggctccagccatttggggccctgaactgggataagcaggttggaaatgaatgaacaaatgaatgaatgaatacaaattgttatcaaataaaaatctgtaaactctaccataattatccaaatgcacataataaataatgcagtacaaaagcactcagagctcatcatatttgtgattgattctgaactgcatggtgggaggacatgctccttacaattttcacttttcaaacgtttataccttaatttaacccagcactactatgaccaccgtcattcactgattcaccaaaaattggataaataattatttcatttttcattaatctttcttaaatgtatgtgtagctcacatttagttcaatgttcagtatgaaacgtgttttcagtctttatttagaagtttggtggtgtatttgtgatcagaaatagactgtaggaacttaactctggtttatatcmgtgagcctatggtcaaattggtttcattaaagttgatttgctcaatgtagaagtttccaagagcctatcgaggatattaagtgaggacttactgtacattgagtaatatgggttctaaagtctgtttttaaaataatacttgaactgcattattcatgtcctgacttgcttagtgacttaaatatatatgtaattatggaccagacaacttgaagatctaaaaaagataaagtgtttttttttttttttctaaatggcatatttcatgtagtgtactgttttgaaggttgatccgtgttatagcctgtatcaggacttctttcctttttatggctggatacttttggttaatccattcatctgttgaaagaaacttggattgtttccaccttttggctattgtgaataatgctgcagtgaacattgtgttcaaatttttgattgagtcccagctttcaattattttaggcatatatgtgggagtggaattgctgggtcatatggcacttctgtatgagtctacttaaatgaaaattctyraatgagtaactagagacagaaagtatataagaggttgtcagggggtaggaggttgaaggagtgaagagttattgcataatggtgatgaagtttgagttgatgaaaaatgttcagaaatagataattatagttgtacaatattgtgagtgtaattaatgctactgaattgtacacttaaaaaatctaaaatggcaaatttaatgttatatgtattgatcacaattaaarataataatagtacaatataccaaaaaccactgtttgcttttaagtgggtgttttgtatggtatgtgaattataacccgataaagctgtttatacaaatgggtcacacttacaaagggaaagtttaaggttccaaacatattttatattgaccacgtcacagtaactaccaagtacctggaatgaattagatttgggaaatttatgcttccactaaaaagtagcctagttttacataccctaagactacaaaaaaaatgtgaaggggcacaattactaaattactcatctccagggactttcagcctaaataatgaagtatggagtaatatccatgaagtgactggtaagttgagataataaaaatcgataaattacatatagrtagatacatacatacacctttgtgtgcatatataagtacctgtatataatttgtaaataactaactcaggaaagcactgaaaaaggcattgtattgtgctacctatttttttaacacctttctttcaacttctcttgtgtatacaaaatgactaagtaggtgcacattttacagagtttacatataacatccattgtacatttgaatcttcaaaatcacctctgtttagattatgaatagtttattagtaactctgttggaaaatgaaatatttacaaatgctggctttcactttaattctacataatgttattacttggaattattaaatattttataaattataattgagatacatatgaatgtttataaatcatatataggaaactttaaattccagatgcacatatgcctatgtacacacacacrcacacrcacacacacacasacacasacacasacacacacacacacasagacaccccttctgtgttgcttaaccataatttgattccagatttgagatattttgaatttgagaatgttgttatggtttatattactacctgctgccccactctccaaactcccacctaaatgttagggaagcatggcaagtgataaatagattcaaggtatgaaatgacatactatcctgtgttaaaaatactcattgttatatcagatcgttgttcaattctggttttttattgtttgcttatttttcagctgctccagttgatgtactaaaagcactagaktttcacaattctccagagggaatatcaaaaacaacgggattttgcacaaacagaaagaattctaaaggctcagatactgcttacagagtttcaaagcaagcacaactcagtgccccaacaaaacagttatttccaggtatattcactttattattattattgttattattactaaaasttrttacacttttgttactactaaaactacttttagtatttctttactaattagtatttttatcaggttagataatgtgcarttatatggtaaaatgcaattctttcwtatatcagacaccaaataccttgtggtcaccaaagtaatgtaatgaaaataacaaaaaatttgataattgccagtcttaattcaacacaatcacatttctgtgaaaatattcttatttgaacatttagtacttcattatttgtacataatatatggagacaacattttatatctagcctatttctacttgtaattaggtagagcttattcatcgtgactggggtataggagggaatctttccccttwatgactttctaagttaatttaatgggcatttgaatgtaaacatacttagtgcatrttttcctaacattaaggtaaatgtttctgttgaaagagatactttttctttgcaaataattttgcattattttttcatgccgytcttatctaaaatataagaaaagttagtcacatctcacagttatccctcctgaaactagagatttttttaaaatatcagctggcagtttttcataatggtactgaaaagtacttgctgaatatttgtttttccttccatgagagcactaattgacctaataacactaattatctagaaatcatgataatgtggagaaagggaattgagtggtgaaatgacaattttcgagcctcatattttcaaagcaggtaacttgttaactgtgcttgcctccatttgatacataccagttatctattgattggtcarttgatgggtgttctcatccttatttaacagaggaggaaactgaatttcacagaggctctctgacttgaccaagttatgtgcagtcaatatttaatctaggtctgttctgctctatatattttatatgtcatcaaatggtcctttctggcactttgggatcttctcagcagcaatttatcatttaaattcttcatattatcctatattatctctgcttgaggaaatttgagtttcctatcttcatatgaaactgttttctaacaagagaaaacaagtataaatcaagggattaaaacattacaaaacagcacagtacacttttcatagaaggacattttaaaatatattgaaatacatttattttgattgttcactgattcttccaatatattttctgttttgcaatactttgtggtgaacaagaacaaactgaaaatataaagaataaaatgaactttttttctgactttgaaaataaaaaagttaaagtgattattaaatccataaaacattttaaaaatagatttaaaaaaattaaaagtaaaaaggtaagctgctttttctatttatgtgcactctgctgcatttcctaaagcatccttaatagaaaaagggatgggaattttgaagagagtaaaacaaagaaaaatataccaattaaaaacctttagaactactcagattacaggttacaatttttatactttagctcattatctcagggtcagtgtgttctgcattccaatgtggtagttacttaaaatcattaattttatataactaattttaaatactatatatttaagtgataagagccatataatcaacattatctgactgctttctttatgatacagtctcatataatttccacaatagttccatgggacagattaaattattagcccagccaatggatgggaagggcaagtaggattttatttgccaagaacacatagctaggagatggtgggttgattccatatattggctattatgaataatattgcaataaatattggactgcagatatcccttcaacatmctgatgtcatttacttrggacatatacccagtagtagggttgatggataatataacataggagtgcaggtatctctttgacatactgattkyatttcctttgtatgtatactcagtagtgcgattgatggcactasctctaattttttgaggaaattttttactattttctatatggctgtattaatttacattttcaccaatagtatgaaacagttcctttttctctacatctgcaccaacacttatcttttgactttttgatagttrccattcatactggagtggggtaatagctcattgcagttttgatttacatattcctaatgattaacgatgttgagcattttyttcatatacccgttagccatttgtatgtcttcttcaagatatgtttattcagacatcttgtccatttttaattggattacttgtttttktctattgagttgtttgagttccttacatgtttttaatattaaccccttatcagatgtatagtttgcaaatattttctyctgttctaaaggttgtctcttcactttgttaattttttcttttgctttktaaatactttttagttaaatgtaatcctatttggatgtggtagggctgggatttgagccaaatgatctgacaagattcagaactttcaattgagatactgtactgtcttccacttaactagtctatgcatacatttatagcataaaaatgtattcatgcctcttgctgttttttcttttgtaatatgttttaataatttccacttcataaaacatctttctgctacattaagtggctgcatacgattctattacataccatacatatttgtattttatttaatcagtttcaatcattgcagcttattataaaattttattattataaatagtactttggtgatttgaaagtacaatacatttacacataagcatcctctccccatacattcttagaagtagaattgctgatctcctacaattgtttgaacttgaatccaagccagacataatcatatttcttttatagatttatactactgcctgtaatagaatttggaatgaatggattgaaaaaggaaggccttgatattaggctagatattgttgattacacatgcacatacacaatggttttgcaaaaagacaacttttcaactaaaggcatctcatttctcaaataataatgcttgytttatttatatgccagagtagtaagaggctcaaataagatatatttgtaaaactattttgaaaaataaaacccgcaacttaatatacaytgttttataaaaatataagtactcattacttaattatttgagatatacttagggtaattgtttaactgatatatttatataacagatgcttagtaaggaccaatgtagatcagactgtatgctagatatttggcatatgattgagagagagaagaaaagaaaaagagtctgccttcttgaatttaaaatcaagttagccaattacctaatagttctggctcataatgacatatgcttctttaataagaagcaatatrcagtgaaactgcattgtttgatattaagaactaatcraaaactcttaagcttttaaagaaacaacagaaagaatacgtttgtaaattgggtcattacaatgcctctttaaagtgggcatgtatggctacggactagacaaagacaaaaaatacaaactttasgccaaaattagcacttaaataaatgttttaagagtggtggttatgtgtttgatatttactggtatcataatcctgttgcctaaaccaaatttaatttcacataaacattgtgctttaagtactttaagtgagtgtctttaaagtttgactatagcttggataaaaattgaagagaaaccttaatggaggacccctatttatttattaatctgtttactattcaamgttagttgatttataaaggccatgtagaaatttcaaaaataccacagtgatctaggaataaagtagaaattggaaattggaaatttctaactctttggccttttcytctcaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtaagtaacaaaataatacaatrttttagctatgccaaaatcattttttttattcagtcacttaacaaatatttatgaagtgtgataaggtttttctagaggctggtgataaataaatgagcaaaaaatacataaagacataatttatagtgtgtacagggaaacaataaacaatgttttcaaaataaattactaataagtagtatagcaggtggtaataagtgtgaaagaaaaagagagcagtaaagaggttagggtgtggcagtggggtgggtagtttwaagaagtgacatcaagccaaatcccactaagaaagtgatatgtaaagaaggtaaagtgcatgccatgctgttcattaaaagactagtgttccaggagaagcaggaagcmaatacagtctctgattccagggtgtggccagtttgttccaagcaacatcaaggataccagcatggcaggagaagagtgggatgatgaggatggagaagcagagggaggccagatggtataacacattgtaggaggtcgtaagcactttggattctactctgagagaaacaggaagttactggaggcttttkgagcagaagaatgatctaatttgacttacgttttactaataatattaatattggagatcagaggaagcattatagagtgctgatatgtgccatgtactaargtctttatacattgttaactcatttagttttattgattcctttaagaaagtaatgttaacaaactaattttcctggtaagggaactgaggctcaragagtttaagtaatttgcctaagttcrtatagttggaaagtgatagagatggggtttgaactcaggaagtcaggcttgcactgygctcttttgcaaatcatgtcgaattctgaattatgtattgtggttgtttcctttcacttatggagcagctaaatakaaattaatgcttattaaatttactcaatattttatcactgaatccagacctctaaaaacagctttatccaaaatagcacatttggttrtagctataagaaggaagtagcagtgatcattgacactcattatatttttgtcaggaccacagagaaactctcaagtctcagttttactgagactttacaactttaggcttttacaactaatttacattattatcctataaacaaattagayataatagcacgttgtgtttctttttttgactgttagcaaactccatgctaaggttttaatctatatttggtaaatgtagaaaatattttgaattcatcttattattcacaccttatttttccttaatcctgctttcctaactgaaraaaaaaaaacaaaaacatcaatttattgcagcccagcccacatcctattcaaaactagcaggtagtgtttactatgaatgtatccttaaagtaaaacatgaaaaaataaaaataaaaaaatggagaatgttcaataaatatttttaattgattwtcaaacagaagttatatttacatatatcacagtagtaaaatattatcttgataatatgttgaatacarttaatacctagtagtattaatttttttcatttgtatattccttcaataacaatttattaaatgcttactgtgtgctaggtaggtcctatacttttacttgagacagttaaaamgtgacatacttgttgagctcaactgccataataatttagatgcaaaaatattggtatttaagcacactstgatgtttttaaagaacaatcatgacattcatcatgagtgaacattcattccataagtatttwtctattagccaccgcttggctggcagtctgtagagcacagcagttgtagcaatgaacaacccaggtgaagttcctccactcctggagcttaaatatgcgaagtgctgatagttctttgaacgaaaataaatcaagrtaagagatrtagagtgtactattttagayaggacagtttaatatgaatgaatcctcaaagtaaaacatgaggtttcactcatgtttttttgagtgaggttgcattgagcaaaatcacaaaggaagtgagagaatagccatgtagggatgtggagaaagaacaatcctgcctgggtgaagaacatgtgcaaggggcaaaaaagaggcagccttgtggctgggatgccaggagtccagggggcgtctgagctcatgaggtcatagaaggataggggaccctcctgtgaagcagaataatggcttcagcttttactgtgagtattgtatttgatagttttaagaatgcagatccttgatctgacttagatttttaaaaggtggctctggatgcataagagtagaagcagaggccagttaggagtctagctgtgagagatggcagcttgtactaaattgagagatattggattctgtttatacttttgaatatatgaactgatagaattttctgactataggagtgtgtagtatgagaaaaagagaataattaagaatgcctctmaggctaaatgttaatttggtattttgaatattatatatgacaccatgattatgacatatcattatcatagcctacattaattaaacaaaaatatcaagtttagagttctaatcagttttaattattgaaattgtttttattttctgttaatgaaaagcacatacctataatactgggaatggcttaagtgaagacccagatttcttggcatgaagtatgtgtaaattttactctcactatattaagtagctccttatataaatctttgctcaattcaaaccaagcagacacctatgccagttgaatgttctagtggaaagaccaaagattaagtgtatatggaaatacacttggtcaccatgccaagtcacatgaaacagacattttacgagggctyctgcaactttttgggtattttattttatggatctagtcctagacacttctggaatattaatctagcacttttcatttggaaaaaaaataaaatataaaccagactggcttgcagaattgagtgggcttcatttaatggtttatgttagcacyatacattgttaataaaacccaccattttacagtatggttagggaatgtgcatttccaaagggctggccatgtctccccagccaagcctgtcatcactgctctaaattagctggagcagtagctgcagagtgaattgagagtctcattccacacatgcgttgactatgttttctttcagttttccacatctgccaaccctggaaagaaggaaagatattgtgtctcagtcttggatcctgcctacagtagtgatctataactgtcttgaaattaaagtggaaaaataatgaaagcacttgaaataaatgtgaataaagacagagaagcacattgtgttttacaattaggacgttgacttgctctagatggagcgctcattcaattagtagacataccctgttacagtcaatctcaggggatcactagagcggagtttttttaaatggaattccactttggaagaaagcatttatgtacttggaaactattacttaycccatatcccaccctaatctctatcaaataccttcatcaggacacagtgagattaagcttttgttactacaacacaaagtgaagcaaaggatgggcacttcyttatcagcacagacagctaattctactgtgcattttatgctgcttgtgtccttttgggtacctagtactgttgggtaacgagtaagtagtcayctgttaactggctgcttaataaatgagcctacattttttgtatgattttagctyatttttrtaatttaaaatacacagcatttttatgtgaatactgctttggcaaccactgtttctttgaagcttacaaaagaattacttgtcttttttaggtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgaggtaaaaataaatccarctctaagctgaatattgacaaatcaratgaactgggttaacaacrgtaaaaatatcgctttatagcaatacgttataaagcaaagttgaaaactctaaagggtgacctagtttcttcctctgtgagtatagtggtgatgttttctattgttcagtaagagaatgaccagacaatggygacmgtaacgcctgggaaacatttacagggattggttgatttgaacacagacatgctattctcctgggaaggacaaacggcttaactcttagtagtttgtattattttctttgcagaaaagaacattttcttcatttcattctatgggaggttaatttagagagatgcgcaagtcatatattttgccttcctctgttctttgtgaatgttttttaaggtaaaatagagatcatattgcaaaatataaattttaagtgtttaaatcactttaaaaaatatgtaaagatcatggtaagatatttccatcaaattatatttcactaattatgataatcacattcttttagtcctccaatcattggatatgacaacttatgctttaactttcatttagtcactttttaaaagaacaaatgacctgaattctgacaccattaaaggatgcactctcgagacattatttattatttctgtgattgtttttaaacaatttgagtcgtttctttgtcaaggtgtaacaaagtaaagctgtgtaatatattacaaattaatagacagtttcacctggagatttgctatattttttgatgtgtgactatacatacacagatgtgtacacacacatatatatatacaaacatacagacagtatgtattttcataaacagaacaatgttcattcagagcatcagctagactatttcattcctgtacttataaatatatcctacagtgtagttttatttaaaattattattataataaacatttgtgaaagttccatrttatttatttgagatgctatcgtttctgacttttatccactagtgtgtaccaaagcctttaattctacataaaatattttaaactatcatatcatgctagattatgtaaataataaactgattcaggtagtttataatggtaatatactctcagatatcccaatatccaacactgattgcatgcacatkatgataaacaattatytattcattaggcaaataaatattaatataatttctaatcttgaaaagcrttattttaaaaataaaactattcataaayataagttgcatgtgaattatgaataaattataatttatttttgtaacccacaccttattttccaggaacataaatgtgtaagacaaaagcacagtatcagtggaatttctttccttttttaaaaattgatgcttaactttgtaaaactatatcccacattctgaatcctrgagtaacttcagctctttagttggagaagctattaaaacattaagaaaagtaatgttgaaaggattctttaatgaaacccttagtgaatatgacagtgagtagtgaaaaataagtttattaagctacttcgcatcctagagtttcatgaaaccctatgaagttttaaataaaacatttatttactattaagtgtagttagtttttaaaatgttaatgaataaagaacttactctctcagtttatcttttacaatctttgaccagttaaaggggaaacaatttttacttaataaaatatttagaagtctgtagagtaggaatctttgaattggatgaaatttagtatttatctaattcatatactcaaacagccatcagatataagattcaggtcttactttctaaattatattattgtatgtatatatgaaatttcaaaaacaatttggtctctttccacttgaaaatagtgcatgaagaaaataagtaattcaaatatatggatgtttagtccaaatttagaaatttccaccattttgtaaaattagttcattctacctgatgttaatatctcttttcttaaaaacttattcgagtatgtttttccttttatttttggtttatattataatacctatatacttatgaatctttgcaagtaaacacatagaatttaaactgaaaatgacaggagatagaaattgtactgtctatatattatgttagtgttttataaatagttgtgatgatgaagataatatgataataccagtgattcattagtctgaaaactagaaatgtcactttttcaggcatagcataagtcagatttagttgcagatttgtttggtatatgtaatttcatgtatacactgccctacattaatagaatggtactactatggtaaaaatattaaacatggtcatatttgaatttcaatctaatgactttttagaattcaactttatacagctaaatgcaaaactgaagatgattttaaagttggaacaattatagtttacatattatgctcatcatatgctcaccacaagaagagcatatagactcataattcagattttataatttcagcatagcagagtgagtatatgaattgatttggggatgacaaaaatccgattttgaatcccagcatatarcttaatattcaaccttctctatwtaattactctatatcagtttcaaatgggaaatataacagaatcttcctcataaggatttatagaaaaaaaatgagctgatrtatgtacagtctttaagatactagtataaatatatatatatatatatacaaacacatatgtaatataaatgtggttgtatgttgaacttaattatccattaatgtgtagttttacaaacattattattacttcttttycttatgattttacaaccatgacatttcaacttttgatatgggcaactaacagtgacccatctgtcagtcagaagtcctcgtgggtccctctgtctgtctgctaaaagtcctcatgggtccgtctgtctgtgttctaaatgaagtacttcttttctggsctactgcaattttacaaattaccttgtagagattagatacatttgtcccctctagacagaggtaacacctgagtacagaccttaataaatggagtgtggtctgattgaatgaatatttccatgcaggcaaaaaaaaaaaaaaaaaaaaaaaaaaagtcctaccaacacaaatcaacagccttgatttttttttcctgctaaataagattcaaagatgtgaggaaaaytaaattagaaaagttgtattgcttgtatttattgtcaatacaattatttttggagtcttttaaacaggaaaatttccttattaaatagcaagttatagccattgctcaagttttcaaaacatcattatttctgtttyctaattttttaaaataatcaaaacagattattgcaggtctttcatattttttaacaaatagccatctttggggagattatttatttcgtggaagcaatgagtagaatatgacatatgatggctatttgagtagaaaagctttgtgatggacattttgcattttttyaaactcctcaraaaatattttgaattcaattttctgtggagaaatcaatgaataataatttataacaactatgctatttgataactgtacaaggcctgaaaaaagtaagattagcaaacttttttgagatggcgtttgagatggccaatactaaagccatctcaaaagccattaagagcttgattattgctttatggtgtccatatatctttttaatgcatatattatccaatatacacacttaaaagttgaattttagtagacatggttttcctatagaacaatgttataagatggagataacctttccatttatccactttacccagtctagatgcatttagttcttggtccttgtgattttttttctaaatttattgagttacaattgaatcacaataaactgcaaatattaaaagtataccatttgatcagttgtgacttatgtatacagctgtgaaaccatcatcataatcaagaaaataaacattgccatctcacccaagagattccttatcatcttttttaattcattccttcttccatcctaaccccagacartcatgaagtagctttttatcactgtagcttttctgggacttttacaaatggaattatactgggtgcactcattttaacttaactcgttttaactcgttttttttcccttgttattaatagtatgtcgaattaygttgattggtttttcaaatatttaaaaacaacttttcaatctttagaggtctatagactgtactggtgatgtagtatgttgtcttatttatattacatacaattcagttcttacttagtataatgatcttaagaattacccatgtttattgtatttaatattattattattattattattattattattttgctgagtargattttaacacatagctacaccaaaattttttcatccattcaccctattagtgggcatttgtgttacttccaggttatggcatctataaagccactataaacattcatgtctacattttggtttgtttggttgaatacctagatgtggaatgcatgggttatttggtaggttcatgattaacattaaaaaaaaagaaaattatcaaactatttttcaaagtggcattaaccattttatactcccttcagcagtgtatgagagttccagtcattatgtctccttgccaacctctgatatgctcagtctttttcattttaggcattctaactagacgcattgtagtrttacattgtggttttaatttacgcttctcccttgactgatgatgtctgcattttgccaggttcttgtgggccatttatgcatattgttttgtgaggtgtcttttcaaattttttgcccatttaaaaaattgagctgtttgttttagtttaaggagttttaagagtatataaaactttatcctgcataaagattttttgtctgatatatgtttgcaaatattttttccagtatgtgacttgcctttttwttgttttcttattggtgtctttccaagtgtaaatgcttttaattttgataaagtttaatttatcaattttgttgttatgtttgacactctttgtgttctaagaaacttttactccaagatcacaaagattttcttctatttttagtatcagaacgttgttgtttcaggatttgcacatgggtcatgacccattttgagttaatatttgtgtatgatgtaaggtaaaggtcaatgttcactgttttctacataatcatatccagttcattcagcacatttttctgaaacgactttcttttcatgayttatattgccttggtctttaaatcagaaattaattgactaccaaytagtgcacctattactgaactctctaccttattatttattcattttttttactactaccataatatcttgattactgtagttttagaaaacattttaaaatcatgtgggtaaatactcctactttttattctttgtwaaacattgttgtagcaattttgggtcattttcatttctacacacatgttagaataagcttattaacttctacargaagttgtggttttaatggggatttcatttaacctacagatcataatgaagacaattgaaatttttaaaaatcatggagtyttctatttcctgtacataatataactccatttattttggtcttgtttaatttttttttacaatgttttctarttttcagggtaaatgtcttggacatcttttatttaattttttcctaagtatttttttttagtgctagagtaaatgaatttgtttctaatgtcatatttgaatattttcttcctaatatagaaaacacgattttttatattaaccttgtatcctatagccttgttaaattcatttattagttcagggtttttttttagtgtaaaaagttatataatctgaaagtagggaccattttgcaagttttctatctttatgctttttacttatttttcttacggcaatgaatgggatatacatygaatataacttttatatatattgaatatatcttgtgtaagcaggtattcttacttttttttctgacctcatgtggaaaataattcagtctttcagcattaagtatgatgttggctgaaagttttcattggattctgtttatcagtttgaaatttactgtttgtcttagtttcctaaatatttgttatcaagaacatgtactaaattttataaaacgctttttctacacctattgaaatgatcatgcgggttttttttcctgttagtatgttgaattacattgattgatttttcaaatatttagaaataactttgcattccttaaaggtgtatagattccactgtagtcatgcagtatgttatcttattaatgtaacatataattccattttgtaaaatatctttaaaaagttttagtctatattaatgaggaatactagtctatgaatctctgtatttataatgtctttgtcaggttttgatagggttatactggcttcataaactcatctgtgcrgtgatctctccttatctattttctgaaaactttcttatattactgatgttatttccttcttgaatactggatagaattaaccagtgaaaatttcagggccctgagttttctttttagaattgttttaacatattcaatttctttactcratacaggttaattcrgtttttctgtttcttcttgtgttgatcatgttaagttttwtttttcaagaaatttttctagttcaactaagttgttggatttgttcatataaagctgtttgtagcatttcattattttaaattttaatatctttaaaatttctactgaaaactactttttattctttatattaataatttgtattttccccccagatcaataatttgaacaggtacttgaaacttttgttgatattctcaacaaaccagtttcaggctctgttaattgtcactcttaacagactcttttctatttcataattattttttcctatcatagatttgaaaaagaaaaattgtttctctagcctctcaaagtatagggttattacttcgagatttgyttttttcccagtataaaaatttaaaattacacatttctctctaaacacagttttagctgcrtaacacaattttactatgtcatttttgatggttatttagttaaaataattttcaatttctttttttattttatttccagcccactaattatacagtgatgtttaatrtctagatacttgagcttttcttagagagcttattggtattggtgtctaatyctgttgtcttctgagaataaatttggtatgatctcaatccatttagatttattgaggtttgatatatggtctaacatgtagtctatctcagttaatgtaataatgcccttaaaaagaaagtgcattgkgaaattgttcgatgcagacttttataaatgtcacttagatctttccttatatwtcttatttttttgtctacttrttctatcagttgttgaggagtgttaaaattttctaccataattgtgtaattgggtatcttccttttcattttgccattttttgcggcatgtattgcattctcaggcatgtgcacatttatcattgttagatctttctgcttgtcactttttactgtgaaatagctctctatctccactagtattttttgccttgacgtctactttatgtgatattagaatggccactccttttcttgttaacctacaatttgaatgctatatatatttttatgtccatttattttcaaattatgtgtctgcatagttaaagtgtgcctgttagagtcaggttactggggggcctttttttatcccctctataaatttctgccttttaattggtgtcatgaaactaataacataatttacattaaatgttatgctaaatgtcattgatttgttattgatgtggctggatttaagtctgcatcttattatttgtattttctttgtactctctgttttctgattctttgttcttcctttcctgcctccagtctttttttttttttttggtgctgagggtttatttgaatattttgtagtattccattttgttttacttattggatttttgctatttttttatttaagaaatactttttataataattgtaaaatttgtaccaaaatgttatgatatatttcttgcyaatattgtatcattgtatgtatgtaatgcagaaacatttcaatctccttgtcatactgatctttgtggtacagttgtcatacttattagacctgtatatattgaacataccaccaaatgttatttttgctttaaataatcgtatattttaaagcttttaagataaaaatataattttatatctaagtaaatatttgttatttctgtttatcttttatttctgaagctccatatttttctaggatacacttttccatcagtctaaaaagttttctttaacatttcttatacaacagatatgctactgatgtatctcttagttttcttatatgtgagaatgttgttcttttgccttcattacagaaggatattttcactgascatagaattctgggttgacagttttattattttaggactgtaaaaatgttttgtctctggtccctgtgttttctgatgcacaactcacattcacattgttgttatcatgtacttgatgtaccactttagctgctattaagattttttttttctccgtgtttgcttttcagtagattgacttcagtagattgtcataattttgttttaatttattctgtttcgggtttattaagcatcttacatctgtaaatgaatatttttcaacaaatttaggaagccttcactctttaaagtttctactttgctgctaaatattcttatattttcattcttttcaatagtgtatcacttgcttcttggaggagagttataatagctgttttaaaaactcttcctgagagtttcaatgtccaccctatctcagggttggcatctgtttattgcctttgttgctattttttttgtttgtttgtttgtttgtttgcyttctttttttttttttttttttttttttgagacggagtctcgctcttctgtcgcccaggctggagtgtagtggcgcgatctgggctcattgcaagctccgcctcccgggttcatgccattctcctgcctcagcctcctgagtagctgggactacaggcgcctgccaacacgcccggctaattttttgtatttttagtagagacggggtttcaccgtgttagcygggatggtcttggtctcctgacctcgtgatcctcccgcctcggcctcccaaagtgctgggattataggcgtgagccaccgtgcccggccaattgctgttgtwgttaataaacaatctttattttagagtaggtgtaggttcacagcaaagttgagcagaaaggacggggagttcccatatactatttgccccaccccaacatataaccttccctattatcaatatcccatatgagagtaggaatttattacaacagatgaaactacattgactcatcattatcacccaaagtctatagtttacatgttcactcttggtgttgtacattctaagagtgtagacaaatatgtaatgacatgtactcaccatattagtacctaaaagaataattttactgcactaaaaatctttctttctctacctaatcttcctttctctacctattcatccttctctccctgattaacccctggaagttgcgattttttttttttttactgcctctataattttgacttttccaggatgtattagttgcagtcatacagtatgcagccttttcagwttagcccctttcgccaagtaatatkcatttaaggttcttctatgtattctctttttttttttttttcttttttttttgagatggagtctggctctgtctcccaggctgagtgcagtggcgcarcctaggctyactgcaagctccgcctcccrggttcacaccattctcctgcctcagcctcccaaatagctgggactacaggcrcccaccaccacgcctggctaattttttttgtgtttttagtraagacaggttttcacygtgttagccacgatggtcttgatctcctgacctcgtgatccacccgcctcagcccccaaagtgctgggattacaggcatgagccaccgcgcctggccctcttctatgtattttcatgactggtaggctcatttcttcttactgctgaataacattctactagccggatgtggtacatatttatcagtttacctactaaaagacatcttggttgcttctaaattttggaaactatgaataaagctactagataattatgtgcagttttcatgtaggcataaattttcaaatcatttggataaataccaagaagtgtgattgttgtatgaatatgctttgttttatgagaaactgccaaactgtcttgctaaataaacccttttggattcccgccagcaaggaacgagagtttgttttgcttcacagcttttccaggagtttttgtcatcactgttttgaatttgccccaaaacagccctattttcttttggtatgttgtggtttctcattgttgttttaatttgcaattctctaatgacatatgatgttgaacayattttcataggctyactttccatctgtatatcttccttgttgaggtgttcaacatatttgtgcatttttaagtcagattgttagcttttttattgttgaatattgaactttttgtatgttttggataacagtcctttatcaggtatgtcttttgcaaacacatgcacctgctgtgtggtgtattttctgattctcttgwtattgtcttttcagaatagaagttttaaattttaataaagcctagattatcaataaattctttcatggaatatatctttggtgttgtgtctgaagagtcatcaccatacccaaggttatttaggttttctcctatattgtcttctaggagtttcatggttttgtgttttacatttatgaaccattatgacttaatttttctgaacaatttaaggtttgtatttagatatttttttgcatgtggctgtccagttgttccagcactattagttgaaaagattatcattgctccattgtattycatttgctccttttgtcaaagatcagtttagtatatttatatggatctttttctaggatctttattctattccattgatctacttatcagttcttccaccaatactacgttgtattcattattgtaatattatattaagtcttaaagtcagataatgtcagttctctgtctttgttctttacctttaatattgagttaattgactattctggatgtttttcttcttatgaatttggaatatgtttggaaagatccacaaaataacatgctgggaaattaattgtgagtgtattgaatctatagatcaagttgaggagaactgacatcttgacagtattgagtcattctatccatgaacatagaatatttttatttttaaagttgttcgatatccttcatcagagttttgtagttttcttcatatagatcttatatttattttgttacatttatacatatgtatttcttttttgagtgctcatgtaaatagtgttgagtgataaatttcaaattcttcttaagaaaatgattgatgttttatataccttgtatacacaaccttgtaacaatcatttattatttccaatttttttgtcaattattttggattttttacctagacaattatgtaatctgtggaaaagtttaatttttctcttccccatctgaatacattttatttccttttcttgtcttactgcatcaactaggactcccagtatgatgtagaaatgcaatattaacagaggacatccttgccttctttctgatcagtttgagaaaatktccttctgttcctagttttcagaacatgttttaaaatcatgaatgaatgctgtattttgtcaaatgctttcctgcatctatgatatgataatttrtttattttttctttagcttgttgatggtgatactaatttattttcaaatattgaaacagcctggcatacctgggataaattccacttgactatggcatttacttattttatataccttgggattcaatttgataatattttgttaaggatttttgcatttatgttcatgagagatattggtctgtagtattattttcttttaatgttttcacctggttttgatattagggtgatgtgacctcataagatcagttagtaatattcctttcgcttctatattctgaaaaaggttgcagagaattggtatatctttttccttaaatgtttgatagacttcaacagtgaacccatcttgttctgatgctttctctttagaaagtttattaatttttgattcaatcttcttattggaccttttcagattttctaattctttatttatgagtttttacagattggatctaccaaggaattgacttatttcatctaatttatcaaatttgtgggcacagagtttttcataatattcttttatcatccttttaatgtccatgggatctgtggtgatatctcctctttttcctgccaataataatttgtaacttatctcttacttagttggcttagctagaggcttataaattttattaacattctgaaagaatcaggttttggtttggatgctaattctatggtgactttctgctgtctgttttattacttctggtgtaatttaattttcttttgttctgtttatttcagatttattttcctcttttttgtttagattcttaggatagaagcttagacagttgattttagatctttcctcttttctaatatattcattcaatgctatagatttccctcaaagaaaagttatattttgatttttattttgtttataatatttttaaattattcctgagattttgtcttcaatccatgtattagttagaagtatgtttttacatttccaattattttgggatttcccagttatctttctgttacggtttgagagcagttattggattatgtatatttgttcaaatttttaagagttttctttttggccatgaatgtagtatatcttgaggaatgtccatgtgaactttagaaygataagtaatctgctgttattggttataggagtatatatatgaaaattatcttttttgattaatagtgtttttagttcaactttgtccttactaatttctgcctgctgtatattttcatttctgttagaatggtgtttaccatttaaatgtaatagtggattcatctatttttccttcyatatctattagattttgcttcatgtattttgttaggtgcatatgcattaaagatttatgtctttttggtgcactgacctttttacccttatwatcatgtaatgcctcactttatctctaataattttccctgctccaaagtttgcactgtgtgaaattaatttagctactcctgttttctttttattagttktagaatgttatacctttatacccttccttttactttgtatgtgtttttatatttaaagtgtgtctcttgtagacaacatgtaattgagccttggtttttttttgatccactctgacaacctgtctttaatgagtgtatttaaatcattcatatttaaggcaattatatatatagttagaataatattcaccatatatgttattatgttccatttattrccctgggctcaggtgatccttccagtaccaccatgcctggctgattcttttctatttttttgtagagatagggtctcactgtgttgcccaggcttgtctcaaactcctgggttcaataaatccaccagccttggcctcccaaaatgctgggattaaatgcatgtgccgcctcacctggctaggtttttaaatatgaacttacacctattccaagtcaacttttaaataacactatactgatttatgagtaatgcaagcaagtatcttataaaatatttcaaattcctctctcctgccttttctgtcattgcaatcattcattttacttatacataagcatatatgcagtgaaatccattattgctattattattttgaaaaaactyataccttagatcaattaataataataaaaaatattttaccttcacttattcattctctgaatagtttatgtagatttaagcttctcacttatataatttttattatttctgaaaagcttattttaacattgcttgcaaggcaggcctactggcagcaaattcctcaatttttgtttgtctgagaaagtctatatttctccttcacttttgaagaatgatttctcagggtacagaattctagtttggtggtatttttctctcaacactatatatttcactttagtctctctttcttgtatgatttctgataagtcagatgtaattcttatcttcgcttgtataggtaagttggtttttttcccctctgggttcttttaatatttttaaatttatcttagattttctgatatttgaaaatgatattcccagatttttggtctgatatttgaatattatacttctggaattttggtttgatgtctgacattaatttgggcaaattctcagtcactattgcttcaaatgttggttctattcttttctctctttctccttgtattcctattgtgtgtaattacatattttgttgttgtcccaaagcttttagatatcctgtttagttttgtatttcccagctttttttctctttgcttttagttttggaagttttgattatcacctcctcaaactcagattctttccttagcagtgtctaatttactaatgagcccatcaaatgtatgcttcatttcaattatggtgttttttatctacagcatttatttttgattctttgttacagttatcatctttctgcttacattagccattctgttcctgcctgttgtctacttttttattraagttcttagcacgggaatcatagtttgaaaaattcctagaatgataattccaacctttctgccatatctgactctggtttgatgcttattcagtctctttaaactgtagtttcttttcctygcagtatgccttttaattttgtgttgaaaggtgaacatgatgcactgggtaaaagaaactatgttttgtttttttttaataagcccttagctatgtgttggtaaggtgaaacgggaaggactcattctatgattaggtctcagattttggtgagcctgagccctggactgtgaattttatcagtgcttcmcagtccctcaccccatgaccttaggtggaacaggatggctgaaggtggctggggttattttccttcttccacatggaagaccagagggagctgtagtagggaatttcctttctttcacactgaaggataatgctgcactgcagttaggcacaacatacattgttatatcatgcttttctttatgctttgtggatattgctcttgttacaaattgaaagtttgtggcaaccttgaatcaagcaagtctgttggcatcatttttttccagcagcatgtgctcacatcatgactgtgtcacatttcaataattctcacaatattttaaactttttattattattataagtatggtttatgagaccccaaarcaattacaactgtaacattaaagatccctgatcacagatcaccatagcagttataaaaatgaaaagatttgaaatgtcatgagaattaccaaaataagttacagagacatgaaatgagcatataccatcttatatataataataatgtacacaataagatggtaaacttaagtgataaatgttttgtgtgttctgactgctcaactggctcaactgaccagctattctcaaattctctcctccttgaggctctctattgcctgagacacagcaatattgaaattaggtcatttagtaaccccmcaatgacctatgtgtgttcaagggaaaggaagagtcacaggttcaagtgttcaagagtcacttgagatcaaaagctagaaatgattaagcttagtgaggaaggaatgttgaaagctgagataagccaaaggccaggccttttgtgccctgtgaatccaagagttatgaatgcaaaggaaaawatttttaaagaaattaaaagtactactctagtgaacatatgaatggtaaggaagcaaaacagtcttattgctgatatggagaaagtttgagtagtctaatagaagatcaaaccagccacaacattctcttmtgccgcagcttaatccagaacaaggccttaactctcttcaattctgtgaaagctcagagaagtgaggaagcttcagaagaaaagatcaaatctagcagaagycagttcatgatgtttaagaaaataagttgtcttcacaatataaagtgcaaagtgaaacagcaagtgctgatatagaagctgtagacaattatccagargatctagctaaggtaaattgttgaaagctgctacactaaacaacagatttccaatgtaaacaaaacagccttctgttggaagaagataccatctaagatgttcctagagaacagaaatcaatgcctggctttaaagcttcaaaggacagcttcaaactctcttgttaggggataatgcagctggctactttaagttgaagccagtgctcacttaccattttaaaaatcctgggacccttaagaattatactaaatcaatcctgctgtactctataaatggaaccacaaagtctgaatggcagcacattcatttgcatcatggtttactgaatattttaagcctacagttgtgacctactgctgagaaaaaaaatgattcttttcaaaatattactgctcattgacaataaacctggtcacccaagatctctgatgtagatgtgtaaggagattaatgttgttttcatgcttgctaacacaacatcaatagcccatggatcaatagtaatttcaactttcaagccttcctatttaagaaatacttttcataatgctatggctgccatacatagtgattcctatgatgaatctggacacagtaaattagaaactttctagaaaagattcaccattccagatgtcaataagaacatttgtgattcataggaggagaagtttgtttcaaaatgagtttgaagcattcaagatgtcagtagggaagtcaatgccgatgcggcagaaatagcaagagaactagaattggaartggagctcaaggatgtaactgaactgctgtaacctcatgataaracttgaacagatgagttgcttcttatggataaggaaataaagtgtttttttctgagatggaatctacttctggtgaagaggttgtgaatattgttaaatgacatcaaaggatttagaatattatataaagttagttgataaagcagcaacagagtttgaaaatactccagttttggaagaagttctattgtgggtaaaatgctatcaaaaagcatcacatgctacagagaaatcttttatgaaaggaagagtcaattgatgtggcaaacttcatcattgccttattttaagaaattgatacagcaacctcaaacctcagcaaccaccaccctaagcagttatagacacagaggtgagaycctccaccagcaaaaataytacagtttgctgaaggttcaaataatcgttagtattttttagcagtaaagtatttttatattaagatacatacatttattttacactgaatgtttttgtacatttaatagacaacagaatagtgtaaacataacttttatatgtactgagaaactgaaaaaaatcttggcaatattttctttattgtggtggtctggaactgaacatgcgatatcttcaagttatgcttgtatttccctttctcaagttaggttaaactatgatgaaatcccagcaggttactctgagggcatgctttttttaagaagaacagaatgttctggtgttttcaacatgattccttttctcctcccacttccagaagcatgagaggaagtctttatgatattcacttacaggccttatagagctcttccaagtaaaactcacaaaagtgcaggattcccccatgactgagtctccttggtgtttttaactcttggaagttttaactgtcagaatattggtattttctctctcacataacataaattcagaagctattaggagacctcatataggtagttttaatttcagttcaattccttaagtttttcctcaattggtttgggtctgttacacatgcttaattctggagatagcctgaggtttttatggttcatacaaaaattaggcaattcccctcttcatttttctcatctcagattcccgtacactttctaacctgcatttttcccctagttcctatgtccaaaaacacagggtttctttcaaagttttaggcagacaacagttgttctgctcagctactggattccacccttgggacaaaaccttgataaaatatgaaacaaaaacaaaaacaaaacaaaataaaacacaagtaagttatacctgtaggctaattyctccaamttttgactctcttctataatctgcataatttacagaattgtcagctagttgtttattgcattttgttcagagtttatagttttcaacagcaagagagttgggctgtagcgggctyacacagtcataggagtattggctttcccaagatacraacgtttgaaaagtrttcatttcttatgaaaaatgtataccagaggtgtccaatcgtttggctttcctgggccacattggaagagaagaattgtcttggggcacacataaaatacactaagactaatgaaagctagtattttaagaaagtttatgaatttgttttgggccacattcaaagcctcctgggcctcatgtggatgtggttcatgggttggacaagcttaatgtataccattaaagagataagcatggtacttgctcttgcctcatcttccaaatccctaaaattggtacaattctattatctcacagttaagtctgaatcctccttgctctgtcttctctgtggaacttctttaattaagaaagaaaacaaaataagctatcactatttwaaaaaattaacattatatgttttctatctggattttaaaatataaaggtgtgttcactaattrtttctctaaatactatctttgtaaatgtgtagaaggtcttccataaaatatgaacttaagcagaatgttggatgtgagtaggcacagatgataacataatatttattgtttaattgagaaataaaagatgaaggtaarggtatcatacagtatctaacaagtacaggtatggttgaatgaraaagattataataatgatgaaatgatgataatttaagtatttgcattttaaaatcacacacatggtagttaacaatgttgactctggagtcagacagccctggcttgaattttggttttggaaattaaccagctctgagattacagacaagatatccagtctccctgtttccttcctcatctgtaaaatggaataacagtgctatgcatcctatagagccgtttggaaattaaattaatgtttgtaaaatactttaatctgtgtgttgcagtattgagtgttttatgagtgtttgctttttttctttttaattttttttgagacagagtttcacttttgttgcccaggcyggagtgcaatggcatgatcttggctcactgcaacctctgcctcccatgttcaagtgattctcctgcctcatagtccagagtatctgggattacaggcatgcaccaccatgcctggctaattttgtaattttagtagagacaaggttttaccaygttggcgaggctggtctcgaactcccgacctcaggcaatccatccacctcggcctcccaaagtgctgagattacagacatgagccaccgtgcctgacctgttggctttttttttcttttttttagaaacaacaacaacaacaacaaaacacccttttttcatttattattgctgaatttaagtgaaaaacacagatatggttaacataggagccacatttggctttgtaaaagactcaggtttatagtttattattttaaagaagccttcaatacctgaaggcaaaagcaaaatgccatttgaacgtggtactttatcatttactcttgttagagtagcatagagtcagcaaaagagaaaagcaaggaagctttgagtttacttatgggtgttaagtttaattcttgtctgtagatctttggttcgcatgtgcatttcgcaatgtagctgtggctttttaattattgaaaatattgtctggaatctgtttcatgattcattttttgtataatgtattaaaacaacaaaattactttctaaaatcagaaattaatgtacaattttaacagaaataaactgtggacaacaaacattaggtaaaaatgtggtagacttgatattcaaaaacaatccaaktccaaattcagtgtgacacacaaattcaatgcacattagtgtgaaaatytcaggggataccacacacccaggtaaattagagttttgtaacaaaaataatataaagcctcactgcattcacaaacatgttgaatttctttaatatagaacaatatatgcagttgttctttctaaaaggaggttttatagttttcgtgaagaaatagtcaaatgtatttacatgatagtatcttttagcagtatttaaaatgtaagatgtttttatggcaataagttgagcatttgttagattttattagactattattaacaaattgagattccacataaaaatttttctcttttgatttttgtttttaggagatatttaagttccactactgaccacttgtataagagtagacagagccacaactttgatgtaattcttttttgagagttatccttagccaagactcaaaagcgcatctgtttttggctgttttatgtataattacattctttattgctgcacactgaatttgtctgtcaagtgtagtgaaaaacaacaaacaaaaatgtgccacattatttatgaccaagcttcagtgattctgtagggctgaatttgaaatggattttctcagttctcctttctagatgctactgtactttactatacaacagcctcaaggtatcctgttgccagtcagaccatctggaatcagatcagcaccattgtattgtgatatgcaaataaagtcccatattttgggactttaytgaccttttgttataattttatatttagtaggatttgtggctaaaactgtttcaagaagctcaatgacgcatttaaggcaaatttagatttctgagctctatagagatccaaagtaccacagtttatataggatgctacttgtcctctaaaaggggcattgccctgtttaatttggatttctattttgctgattagtgcgtcattggattagctactgccggcaatgcacaatagtgtttcatacattttatgtttcctcttttacaaatattgtctctgtattgatgaccttagttttatttcccccttttaaggtctattattagcctgcagtactttattaactttttaaagaagaaatcatcttacatttgcattcttgtttgtctgtaattaccaggttgttttagaattacctattaatgtacagcttccttattggactacgtatttcttgagtgctagatttttatattccattactttaccattccaggagcaacatcaatcccaaagtttgtcacggtgtttatagttaataaagattagtaaatgcatgaatgaatgctttacccagaaatggctaaggctttgttagaagtatcagggagaataaagggttgggaaagctgtaagatagcatatgttattcaaaagctaggtgttcacttaagttgattattctctgttgaaataaaataaayattatgtgtcaattgttgtgcttaagtaagggatatagaaacatagttgtaataaaagacttgtgttacataataaagacataaaaatattcaaggggggaataataactaaacctagagtagtaaaaataaaaggacatttaaaggtgagaacacatgtaaaagatgaagatttgtaataagcccagcagttctgagaaatgtaatgtggtttgggggcatttgggaggagacctgggttagtgtgtaaaagcccatttgtcttttataccatactaaggtggttgaactttaaactataggctatgagaacattccttaagtagaggaattaaacattaaggttttttttagaattctttttgtgacagtgaaggagctagtttagaattggaagaatctgacttaaaaaaaaraaaacatgaattgttgaatattggttcaaataaaaggtacttagagtagagayaaggccatagcagaataaatggagaaaagggtcttattttcaatatggaatagaactggtaggtcttggggactgttaggatatgagaggtaatgggagggaggaacttaatatttttggcctttagcacataggtaacaaataggtgatatttactttttacatatacaarctgtttaaatttgagctgaatgtagaggactttaactatctttcatattacttatgarctatgtgttttaaaccatgctttaaactagtaaaaggctgtggractatcctgagccaaagaatcatttcaccatcttttctatacttcttgagttttatagtaaacacacagttaatgtgagattgttattagctaaaagaagtgtaataagaatattgatatagggaggagccaagatggccraatgggaacagctccagtctacagctcccagcgtgagcgatgcagaagacaggtgatttctgcatttccaactgaggtaccgggttcatctcactggggtgtgccagacagtgggtgcaggacagtgggtgcagtgcaccatgcatragccgaagcaaggcgaggcatcaccttacccgggaagcacaaggggtcagggaattccctttcctagtcaaagaaaggggtgacagatggcacctggaaaatcaggtcactcccaccctaatactgtgctttcccaatgggcttaaaaaatggcacaccaggagattatatcccgcacatggctcagagggtcctacgtgcccacggagtctcactgattgctagcacagcagtctgagatcaaactgcaaggtggcagcgaggctgggggaggggcacccgccattgccaagacttgattaggtaaacaaagcggccaggaagctcaaactgggtggagaccaccacagctcaaggaggcctgcctgcctctgtaggctccacctctgggggcagggcacagacaaacaaaaagacagcagtaacctctgcagacttaaatgtccctgtctgacagctttgaagagagtaatggttcacccagcacgcagcttgagatctgagaatgggcagactgcctcctcaagtgggtccctgacccccgagtagcctaactgggaggcatcccccagtaggggcagactgacacctcacagggccaggtactcctctgagacaaaacttccagaggaacaatcaggccgcagcatttgtggttcaccaatatccactgttctgcagccwctgctgctgatacccaggcaaacagtgtctggagtggacctctagcaaactccaacagacctgcagctgacggacctgtctgttagaaggaaaactaacaaacaggaaggacatccacaccaaaaacccatctgtacgtcaccatcatcaaagaccaaaggtagataaaaccacaaagatggggaaaaaacagagcagaaaaactggaaactctaaaaatcagaggacctctcctcctccaaaggaacacagctcctcaccagcaatggaaaaaagctggatggagaatgactttgacgagttgagagaagaaggcttcagacgatcaaactactccgagccacaggaggaagttygaaccaatggcaaagaagtwaaaaactttgaaaaaaaattagacgaatggataactagaataaccaatgcagagaagtccttaaagsacctgatggaactgaaaaccaaggcacragaactacgtgatgaatgcagaatcctcagtagccgatgcgatcaactggaagaaagggtatcagtgatggaagatgaaatgaatgaaatgaagtgagaagagaagtttagagaaaaaagaataaaaagaaatgaacaaagcctccaagaaatatgggactatgtgaaaagaccaaatctacctctgaytggtgtacctgaaagtgacggggagaatggaaccaagttggaaaacactctgcaggatattatccaggagaacttccccaatctagcaaggcagggccaacattcaaatttaggaaatacagagaaccycacaaagatagtccttgagaagagcaacwccaagaaacataattgtcagattcaccaaagttgaaatgaaggaaaaaatgttaagggcagccagagagaaaggtcgggttacccacaaagggaagmccatcagattaacagctgatctctcrgcagaaactctacaagccagaagagagtgggggccaatattcaacattcttaaagaaaagaattttcagcccagratttcatttccagcgaatcaaagcttcataagtgaaggagaaataaaatactttacagacaagcaaatgctgagagattttgtcaccaccaggcctrccctacaagagctcctgaaggaagcactaaacatgtaaaggaaaaatcggtatcagccactgcaaaaacatgccaaattgtaaagaccatcaaggctaggaagaaactgcatcaactaatgagcaaaatagccagctgacatcataatggcaggatcaaattaacacataacgatattaactttgaatgtaaatgggctaaatgctccaattaaaagacacagactggcaaattggataaagagtcaagacccatcagtgtgctgtattcaggraacccatctcacctgcagagatacacataggctcaaaataaaaggatggaggaagatctaccaagcaaatcgaaaacagaaaaaggcaggggttgcaatgctagtctctgataaaacagactttaaaccaacaaagatcaaaagagacaaagaaggccattacataatggtaaagggatcaattcaacaagaagagctaactatcctaagtatatatkcacccaatacaggagcacccagattcataaaggaagtccttagtgacctacaaagakacttagactcccacacaataataatgggagactttaacaccccactgtcaacattagacagatcaacgagacagaaggttaacaaggatacccaggaattgaactcagctctgcaccaagtggacctaatagacatctgcagaactctccaccccaaatcaacagcatatacattcttctcagcaccacaccacacctattccaaaattgaccacatatttggaagtaaagcactcctcagcaaatgtaaaagaacagaaattatamcaaactgtctctcagaccacagtgcaatcaaactagaacccaggattaagaaactcactcaaaaccgctcaactacatggaaactgaacaacctgctcctgagtcactactgggtacataacgaaatgaaggcagaaataaagatattcttagaaaccaacaagaaaaaagacacaacataccagaatctctaggacayattcamagcagtgtgtagagggaaatttatagcactaaaagcccacaagagaaagcaggaaagatccaaaattgacaccctaacatcacaattaaaagaactagagaagcaagagcaaacacattcaaaagctagcataaagcaagaaataactaagattagagcagaactgaaggaaatagagacacacaaaacccttcaaaaaatcagtgagtccaggagctggttttctgaaaagatcaacaaaatagatagactgctagcaagactaataaagaagaaaagagagaagaatagacgcaataaaaaatgataaaggggatatcaccaccgatcccacagaaatacaaactaccatcagaaaatactataaacacctctatgcaaataaactagaaaatctagaagaaatggataaattcctcgacacatacatcctcccaagamtaaaccaggaagaagttgaatctctgaatagaccaataacaggctctgaaattaaggcaataatcaatagcttaacaaccaaaaaaagtccaggaccagatggattcacagccaaattctaccagaggtacaaggaggagctggtaccattccttctgaaactattccaatcaatagaaaaagagggaatcctccctaactcattttatgaggccagcatcatcctgataccaaagcctggcagagacacaatcaaaaatgagaattttagaccaatatccttgatgaacattgatgcaaaaatcctcaataaaatactggcaaactgaatccagcagcacataaaaaagcttatccaccatgatcaagtgggcttcatccctgggatgcaaggcttgttcaacagacgcaaatcaataaaggtaatccagcatataaacagaatcaaagacaaaaactacatgattatctcaatagatgctgaaaaggcctttgacaaaattcaacaacccttcatgctaaaaactctcaataaattaggtattgatgggtcatatctcaaaataataagagctatctatgacaaaccacagccaatatcatactgaatgggcaaaaactggaagcattctctttgaaaactggmacaagacagggatgccctctctcaccactcctattcaacatagcgttggaagttctgcctagggcaatcaggcaggagaaggaaataaagggtattcaattaggaaaagaggaagtcaaattgtccctgtttgcagatgacatgattrtatatccagaaaaccccatcgtctcagcccaaaatctccttaagctgataagcaacctcagcaaagtctcaggatacaaaatcaatgtgcaaaaatcacaaacattcttatacaccaataacagacagagagccaaatcatgagtgaattcccactcacaatttttacaaagagaataaaatacctaggaatccaacttacaagggatgtgaaggacctcttcaaggataactacaaaccactgctcaatgaaataaaagaggatacaaacaaatggaagaacattccatgctcatgggtaggaaaaatcaatatcgtgaaattggccatactgcccaaggtaatttacagattcaatgccgtccccattgggctaccaatgactttctacacagaattrgaagaaaactactttaaagttcatatggaaccaaaaaagagcccgcatcaccaagtcaatcccaagccaaaataacaaagctggaggcatcmcactacctgacttcaaactatactacaaggctacagtaaccaaaacaacatggtacttgtaccaaaayagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaacctattcatctgacaaagggctaatatccagaatctacaatgaactcaaacaaatttacaagaaaaaaactaacaaccccatcaaaaagtgggcaaaggatatgaacagacacttctcaaaacaagacatttatgcagccaaaaaacacatgaaaaaatgttcataatcactggccatcagagaaatgcaaatcaaaaccacaatgagataccatctcacaccagttagaatggcaatcattaaaaagtcagggaacaacaggtgctggagaggatgtggmgaaataggaacacttttacactgttggtgggactgtaaactagttcaaccattgtggaagtcagtgtggcagttcctcagggatctagaactagaaataccatttgacccagtcatcccattastgggtgtatacctaaaggattataaatcatgctgctataaagacacatgcacacgtatgtttattgcagcactattcaaaatagcaaagacttggaaccaacccaaatgtccaacaaygatagactggattaagaaaaatgtggcacatatacaccatggaatactatgcagccataaaaaaatgatgagttcatgtcctttgtagggacatggatgaagctggaaaccatcgttctcagcaaactgtcacaaggacaaaaaaccaaacactgcattttctcactcaggtgggaattgaataataagaacacatggacacaggaaggggaacgtcacacaccggggactgttgtggggtgggggkaggggggagggatagcattaggagatatacctaatgctaaatgaggagttagtgggtgcagcacaccaatatggcacacgtctacatacgtaacaaacctgcacgttgtgcacatgtaccctaaaacttaaagtataataataataaaattaaaaaaagaatattgatatattatttaaattattgtttaagtaagttttttaagaccttgatgtttttaaagcataaactactctatttctgtttatgatttgactgtatatagttcttagaagagtggcaggtatatagtgagtgccaactaagtattgtctattattataactatcagtattacttgttccttggataattgcaagagcctttaattgatctttctgcttttgccatttcatctgttctctaagcagcataactagaaaagcaagtctatttctttcaagtagcacctggccaaaagaacaaatgaatgaatgaagtgtgccacctctttgctcataatcttccagtrgcatttcatttcatttgtaaagttattccaatagtctgcaggaccttatgtgacccatrccacaccctctgcctctcctgttagagtttatcagtgtctcctctccatgttgctacctgtggattgttggttcacaaggtgtccctcacttgaatatattaattaatctcttgccttggggctgcttgtgccatggggcctggacattcattagtccttctgcctggaaagctctctcttagatatagcattttttatttcctcagttcctcaagtgtctctgtctcagtgtctcttaatcagtgaaactttccatgattgcactttataatagagtatcctactttctgacatatattcgctatcctttcttactttatgttctttacagcatttattactttctggcatactacattattcttattttgtttctccctctggaatataaactcctagaatgcaggagctttgtgctgtgtccacaaaatctaaaatagtacctgacatgtaatactagtattttttagtgaatgaataaatatattttctagcacttattaattcaaagggtataggtcatctatagcagacaaggaagtgggaagcaagatctgttacctttttataaccttttaattaattaaatttatttgatgcaatagagccatattggtagttatgctttagtaagaatccttgtttaacattgataacmtagaaagtataagataaacgtacagttttttcatagtgttttatccaacttttggcattttctgtagtacttggtaagcagatgttgaattagaagtacattcaagtaatataagacactgctaattttctcaaagctggtttcttaagttagttttgggattctgcgcaatacaagggctgtgtgggaagtagttatgtctgtgattatatggtttccctcattttttcctttgaattatggttcaaatgcaatctctgatgcrtttttcaattacactaaaattctaagcattttggcaactttcctttaccacagaaaacagttgagaaaaaaaaatcattaactgtatggggygtttgaaaaaaaaaaaaactggtgagagttaatgccttggcaaattcagaattctaagtagacaggaagcataggttttcattaatcttctgattatggtagttacttcttaagaattttatgccacatttaagatttaatttcagccttgtatatgcaatcaaaaactctgccaagagccaccagacttttcctgaaagctctaatatcaaatgtgagcagaagttttagggtctaggggctatcttatgaaaatattatagaatgttgttaggctatttattttacactggcacatacaaggctacttacctaaatgtatttttattttctttctattacatttttcctcatgtgtttgatttatagaataatgactttaagactcctgaaactggaacttatttttagaaaaaktataactagaagtctgccacttaaaggtttgttttcctttaattgactccaaacactggaataaaatatcttatatttgtatatactttacagtttataaacagcttaaatctatattagttgtgtttagaatttctgaggaaatacaagtaatagtattcttcatttacaggtgttgaaataaagtctttcaatggtgaataaattattggccaggagatccatttattgatcatttattgagtactcactatgagaaggcctagtccaggaattgtgaaaatctctgacaacaaaactgaaaagtccctgctctcatgaagtttatattccagtgaatttaattgaacaaaatagattgactggttaagtaaggagcccaggctgtaaactatgccttttattgtcttgtagagatgctataccttcctgacatgtgacacacatactggttattcaaatccttaaacttactgtttggtcatccagatatacatataaaatayatatttcatatatatgatgtatttcatatatacattatatatatatttcatatatatgatgtatttcatatatacattatatatatttcatatatatgatgtatttcaggtattcattatatatatttcatatatatgatgtatttcaggtattcattatatatatttcatatatatgatgtatttcatgtattcattatatatrtttcatatatatgatgtatttaatatatatcatatatatttcatatatatgatgtatttaatatatatcatatatatttcacatawatgatctatttcatatatatgatgtatttcatatatatatatatttatatacatgataccaatttctawattaggtcttcaagtagatggtgtttccccaacttctcatattcttttgggttcactctgagttcccacagaaaacagaactctcttcaggtagtttcagaagtttgagcagggaggctgggaaatctagtaattagcaytaccttcctgaggactaaaggggcaaggggcataaatactgrtacagtgctcagtgaggagctgtagttctgtagaagtactttctagcagtgtcaatagtgataagggtcccagactactgtgacaagctaggaaagtatgggggtaaacaatgccaacctttttcccttcccaacttccaaactcctggtggtagcttccatgtctgtcccggaaaccaacctgcgggagagtctggtgatgcagactttaggggtcagattcttgcaggcacagagtaagagacagaaatgttagtaataggaattggggtgccaacagwgaataacaartattcctttatttaaaagaaaaactgaccactttcacataaattatgccaggaaattctagmtaaatcctctaattttctcaggtgaaagttatttcaaatttcttatatcttcataattggaatatagcaggtagtaaagaaatatgtgtctcatatcttatttatttgtgtataataatctgaataaccagtctataagtatttgagaggaggtttattttcctcctattcatagtgtcrgcatgatactttgcctccataaatatttattgaattaattgatagatgaatgattggtaaacagtcaaagacaaatattctcaaagtaacctggctgttaaaatccttgtacaagttagaattaaaagttataggagaaatataattactatcttatttataatatatcttagcctattaacttgttataatacayacaaaagaaaacattttgttttgggaacaaaatatagcttttcctaaaataacgaacctatattgttatacaacaatgttgtataacagattgtttttgccttcaaccaaaatacagtttttccaaaatatacccatatcagtagggaattctcgctttcaattttgagcaagccttccatcgtttactgttcaacagatattgcatgttcaaggcacaaactgactatattttgtagaggaaacaggttttcacatttgacaccaaaacataatttttgtttcagaatttraaaaaataaaggtatgctgattatattatatatatgcatactttaaaagtcctctccraattacatactttataaagtagccgatttagatttaaagagacttcaattctctaaagaatgaatgtatcattcattgttatagaggattgcaacagagcaaaaataagggactatttttaaaagacctgttatttctgggatagtaccactttatataaaattaaaataataaatatatagaaatrcaattaccaattatttatttttattctctgacaggtattttctctgagggacttagaacaggcaccaaaaaaaaaggatgatgctaaaaattgatatgtaaaaagctgatacccaaatatctggtattgtgttggaggaataaacgtgtcagttcaactgttaactctttatgaaatagtgaaaatagtctataatttctttcatattccaaaaataacaattactttaaaaataaatctaaaatttactgccaagttaaatactatgaaataaaatgtaaatgtcaaattctaatgctaactytgtgaaacaggcagtgaaagtactacctaatgcaaaggccatatttgaccttcacaatgatattaattatatgaacttgtcttttgagtctaagtgttaaaataaaagttaatcattatgtgtcaattcaaaataaaaatataaaaattaaaaagcacattaaaaataaatactgattaagaatttatcattrataattagcattcaaattgagatgtgctctaaatgtaaaatatacataatctttcaaaaacatggtaggaataataattaatagcttttatgttaaatacaaattgaaattatatgttttgaatatattatgtaaaatgtatgataaaagttaaagaaaaataaaaatattacatacttgtttccttacatatgaataatttttctcaaattgattttttaaaaagaggtctcaaaatgattttcattttgttttaaaatcctctttagtattttaaatgttaatttcaatcatattattttggacaacaaatstttttaaaatgtatcagatgaatttattttgggagggggatcaaactgtggtaacattttaaatgttaatyatttaaagaaacattgatatgaagaatccttttgtaatctgagaatcatctctaagtattttttagaattgtaatttaaatttttacataagagtttccttaaatcaacaaggaactaaacatgtttagtcttgattcatgttaacataaactgataaaatgaaacaaagaatacaaaaaagtatataatctgagattatcagaacatatactttaatatatattttgagattaatatgagaatatgtactttttgaactatatatttgaactctgtctatatataatatatataattggaatatatataaatgtatacacacatagttcaaatattaggggtatgtttttctagcattttttgttttctattgtcgacatgaagtaggattacaatataactttattaagatggaattaatgatacaaacaaaattattttaatcttttactagcrcaataaaatgtattttaaaaataagactattttatggatatttcttaaaaatttgtcctctttaaattctttatttgtagttggaatgatgcttttttacatttcttattttctattttcttcagtggactgaggggtgtctatgatgatgatactgtcaggtgtataacttctgattaccctgtattctagctacttgccaaattaaatcagccaatatttctacagcatctacttaataccggaccctggatatagtcagttattacttttgttataaataaacaaatatccattttgtattttttttcaattgaaatgacctttgctctgttacaaagacagaacttcagacgaataaaaaaaaaaccctagtattaactgatttatattagttttttagggctgccataataaattgccacagcctcagtggcttaaataacagaaacttattttttcaaagttctggaggctaccagtccaagatccaggtgttgacagagtcgttttcttctgtccgagcgttcttgccttggcttggaaatggttgtcttctccctgtgtctttacatggtctttcctctgtgtgtgtttgtgtcttactcctttcttaaaggagaccagtcagattsaatcaggaccatactagtggcttcgtttaaccttaattaccttcttaaagaccctgtctccaaatacagtcacaatgtgaggtattgggaattaggatttcaacatacaaattcgaggggacacaatttaacccttagcactcagtctgggcaagctcatcctgttcttgataaacaatgaaaaaaataggtataagattgctacagaaagaagtacggactgtcatatcaaagggaaattttctgccaattattattgattcttgaaacttggtttggtttcaatgatgcagtctgatagtctgcaggtataggagagatacagttcaaaaataaataaaagtyactgtcttaagtgataaactgaccttactccagaaatgactgttagttattattctacttcttagacttaagagattgaccctccaattttttccttttattgtagttctatttgagtaaatggctttgccatcctaccattgcttacttgagaaactgcagaattgctctacrttcctctgttaacactttgctccatatttccttatcattctygtctcactccatcatcagcatccagtcagtttccaaatctcacagatatattttttactaatatatgtactgtctgttccatctaytccattcctagtatggctgacttggcttcaattctcaacacttttattgaaatcaactcctaattgatttatctgactccaaactggctgcttccaaattatcctcccttttgctgtcaaagtgatttttttaaaatacaacattgatcaatctatttcatttatcagagtcctcaaatgacactcaaatgacatcttttgagtttcagttcacatgcaaggcttttcttaaattggttcctaacttaaaaataaatatctactctttaccctcactctttatcatcaccatgtaagtccttccctctaatgtgctgcactatatatacttctctctctctctctcgctctctctctttttggagaaagagtctcgctttgtcgagcaggctgagtgcagtggcagtggcgcgatcttggctcactgtaacctccacctcccgggttcaagcgattttcctgactcagcctcccaagtagctaggactacaagcatgcgccaccatgcccagctaactttcgtatttttttggtggagaatgggtttcaccatgttggtcaggctggctttgaagtcctgacctcaggtgatccacccacctcagcctcccgaagtgctagtattactggtgtgagccactacacctgacctacgtctctgaattcgtcatacagtttcatccctcaaaagttttgtttaagatgctttttatgtttaatgctattttacctccatccccttcattaggcyaactcctatttgcttttaacaaatcatcaagatttttccaagaaccgtttcatraaaatgttcattctcattgagatacctgtatgttgcaagttaatggagacaagaatgaactataagaaatttggaatctagatgattttatggaacaaaattatagctgtgtgatttactctagcatttagggagatgaaatatctaatcttagatatttctgtagttcaataaggtatatagtcaatcgttacagtgttattttccagatcttacaaaaaattgctctcttagaataaaaaactttaaatgttaatattwaaagtttagatcttgtgagattcagagtagaattgaaagccttgtggaattgtgcagtcaccagttgttagattaaaatttaagagagaagatcatttttcaattataattgagcactgattcaacatctgcattaactgttttagttatatctaaatttcttctgccttttttgtgatcctaktaagktccaaacacataatccatctacaagtcacattattcaatcagatggaattgaacaagacagtatcacaggctggtttttcattgctcattctctagaggcagctgctttgctgtgcaattcagtggatgctcaggctgagaactaacataaaccaatcactggttggcttcacataagacaaggagttcaatctgaaattcagatccttagcactaacacattgacatgtgaccttaagacattagaccaatattatttaccatacttttccaataaatgtgattctttacacacacacacacacacacacacacamacacacaatctaaatgtatctttacttgtgtatttcatagaccattatgtaattacattyatagcacagaaaattgaaacagctatgccttatatagactttatatatatatatataaaattatatatatgcaaaccaaagtaaaaaaatgaacaaaaaaagttagcatatgtgcattatttgtttggttttaaaagtatgctattacttatataatttgattttgataaaaaaaatagtgagatccttttgcaatgcatgtgacattcacaagaacatcatctgtgtagacagtttctatttagttttcttacattttatttgctttcactctatacccatactgtctataggcaaacactatagtataaacccagttgacacagctggagatcacaaagtaattgcatcaactgtaccttaatcttggttttgtggaccattaaaggaggaggatgccttgtatgctaaagatgccagttttactcaataactttaccttttttagctgtgaaaatktttatggcactattgaatctaaatatttatagttcattcaatctgtaacaatgagcttgtttacagagtgtcttaaaacatgtcatacgattaacataaaacactgtaaaatgccttctgggaaaaaataggactgtaagttttttattgaatttttycagtttctttctagtatattttatgactattaaacacctgaaataagaatttatattggaaaagttggcaggattccatttagtcaagttaggactgtaaatagaatagtaactacttaaaccagcattatttaaaaatatatattatttaaaagtactataaacatacatgatgcatatatagatatatatttatattatatataatatatatttatatacataagtatcatatatatatatatwtatatatatacgatagcaacttttttgtttttcagcaatagattcacttgattcattataatttgtatataattaagtatggcattctagaatttctatccctggaaaggaacttagctattatctctcagtgcattcattttacaaatgataaattaagtgatgcacaattccaagtagttaatggcaaagctaggagaaaatttaggaagcagagtttgtaatcaaaaccctcagtgattccattactcagtcatattgtcatgtactcaatagtgcctccttatttgttttaaatattaataattttgtattcaaatttctctttgctttttttcatttataacaattcaggtatggttactcagtgttctgaattgttcagttggratttgagaaatactatcagtatattttaagaacttgtatttatttgctatgtgtctatttaaaattagtaggtattaggcaatattagagatgctcctacttaaaaataatttacaaaaaaactcagaaactaattttattatcagttatttatattatytcatgacatgtaaaaataaatattttcaagtttagaagtactaataatacttatgatgattttaaatatggttgtctagatgaatattttctacttctgctttatgttatgcttcatcataaattaaagaagatgtttccttatttgggtgttactaggacatactagcatattacatgtatttttaaagcactatttgagagagtgaatgaattaaaaacgattaaataaaatgagtaaaaaacttgcataaatatagcacaatctgagatatcagtggagatatttctgaagtccacaaaatttatcrtgaagatgaataaacataatatttcatttatgtcagcacaatttttattagtggatgtgtgtttttgagtcatttttgtgatgtaatgttgctcatttttgtggtgataatgagacattctagatgaagattaacaggtagttggcaataagaawttaaatgtcaaaatatggatcaaaaggggatcagcttaaaacactaaaaagaagatttaaaatgagatgcccawaaggagacttgaaaggctcaaacattaatctgatcatctaggatacctgtgtgactgtccaggaaagacctgaggagaaggccctgctatttcaaatatggttgactttgaggatctacctagcaaaaagtgagagctaagacagtgttgtaaactgtaggagtgttgaaagtgtttgccaaggcacwcagaaagtctcttgggatactaattggttccattcaattccaagatttaaggaaatmtcactctaatcatttactgatcattaacctaaccagagacctcattggccacaggcagcaaagactacttacttagagaattacttcaaggaaatcactaaatgaacaagcaccaacaactacaaagaaaaataacagtaggcctggcggaaggggaggatagtatctgatttcagggttgttatttaatatgttcaactttcaacaaaaatactttcaacatcatgagacaacaaaaaaaaatgaaaattaagtgccatacaaagtaaaaagcaaagcaaaacagttaagaggatctgtccttgaagaagcacagacattggacttccccaacaaagacattaaatgaacaattatggttatgttaaaaaaaacgtaaaaaacatgactaaataactaacagcaagtatracaatgttgtcttaccaaatagaaagtagcaataaagatatatactactaaaaatactaaattgtagtactgtagttgaaaagtataacatacaatgaaaaattgactagagaagttcaacaaagaatttgagctgacaaaataaagaatcagtgtacttgaagacaaatcagttgatattatctacaatgagaataagggggaaaaatacattaaaaaaagttgacagcctcagtgcgggacaccamcgaacattccaaaataggcataataggagtcccagaaaaagtaagggcagaaaacatatttaacaaagtaatgactgaacacttctcaaagttgatgaaacaccttaatctacayggtcaagactctcaacaacttaatcygataaacttgtaaaatctacatccagatacatcataatcaaacatcaaaaaacaaagactrtgagagaatcttcaaaacttcaagagtgaagtgactgataacatataaaggattctcatttagattaatagctgattccctaccatatactgtggagggcatgaagtagtagggtaacatattcatagttctggrgggtagggggaaagacttcatctaaaaattttatagccagcaaaactgactctcaaaygcaaaggaaacagccaggtgcagtggcatgcacttatagacccagctaattaggaggctgaagtyggaagatagctggagtccaggatttcaataccagctttgggcaacataataagacaccactcttaaaacaaagaaaaattaagacattcccatatttaaaagaatgttcactaataaagttccctttcaagaaatataaagtctctcagattgaaatggaagattactggacactaactcaaataaagaacactggtacagttatctgggaaaggtaaatataaaagattgttcttgtttataatatttctctttttagattaaaaacaaaattgcataaaacaataattataaaactgtgttgataggctcatagtatgtaaagatgtaatttatacaacaataatagctacaaggtgggaggagggattagagctacataagatmacatttttgtgtaggattgacatgaagttagtattaatttgaaaaaggttgtaataaagtaataataattctaagagtaaccactaacgaaacctataaggctatagtaaaaacataagataagtcaaattttaaaatagtaaatatctattcaactcaaaaaaggcagtaatggaagaataacgtaatattaatacaaaggcagaaaaygtagaaaacaaatagcaaaataataaataaaaacaactcaaatttccagaaactgatagataaactgcggcatgtccataaaagggaatgttacttgaaaagaggaatgaagtactaacacatggtacaacgtgsatcaatcttgaagacattatgataaatgaaagaagccaattgaaaaaggccacatgttgtatggttgaatttaggtgaaatgcccaatttttacaaggggccrggaaaagggaaggatagagagtgactgccactggttgcagggtaacttttaggtgtcatgaaatttttctgcaattagtagtgatggttggacaaggctgtggctgtactaagcccactgtattgtaaattttaaaagaatggattttatatgtgaattaattaaatccattataattgattttatatgtgaayrgtgtgaacagctcaataactgttatttttaaagaagagaaatgtaagcatagaaatataaatttttgaaccttaaaaataaatcctaattctaagggtgagaatgaacacagttttagacagaagaaagaatgatacaaataaaaataagtgccaaccacaccacaggtagtaaccacagtatttactaagaaattgcctgctaggattaaatatcttaattcttattaaataacttatactcaattctaattaactaattaacttattcctttcttggcacttcttacactatttgattatatcttttcaagttattaattttattccaccttatgctagagtttaaatattcttaaccactaatttgcactctcyaaagtgcaaagattatatcaartatgtgtttctacacccacaggttcaatattttgtgtataatactttctcaataaktatctgttaataaaaaaatgaatattgtggtataaatgtagaatgaattatttccacattctttaatttttaaagatttttgtaatttaatttccatatttttatcaagttctaaataatccctgttgataagatgcaaagaaagctagcatgacttttaagttattaaatatggagtcgggagttttatgaatcagatttatgtgctcaaacttacagggaattgaatgctcaagttaaatggctatcagcccagatattactctaggcctgagtrtaattctgaattaatatggtcatgacacacagatttatattaaattagtttcatgatgaaataaagtccagatggaagtagycacattacrtcaagagcagaatatttggatttttctcttgtttgcmgtttccaaaagctcttgaaattaaaactctttaggtaattctattattaaatattaytaatgttttgattttattgaaatcatacaaatttattgataggtgatgtttaatgtatccttaggaacwcttttttttttcttaatataaatgcatcaaactcatgytttttttatttttaatctggatttttctggtgtcttcatttctcattcatctttgtaggtagggatttcttttgatactaatttttctaacagaacataatagttggatctatatatttactctaaaaatttcatataaatttcctaacaataattccttttaagcttattgagctttttacttatttrgtattactattacattactgtctttatatatgcacagtttttaaaatgtgttgacttttaaaattagccttttgctcacattttatttgttctttaccatgcagtataaattaccagtggagtaaaattgagttttgaaaaatgaatgaatgtagtatagatttcctgagccagaagataacatagaataacagcctaatatttacagccgatttgtaaaataggtgtttctctttcaatcctataagactcttcttaacattgaaatataagtaggtcatttttcttcttcaaatatttaaaaataaaccacatctcgctttggtatatgtgtactttaatatgctaactgaatctgtgtctgtttgtttttgtttttttttttttcccagggggacatycagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatmgcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataatggtgcttcacttgtatactgtgtatatgcacatattccattttggagggggtgagaagaagataatatgtaatagcgatatttcgaccattagcatttaaataattaacagcctcaagatagaataacatattttctggtgtacatgccatctccctaggcctttggcaatgcatacaaatgagaaagtgacattagaactatcttaaagttttcaggctgtgttgaacaattagagggtttttaaaaaaaawtttctcataggaaaatktaaaagcatgtgaaatggaaggaatttaagcctcagttgggagcaaaactatatttttggattttttttttttggattttgaatttttaagacttagagttttaaaaaggaagtagaaatttgaaaatatcaaaactgttctaaaaatgaatcaggtagtatttttcttcccttttaaatgtactattaggtgccaccatttgagttttactgtttacaatgggtcaaaatcttttatcttaattgttagttctgcatgtgaattcaggtcggatttttcactttcaatgctagaagtatgtttttgacactactttactttttaaggtttaataatgaattctgttgcactgatattttccatgacttaatgttagtttttgtttaaaaaacagggtaaaattttaagaacctaacaggaaggcaaatrtgagagtgtaaagataaattactgggatattttatttacctgtttcacagttatcatgtacttcattctttttattctctcatgattcaccaaatatgttttctgtgaattctgaagtgatagataaaataattatcaggtttagtgtttttatatctaagaggttatgtgctgacttaatattaaaatttatagcatttaytgtatattttcaaggttgatgagatctgttttgctcctttataaagaaagataaggcatattattctttttagcaacagatatggctctgatttttggaagaagggaggtttgcattcttaatatatcactttgaggtgttttgttcccatgttgtaatgctattatgtcaggtaagctgttattttatcaaggtaatttgtatccatcttcttaagttcatttaaaaatgaacttgccatttactattttagttgttgacatgtatatttaacattctgttgagatgtcaaacttggttttactagaagcatttgatgagaaaaacagcacattgttacagtagaaactgcatgacaatcttgttgggtaatgcaataatatatagcatttttacctttttttagattgagtaagtcataatgaaaaagttttttctttaagaaagaattagctttcccttttttctctaactctaaattatgttgatccttcaataataagataagcatctataccagcatcaaaaactacttaattgaattagtaagtagtgcttatattaattttaaactatatctattaatatgtcattatatgataacgcatatamataattcatcttcagaagttctacctatataaattaataatgcaatgttggttgccaatgaataaagaacataaagtgcaatatggagcatcagccatayatgtactttatattacttacttgttcactaataaacttctggcattgcatgtttattattctaatttggattaataaatatgtcaatttattttataagtcaaccgatatgcttttttcagcttataattttgtctacttagtatcctctaagtagcatatcctaatctattcttaagattcacattgttatatgcttgacataactttacaaccatcaccatggagaaagagatctataatgtagacagattttaatttaatcataatatcatcacattttaattttatttgaacctacacagtgccatttaaataggtgacaagctaatattaaaattatgatggagttgggattttcttatcaagtgaaattatcttcctatcttataaaaaattagrtgttaaatctatrtgattccttttgatattctttcttaaaaaaggatgaaaacagaaaatgaagtgacartcttttataaaggaatttacaaaacaattagcttttcaaaatatattatcttttcacttaatatgtatcatacattcattagatgcacaggtttttactgatgtcaccagttttcttacaaattatgtaagaayagacattatgacatttctggaagatcctttctcctaacctactctaatttctgttagaataccgacaaagttgaaattattccattactgcctgtctttttgcatatatttgtctgattgattataactagttcttttttctctacttgtctcaagccatccttagaattccataatgaggggagagaattatctccaaaaatatgttatgaggctttacgtagcaatgtatatatattgcgaayatactaagcaatgtcttgagtatattcatgaccaccacacggaggaagctgtgcagataaaggagaaccaggagtgaataagctctaaaagaaagatgtgccggckgggcgcagtgactcacgcctgtaatcccaacaatttgggaggccgaagcgggcggatcacctgaggtcaggagttcaagagcagcctggccaacttggtgaaaccctctctctactaaaaatgtttaaaaaattagccgggcatggtgtcaggcgcctgtaatcctagctactcaggaggctgargcaagagaatcgcttgaacccgggaggtggaggttgcagtgagccgagatcatgccacttgcactccagcctgggcgacagagcgcgactccatctcaaaaacaaaacaaaacaaaacaaaaaacaaacaaacaaaaaacagaaagatgtgctgtagtgtctagggcagttaacatgttatttcctccattatttcaaaaccagcctggttagtcaacatttggagagtttaaataaaggacagaattatgaaagttagaagataatttgtcctataagagaaaaaatgatataaaattgactactttggtacaggtctgtatatatccttgaatagcagatttcaattaaaatacgtttaagttgtccaggtttaaaattggccctttatgcatttacttattgtttttgtaattcataactcctcttaagctactagagcttattattagaaggcactgtgatcacaattttctaaaacatttgtggtcaacagttcttttgctggaagattaaaagggaatggttaaaatgcaaagagagatccagttgagacataattggaatcgtatcaaatacactacttaaggaattatgtgtagattgcccctggaaaatatatattaagtatacatattatatgtattatcatatatgtttgccctaggcaattatatataaattgscccggcatgcatgcatatatatatatatatatatatatatatatatatatatatatwttagagttttaacttgttgagtttactgctttttatgctacatatgacttagtrtatttagttatttttattaaaaactgaatttaacttatgtttaataatatctatatcttgattgaaaattaaaatttttataaagatattgagctttggatttgagcacactattttgctcattatttaatatgtacaattgtcttttaactccctctattaagaaacatatctctccttaattaaaatcttttaatacagaagaaattagtataaaatactatttccagtgtgaatttattataagtattttaagaaagctaagtgttatgccttttttaatagagaaaaaggcagtgattttaaatattaaaattatgtattaattataagcacatctaattttgaatcttttaatgtctcacaaggattttgtgctctttttgatcttaggaaagtctaaaggaaattaggaatttcttaatacattttagattttattttcccattggttacagtatttyaatacagtatatacttatttcatattctttgtattccctttccctcctcccctctttcccgtctctcaatagatatgaaaatcctttcatacttaggaagactactctctacatttttatttttagatatgtagcttaatttaaaattcccattgaaattactgtagcgctcttatagagaaacattgcatagcaatttttacaaatcaaaattaatgaatatttgacatctatgtccaagtacataattactgtgtttcaattaacattccataattaagagtttgaattattattccaaattttttgttttctcgtgatactaactactattctgctcataggaaatgtgctttgtcactcctatgttattatactctgtataagacagtataatacttctatgtaatamaaaaataactcatcaataacattaatttcttatctcttaacatttacactatgtaaaagttaagatggttctcactttgtgaatagtattttgccactaacacaattgcctgatattttttcctttgcaatgtagtatgcaccagaggatataatcgaatatgactatgagtatggggaagcagagtataaagaggctgaaagtgtaacagagggacccactgtaactgaggagacaatagcacagacggaggtaaaaacaaagcagtgcctgtgtatgtggtgtcctgctgttcgtcatcctgtggttccttatgttgactgttcctcaaacttaccataaacctttcattcatcttatttctctgaaccaataactgtgatttttatttgacagtagccgttttgaagaatgatgtccatttcacttttgcttagccttcctttcatctrtgmtctatatttccctcctcgtttatttatgttttccattccatctttcaccacattttacagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactaggggtaaaggtagcgaagaaaaagcaatcaagatctatcctagataagctggaagatctctgatcatgaatcatagtcttaacccaactagataaatactcacttggctaatactataacccaattaaatcatgatttccatacatttgggatcaccttacatgtttactaattctcttctgaatttaccattaggcaaacrtcgttgatgattttcaagaatacaactatggaacaatggaaagttaccagacagaagctcctaggcatgtttctgggacaaatgaggtaatacgtatagacagtattaaatcacagtcccactttttaaatatgtaatttattttgatatacttyactctggaagaatctataatttctcaaacatctgatgtttttattcttttactaaagtaagagaaacaatagcaatggttcactattactaaaagcagttcatctgaaatcaatgccaattcaggttttgcgtgactctttgcttcatgcagatgctaaattgatcaaactgaattggccgctattattttcttaattgctcctggaattgagcaagcttttcaacatgttgtgaytaagggtattcacaacatgtttcttctgtgagaagaatcctctaaagtgaaaattgtatcatcgaaggatacaattagaattttactccctctgatgaataatcatgcattttatgacagcaagcattttgagaaaatgtagtcttagtggacttaaataactatttacattttcaaacttgttaggaatgtaatattaattcttattaaactaatatatcttaatctttccattattttctatgaaaatatttaagtacatgtaggtaaaaattaatcttcctgaaattcatatttcacatgcattctgatcatgaagaatacaattcagtttaactttgttaaatatctggtatacattttggtataattttatcaggaaatgaatataagaaatgtaatttagttttargaaaatttatgtaaaatgtctctcaattaggcaaatagatttatgtgaaaacacaaaattgtgaataataaatgtttagggtgagaatggattttaactttcttttagatgaaattaataattttcaaaaaaaatgagtattttgattcaagatgtccatttacctaaccaaattcatccagcattttagttcagagctatgattatagcaatattctcaccatagatattatgcagtctctgtagacagcatatactccttatctaagaatmcaaaaaaaattacggttattggacatttaattttagtgaaaaattactcatcatttatctacatattttcattcacaagattgtgtaatactattatctaatattaytctatcatctagatttactatggaatagaaaatgagttacttaaaaatgaaatttacaaattggcaagataagcctaggcaatacaataagatcctgtctttacaaataaatcaatcaatgaataarctgggcatgctggtgcatgcctgtagtcccagctacacaggaggctgaggcaggaygatcatgtaagcccaggagtcccrggctgcagtgaggtatgattgtaccactcractccagcctgggtgacagattgagaccccatctcaaaaaataaaaagtagcaagataagttatttaatttgagcctcatcatgatcataataaaaccaaatattcacatgataagtcggattcaggtttattctactagtaaggaattatgagaaaaaaaggtatcagtttttrtctatgtctctgaggaagtattattgacataattcttacttktaagtattaattaatatttattccttactcttcttgagaattgtacagtgatattttatatttcattgtcytaaatgttgctagctatcatttattttatttgctttaaagaactctttggtgtaatactacttccctacatatgagatactctrcataatcattgtaatgatacatctctatttatactgatattggcatattattattttatttatgggatgagactcaaacttatatggcttatccttttagcaaatgtatttcataatgatgttctgtaagatttaaaaattaggcaaagctgccrgggtgtggwggctcgcacmtgtaatcccaacactttgggagaccaaggcgggtggatcacctcaggtcgggagttckagaccagmctgatcaacatggagaaaacccgtctctaccaaatatacaaaattacccaggcatggtggtgcatgcctgtaatcctagctactcgggaggctgaggcaggagaatcacttgaacccaggaggtggaggttgctgtgaaccaagattgcgcccttgcacaacaagagtgaaactccatccatctcaaaaaaaaaaaagaaagaaaaaaacattaagcaaagctttaactccataccttttttattgttcaaatcttaaactgtgaagtaaatatgaaattgactaacatgttttttccaatggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctttactaacaataaacttcatgttcctcaattccttgcaatttaaattaatagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcgtaagttgatactatgcactgtgtcattgtatgtcttatttatgggatatttttatgtccatgtccatcttaatgtcttttcaggtttaaaatgcaggttgaatttttatgtaaattatgaatgyctattaccactaggacaccttgttagattctttcacatgggaatcttcagcagttgtatctttggccatacttttggagtcattatttgaaagtaaaatcttgaatagaattgcatcagaaattttgtcattgataagattaaaccatagttgtttttattccaagtagcaagtctgattttttatttctgatttttagactattttttaaatttaatttgatgacatttcttaatgcctgggaataataactgacatctatagatgtcattataaaacatgtttataagaggcaatcgttcaatctcattttaagattcagtattaatgcttcttatgcctctcttttaatttttgccatatttaagccttcaataggtcttcatatttaaaaatatattttaataggttgttttaaatgtgtttagtttactaaattatctttttaaaaacaaatggccggccgggtgctttggttcacgcctgtaatcctagcactttgggaggcagaggcgggcggattacctgagctcaggcattctaaaccagcttgggcaacacggcgaaaaccgatctctactaaaaatacaaaaaaaaaaaaaaattagctaggtgtggtggcgggcgcctgtagtctcagctactcgggaggctgaggcaggagaatggcgtgaacccggcaggcgagcttgcagtgagcggagatcgagccactgcactctaacctgggcaacagagggagactccgtcttcaaaaaagaaagaaagaaaaaaaaaagaagaaaagaaagaaagaaagaaatggtcttacagacatttaggctgttttgaatatttcattcaacagataaatggccatggtgcatatggagagaaaggacagaaaggagaaccagcagtggttgagcctgtaagtagtagtgtgaatrcactttaaaggttggtaaaattgcttatgagccacgattatgttaaattattatgtatgttcgtgttttaccaatgataatcttgatgtccagatgtttgcaattcaccacaaataagtaagttaataaggtcttgtctagaaaggagaatttcaataaaacaaaacattatagagctgcagaaattcagaatttgaaagtagctgaaatttgtcttgtctaattctctcattttaaaactaaagaaccagagatctaaaggacttaagtaattttcctgaggtatcaaatgtttgatcaatgagatataataggacttttagctttcctactttccaatccaatgatatttttctctaatctctatgacttcacattatttgaaatatataacatatatttgttacatatccaaattgtgtcatatgatattttttacttccttttcatctacagaagaatctctaattcactccaaattaatcttttaaaatttatatcaatattattactaataatattgctaagaaacagattcttacttggaagcggttttgccattgtttcctgctaataaacaattcagaaaaactaatgtattagaactgaaggtagaacaacacgaaaatcatttcagaaattgtaaggacataaaaatttcaaaaaaaaacagagaaagaaaaatgataaagaataaaaagatagttgtagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactatttcaaccattgtggaagtcagtgtggcaattcctcagggatctaaaactagaaataccatttgacccasccatcccattactgagtatatacccaaaggactataaatcatgctgctataaagatacatgcacatgtatgtttattgcggcattattcacaatagcaaagacttggaaccaacccaaatgtccawcaakgrtagactggattaagaaaatgtggcacatatacaccatggaatactatgcagccataaaaaatgatgagttcatgtcctttgtagggacatggatgaaattggaaaccatcattctcggtaaactatcacaagaacaaaaaaccaaacactgcgtattctcactcataggtgggaattgaacaatgagatcacatggacacaggaaggggaacatcacactctggggactgttgtggggtggggggagggggragggatagcattgggagatatacctaatgctagatgacgagttagtggatgcagcacaccaacatggcacatgtatacatatgtaactaacctgcacattgtgcacatgtaccctaaaacttaaagtataataataaaaaaaaggaataaaaagagacaattttaaggacyttgttggccatctactcattactccaaaatcatgcaacatgctcacaaaaagtgttgaaaatatttttttcagaatgaatcagtccttattataaaaagttttaaccccctttttaaatgacattatagcttttcagcagtccaaagatggagtggaatcataaatgttttagaactgagttcttattctgaatagctctttattcctttgcttataaagagcttatatcatatttattcattttccttttgcctggatttttctgtaatttccctgaattaaagtgcttattttccattctttcatttacacagcaaatatttactaagtttctgttttatgccaggtattattctgtgggctacaaacaaacgaaaaacaaaaaataaaaaaccttggtagattgttttgtctgtactcttcctgggagcacttagcatattctcctttgtaatattattcatctaaatattcatttccactccacttaattcacacattctctgagggcacagtctatatcttctataattttgaatttctttccttccctgtgcaaaaacatttgtaattaatttaagtggtatgaatagataattcactatttaatatgcaatgatatagtgttctcttatattcatgtaattaagaggttgggggttatatttccctggtagagatgttctcttttcctgttatagggtatgcttgtcgaaggaccaccaggaccagcaggacctgcagtatgtaaatgttttaagattatttttgtctatttaaagtaatcatatataagatttctattaattactgaatgagaacattttagactaattagaatattgaattatagagaaaaacatttgttcagaggagctggtgcctttgaactgccttctgatttgtctatccaagtaatactctttaaattttgttttaaatatttttgtggcttagatacctctgcatcttctaaactcattttcgtctttctactgaaatatatgaaagtaaagaaaagtcatccttattttcattgcagaggtataattgtatcttaacaaatggaatctcaacttctaggtagactgcagctgccttatctatacctctgtgtggagtaattatcagattccattgtggtatcctgataaggctgatgttactcagtgtgtttattctcaggtgattgcactgataagaycttgtaataaatcctctgtcttttgtggaattaattaaactcttgtcgtctaaaataatatatgatactgatgcatttaaatatgtttacccataaaaggaaacataattgcctctaacctaaatgatttctacatgttcaacttggctatcaaatttttgagatctaattttatgagtgttccatttcttcagttagaactgggaccaaatatgaccttagagactttacattggcatattcttctttcctgtttttccttgaaatgtttgcctycaccctgagagcagctgaactagctacaaattggtttctatatgttgtcttttcacaggaagataaatagggcaactgtttagaactctagtgtatatttataaaatataaacgaactcttcrataggactagagtgaattcatctaaatattaatgagattaggaatctgattaagatatggtgtgtttctctatagggtattatgggtcctccaggtctacaaggccccactggaccccctggtgaccctggcgatagggtaagtgaatggacatgwtatctcattacaaatgcatgtcatacagrcttaaataattaaaatgtattctacaagtataacatgttatcttactgcgtgtgggaggggtaaaggcagcatgaattcagtgctgcacaacattttagttaacattttaaatattattttgaagtgaggaaaacaatgtgcatttatctatggcataattagtaagaaaacttttatttcacccaacatccatattgatatgaactcattacattagggattctggtcttcaaatttgaattccagtcatattttccagatatttccatttatatttatttggatgctgacagaataagttaataaatctaaattctactttgaggatcaaaccctgggttacatgctgaaatatctcatttgtgttaagtctctccaaactcttctcataaaataaccttcccttttttccccacatccttgagtagccaataactttgtactttctttcttttgttctttagaggatcagagatgcaaataacttatacttttcatataattacaatttaaataatgtaaaaactttttaatttaaatttaatgaaggaagatttttaactatttcagaaattctggactgagtaacagctatttaaggtcagaggacataagaagtgtattatgcaaacattatgaaactttttatttaaaataaagttcataaagttagttcttacatgctctgcttacttaatttgatatgtccagttycttggagacatttatgtgtaatagtcattttagttaatatttttaaatcccaccatattttcataagacctttttatattctgtaatttactcaccttaaactctatatcaggtgagaaattcatctctttacactgtgccttataaatagagacatataaatgatctaaaaatgtaggaaatattttagtaataggaaattataccattcaagctagatttgttaggattttaaaaaattatttctttatagaagccattatttgaacttactttaacagttccttgaaacttgtacagaatctattgaaataatattctaaataaaatataattttgccaatctagaatcaatgttaacactttcctaggagttaactttttatgagaaattcacatttgaaaagtgctgctgcatttttttatatattggttgggcgctttgagttatagcattttgtatctagttatttattaatttttgaatttacttgcttccctgacaagtatgacatggctatgtagaaatgtctccttatattgaaagcttatggacatataccttatatstatgagtcacatacttatcaacagatgtatatattacatatttaatattttctatattcatatccatatcttggatttctggacagcatagtcacacctaaacttctaaatgtacatgtatgtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctgttaaagaatactaaaatataccttaaacctagtaatttttaaataaaactttcattatttacttaaatctgtttttatctaactgtaagaaccaggcttgtactacttgtttttctcacattactttcccttaaaatatatgtgaactcttcatcttacacagttttaggctgtgaacaaagtttgagcaaaatttatagcttaattggattatatattaataaccgaacattattaaaatcatctaaaactagtgcaacagaatagaattctgtctaggtatacttactaaaaacagactaaataaggtggaaagggcaaatgcaaattagataaagtagacttacgttataagttattctagttctagtaaatattattttgatatttatttattttggktatttcatttatttttctagggccccccaggacgtcctggcttaccaggggctgatggtctacctggtcctcctggtactatgttgatgttaccggtatgttcttttttatgttatagagatgacttgatatcttgtcatcttttttctgaagtttattgttgaaccatattgaagagcaatcaactaaaaaccattgtacaaggtagaaatacttgaaattaagcagcatttggaaattcagggaaattttacaaaacaaaattatggtatcaatctctgcattaaaactaagaattcattatttgattacactcttagcaacagagtttttgacaatatttccaattgtggtttatcctgagtcacartattaacatgtttttcatatgttatttaacataacattaatatactatttaccatctattatctatatagtcataaatagtatttatttgtagtgttattattcattgctcaaraattatttgctttactgtaagattcctttgtaaagtttttgttgccctggtgttttgggaaaaaaatgcatattttatttatcaatttmaatgtaatgaacaaagtttcaagaaataattacttagaatgaaaaattgactcctactgcattttgagttaaaatggagcaaattttatagaggaatattacagaagatctgttttataacataagtacttaagaatgggtgaacaaaataaataaatcacaaggaaaatttcctgtgtattaatggatattccaaaaattttgacaaacaaaatagagattgagctgtaactgtcactgaacttggtatatttggaattttatacaaatgaatcaataaaatgggtaacatttgtgcttaaaaaaaagtcacaatggtttattccagaggtatagaaattatagcatttaaaattgaracagagtttctagtttcttcttctacaaatggtaacctgtagtgtaaagaacttccagaagaaatggaaagagcaaaaacaatacaaactagatctcatgattcattacggagttactttgtaattttgtaaaatcccaccattttaataagtggtttttatctaatgatcaaagcacgtaattcaacatgtttgacaaagctaattttgaatttcttaatgttatctcttccaagttccgttatggtggtgatggttccaaaggaccaaccatctctgctcaggaagctcaggctcaagctattcttcagcaggctcgggtaagacaggataaacttgcattcccacaagatgactgactctgtatcaagtatatatgtgtgtacatacggaagatgctaccattattaatagaatatttacttccgaatactgtgttaaacttacttggaaaactgctaaaattttatttgtttttctagtagtaatgtttattaattgaaaattatagttaggtagttgaccaatgcaatgttgccattatataattctagcagtttcccaccataacacgcaagatttctatttttttttcccaagagtattgatatatttacacctagtgcaccttatctttcacatccagttttactctgctaacttataagtcaatgattggttataattaagagaataaaatttgaaatacatttgttcttaattttctggattatttaacatatcatggataacacagaaaattaaattttttgggcatcatatataaaaaagaaaccttcaaatttcttaccaaccctaatctttataatctgtagtatttttaaaatttcaatttatgttttttagtttaaagcttccactacttgtagacttataaaatatagaattacatttatgttttttaattagtttcattgaaattagwatatacacaagaaaatcaaaaggatagaccaggaaggaaatggaattcatataacatttttattcatagtattggttttctttttaaggaagaaggaaataaaggatttttgtttggtatggatatggttacccactttctaaccaatataaatcacttctgtgataaaatttttatgcatcatgatgaatttatgcagcwtgtgtaaaaatatctgaaaacatgagtaaaaattgtaattcatcctcaatatttgtttatgtctttcctaagtctattaatctgaaaatatatcattatttgattgtatcatgtttaaagataatgaaaaattaaaatatttgtttattagattttggcataatgcaaatctaaaattatttaaaataatttactaaagatttctataacttattttataaaatatattcttttgaacgattttaaggtaattatttgaacttaaatattttatgaggtcattgaattcctcaytttattagtcctcttaacctacttgaaaaataggtagcaagcattataattcaatttttcagatatttaatctcaaggattaagaagtatattgtcaaaaatctcatggtgagtcagtagtgattttggagatcctactgttttcatctcgtgcacttttctaatatgattttgcatttatttctgttgtattatttttgatatctttgtgataaatctaagtgttcatctgttgagctctctaatattcaaaagtagcacacaatactaatttaacatctatcaaatttttatcttttgtactgtatgtgtttcagcttttcaagtatgctaatttcacatttctaatattcagtgtaacaatagtgcatgtaatcagtttattatgcrtatgattatacaaaataaaacattcttctctatagcattatatctgagatttgttaaaaggcacatattatcataacacttcctgaccagttttgttttatggtgtctggctttggttatcataatttttcctaaaatattgctaaaagaattttatttaaagcctctcaaattgtgcctacacatttaagagaaaaaggctatgcattattcttgagtaaattcagaatagtaaattatcagatattagttgttctaaaatctagtttaacttttatttttgattaagtcatagcaatatatattacaagattttatatgttaaaaagtttttaaaatgtctgatatttacctcttttgtcattctagaaatttgcagttcttcagtaacctgacactctttctagcatgtagttattaaatctgtgttgatcatgtattacttaagggcagcttgtgcagattcatattgtactttaatgtgctcttccaggagaatattactgaatttgatatattttgttttctagattgctctgagaggcccacctggcccaatgggtctaactggaagaccaggtcctgtggtaggttaccccaacaaagataatatatgttaaaattttcaaattagcagtwccctgtgcaacttcttccagggattgtgcatatctatggttggtgacaatagggtatgttttcatgcttgctgttgtttccattaaaaaaatccttcycaattcagttttctgtacattttgatcaaaaggtctcagtaaaaaattttaaattgaataaataaaattaaaaatgtaattgagtcatatccaactattaatttcttaaactataagtatcattcatttgcctaatattcagcttccaaaattatgttttacattaaatccttgagccttaattttatattaaacaaaatgtttgttaaaaaagaaaaatttatttgaggccaatgaaaattatgacacaatcttagggcaagcaagatactttttaaaccgcaggttgcctcagtattccacaaggtgcttcaactattagagagagtattttctcttgtagaaattctwggaaataacaaagtattatttttttctcactagcgtgatagcaagctaagatatttcaaatatttttgtmtaaaaaatcttcaaatacactagaatatactaatgttaagtggtgtagcagttcacaggattcaaaccaggattctcattaattttagaatagatggataaataatttatattttaaatatttgttttttgtataaattttttctgctatttacagaacgtattattctgamagttaaaatcttatctgtattgtacatagtagacacttgcagcaaaactattgtattcmaatttaaatcaagtactttgccttctaattatttagtctgttttactgattatattaggataatagtttttcttcatgtattttatcgaagattttattatgtagatttccttatatttatatttaccataatttagtcataaaattttatatatattttgcaggaatatacattcaatcatataagctcacggggaacacatattctgatactatgtttcatagaatttaaattatataatttaacacattattaaatgtttatcatgtattttatcatgctttgcytttccaaaatacagtaatatggcagattctrtatcacttaaccaatgaaatagagttaatttttaattatttgttaatgactcaaatttacataacaggaaagtaagtagtatgttagtgtattatgaaatttggggtcagaagaattaacctaggtattttattaaaaataaaactttctgggactctgaacttaagactstaatgttgtagattcaggattggaaccagcgactgtaattttaatacgtgcaccaggttgattcctatggccaaagatatttgagaaacagtgccatatttgatttaatttacaaatatcaggctgggcgcggtggctcgcacctgtaatcccagcactttgggaggccaaggcgggcggatcacctaaggttgggagttcgagaccagcctgaccaacatggagaaaccccgtttcwactaaaaatagaaaattcgccgggtgtggtggcacatgcctgtaatcccagctactcgggaggctgaggcaggagaatggcttgaacccgggatgtggaggttgctgtgagctgagattgtgccactgcactccagccttggygacagagctagactccgtctcaaaaaaaaaaaaaaatttacaaatatcagtcctaggatatctaaaactctattattcaaataaatttcatttattatcttgaaaaacacaaggaartggattcatagaggctaacggcagcaatgagcagaaacaagggaggcacattatattagcagttcttattttcattaaacaaccattaagagccagccaattttccagagactgttggcaaagagaaaatattgacacccataaacacattctcaaagtcayaggcaaaattaattaattttatctacttatcactttgatatgaaagttttagcttccttaattattgaaggtaggtattgagagaaaaaaatcatattgtttctttttaccatttcaaaacatgcaaatttgatgtttgcatcaaaacattaaattattagtcttycaaatatctcttaattctatagtctaaaaaagtattcactagattaagatttagaaaagaaagtctacatcgatattttgacatctgtacatttttcctatgaaaattattttaaccaattgtttacatctagttatctttatagacaaatggaggactgtatcataaaacattcaggaagtgtagaaaatctgttttttccctattattttatagtcaatgactgtgtgacattttttagaataaatgttggagcaaaagaattataatctgttgagtaggtagtgcttatatacagagaatgtaatacagtcgattaattaaaaatagtccattctataattgcataattgcattcaattcagtgattaataatctgatttaatgtagaaccccagtttttttcttgmagaagtttatttgcaataattcttcattggaagcttgaaagtcattattctcttaattttaaagattagaaaattcatgttacttgactttttgtattttgtgggcatcgttaatatttcttttactttggagtcaccaggagactataaattgctaccatttttcagatttagcataatttaaatctctgtcatactttatacgatgtagtatttaatggaatgtgtatggatttaaataaattagaatcttttagaacacacagtatttcagcatgaagtaactataatcaccatgtttatttttaatgttctgaargtttttggggatatgtgttgcctagtgtttaattttaaacctcacaacttgtttataaagcaattttatgttttgtttatttattttagtacacatgccaggttgttgttacaccttttacattttagttatttttatttatttattttttgagatggagttttgctcttggcacctaggctggaatgcagtggtgctatcttggctctctgcaagctctgcctgtccgtttcaagcaattcttctgtctcagcctcctgagtagctgggattacaggcacccgatgccatgcccagccaatttttgtatttttagtagagacggagtttcactatattggccagtctggtctcgaactcctgacctcaggtgatctacctgccttggcctcccaaagtgctgggattacaggcgtgagccaccatgcctggtcaccttcttaattatgtaaatgtatttaagagatgtttgttatacagacttattctcatgggaaaaaacaaaccaacctgggaaaaatgtgttaacactatttcacggcaattataatagtatcaataacaccaggttcttgccattttattatcatacaattcagagtctaaaaaaatctgaatataaaagcagtaacattttgtcaagtccttacagtataaatggattacatgtatatctgatttggtaataatgggttactctactactacatcacagtgtagtcataaataatgctttgtgtgtcatcatatgagttctgatagtgcacacacaaaagacaatttcaatgtgatttcatgaggttagcttctgtgtagtgctacataaaatatagacctttattgctcacaaattggaatgtaatcaacattgagaagagatatatttcaatgcaagtgctggaaaattttactgtgttaattaataagttaatgctaatatgattaaatatattttgaataatgtttaattatttcaggtgcaattggcaggataaaagtagttaggaaattgctaaattaagtgaaatatcttcactttttctctatagggggggcctggttcatctggggccaaaggtgagagtggtgatccargtcctcaggtaaaaaataaaaatttgactttttattcttgactggcttctttgatacagcataattccttcsagaatgcatcaatagttaattttttttttgttcctgagtagtattccattgatgtatgagggtttattttgaaattaaaaaattcagagaaaactgattacgatatttgggtgattcaagatatagtagccttcttttttatgttgggttaactttgccattaaaaggatggaaaatgcagcttaactgggaatcgtgtaaaaatactgatattagactatatgaaaatgtagagagtttattttttcccaaagtttgtgaactttttgctcaacactttctttttataaaatagatgaagctgaaaacatattgcagtaattgttttggattttagtttyccttgactcctttaatccaaaaagagaaatgtgttatcaaaggaaggattattttcatttaaaaactaaaaaaaaawttgtactgttattgttggcccatgccttcagactggagttcasagtacagtcttctcattacaaagctacatactctttaacctgtagacaatcttttttttttttttttttttgagacagagtctcactctgctctgttgcccaggctggagtgtgcagtggcataatcttggctcactgcaacctctgcctcctgggttcaaaggatcctcctactttagcctcccaagtagctgggactacaggsatgygccaccatgcccggcaaatttttttgcattttttctagagttgggrtttcaccatgttgcccagtctggtctcaaactcctgagctcaagcaatctgccctcctgggcctccgaaagtgctaggattataggaatgattcaccgcgctgggtctttagacagtcttaattttatatttctagaatgaacatttcacagtgattataaaaattatttatatkttcaaatttgggtttcatttttttctaccatgtttattatatgcatattgtttcaattaactttaaatagtatatgtagttagttaaatatgaaggcctatgtaatatttatagtgraactacatttgacctattattagctgtacacttttattttaaaayatgtatatcgatccccacgaaaagtatatattgacacattatggtgtactgctactgaagaaaaagataatgagaattttaaacctttaatctgacatagtatggtgccagtcaataatttgcttcagggattggcaaattgtcctccaaaattttgtagctaattaaaagagatgwgtaccaggcactgtgctaaattttaggagtatagtggggaaaaataggttaaagactttagcagttcacaatctaaatgggagattcaaacatgagaaaagaccattacaatccaacattataagcgcaatgaaaggagaaatatctagtaaagaacatccaacaaatgagagaaagtgaaagaaaggggattggaaagagaagagaaatggaatggatagttaagagtgtgttccatcaagggaaatgtaaaacyccaaggtttggggaataaaatgtgtaattatttcttttatttaaatgtaacctcatgtctacayatataattaataagtgataaggsccgggcgcggtggctcacscctgtaatcccagcattttgggaggccgagatgggtggatcacaaggtcaggagaccgagaccatgctggtgaaaccccatctctactaaaaatacaaaaaattasccgggcatagtggcgggcgcctgtagtcccagctacttgggaggctgaggcaggagaatggtgtgaacctgggaggcagagcttgcagtgagccgagatcgcgcckytgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatggaaataattttcttgtgtttgaatgattaaggtaacgctaagaggrtattagtttctgaaaccatctctcttgatgctattgagtttattgatcaagaattctataatatggtttaattatgatgtcttgatatagggccctcgaggcgtccagggtccccctggtccaacgggaaaacctggaaaaagggtatggcttattttcattgtgcattttgaaggcatctgccatgatcattagttttatttatttatttatttatttatttatttattttacttccttgctagtaataaaagtcacttcgcttaatcatgctgttggcattattagggtcgtccaggtgcagatggaggaagaggaatgccaggagaacctggggcaaaggtcaggagctcacatatttttatattcacatcctgtgtcagttcactctggaaaattttatatttaaaaatccattttctgaatctgagagaatatttcgcatttaaattgcagtacatatctagactggaattgtgtgatgatgatgatgatgatgatgatgatggttttacagggagatcgagggtttgatggacttccgggtctgccaggtgacaaaggtcacagggtaagatacatctattcctttttttccagggaatgttataaaatattttagaattgataacaatttgcaaaatcagaaaaagaagaaaaattaattttaacgtttgtgaatccacttaataatctaatagatactagaaggaaaataggtaaaattacacatgtggtatcagtgtaagttctttgaatatttttagacattataatattccttttatgcaaacataaattgaatcagaatctttatatacatttacctggaaaatatcacataaacagaagagcaatgtggacatttaattttacctctaattttttaataattccttcaaccttttcattgctttttgcctgtggacatatactcaaaagaagacatctgtaggtggtttgtcattaatacagtaatatactaggcactatattattttttggtgatggtaaaaactttcagtacaaggcaagaacttgtaatttgtgaaggctaaagaaaccatgattctgaacagtattccagtagataattttagtaggaaactatgcagacaatctctcagaaaaagatcagctttagatcttcacatctttctttaacagcattaataatgagaataagataagctttaagtaaattggagaagaaaaaaatagtaawaggaaagaaaaccctatgaatgtctgacagaacatatagtatgtgtctaacatgttaagatcaagacataattgtatccatttaaaaaataccagatttctttagtcacctgagttatgctgatttaatataaattacttagaagtagaaaatatttaagtcaaaatcaccaaaatatatccatatttaatayaatcatcagcaaaataagtttctgaacaatttagcttaaaataattaaatgtctgaaaacgatttaagatacttattttacataactcttttgtattgaaaattgagagaaaatattataattataaaatattattagcatactaacatgtaaagccagttaaagttgttaaattatgatttatctgcaaaattttttgaggagggtaaataaagcatatattttccctgccaaatgtcctgttttatttggtttggatagctacctgatagacttgtaaacattctacttctttccatatgctaatcttatttgtattgatttaacagggtgaacgaggtcctcaaggtcctccrggtcctcctggtgatgatggaatgagggtatgttaatacttcttttcttaagaaatatttaaaattaaaacataataaaacaaaatcatgttgaaatgatacattgtccaaatgttctatactctcattcattttgtcaatgacagggagaagatggagaaattggaccaagaggtcttccaggtgaagctgtaagcaactyactttttatttttaagtaatatttctagtttttaggactagtgactggtgttacacatataaaaacaatgataaacccaggtaaacattgcagtcttagctaagctaaccagataattgccatgcgaaaaaaattaaaaaggatatatagagctccttttgttacagagaaaatcttagacaattgagggaaaaatctgtggaatgtaacatttccagccaaaaaagttaccttacctagtttttgttgctgtttctttgttttgttttttgtgctgtcatcaatagctccgaaatttatgtactgagaagaaatgaatcctattaccagaagaaaaaaaataatatgtcacttggaatataccagacatatggawtatatcacttttctccaccaaatattacaaatgaggaaactgatctgggaaggtttacttgaagctagctaacaaaataactaaactggaaataggcctcctaattttggttttaaattgctgcattctaccttgcgccacattttagatccttgtcaagtaagttcaagcaaatgggagagaaattagattattttattggcttttctaaagaaggaaaagaaggtgagcaggtgcaggagggggaaaaagaagagaaggagaaatcaagtgtgaataataataatttaagaaacctcgaaaaatggtttctgtaatctgcatatatagttacacagatgatcgttttctttcctcagtgaatgctgtcttaagatgaaatttacctaaatgtacaataaatgagaatcaagactcttctatttatgtagtatatctgattgaataataaygttcgatgctgtcaytgaaatcaaaaaatgacacaaaagtgtcttatagaaaatattaaactgtttcctattttaaaaattccccaagtgattcatatgtaatattatagaatcaaagaaacacagtttctgtactaaaaactgttatttattctggcttttggatcagtataaacactagatatttatgttatggacatcactttcagtgtgttaataaaagatgtccaaatatttttattctaaaaataaccttaggatttcttcattgaaagaggcatgttattaggacattttttttttttaataaaggcgtgctttttmtttttctcctagggcccacgaggtttgctgggtccaaggggaactccaggagctccagggcagcctgtawgtattgctggaaacattgaagattttctagggaaagcttgttgccaaccttttagaggccataaaagccctcagtagagagccaagagtttattgccttgttatgtttgaagatctattgttgctgcctttcactttaactcatcattccctcctttycttctatcttccttttgattatctatcttagtgttttcatgatacatccccagcatgcagaggaaaatgttgctagattgtctccaatgtggacatggaaaagaaagtataggtcttgtctcttcttcgtttccattaaatcctaaaatgatttttagttgcttagggtagtgaatatcatgatattagattagtctttttgattttctgttttagcatcaaaacatataaacaaccataaatactttttcttcattgcagggtatggcaggtgtagatggccccccaggaccaaaagggaacatggtatgtarcaaatagtgataaaataactcatatttgaatataagccctaagaaaccattttttgttgttaaatctaaaatataatgatttattacattttgctaagtatattagatacagcttgcattaatattttgaaatattttccagaatctcatgagggaaaactgtttgagggtggrtagaggtattttccaattgagaagaacaaaaatctattgtgtaatatagcccattaaaaactttttatattttcctctggcagggtccccaaggggagcctgggcctccaggtcaacaagggaatccaggacctcaggtaagtctaagccactgmagctcctttgaaataatggggggaagatgctatctttctataagaaaatmgacagtctcacaattttctatgtagtcctagcaatatttaaaatgtgaatgtaggaaaatacatacttttcttttttyaaaaaaatttgagcaaacttgcagaagcccctctcttcccagggaaaaatgactcattcaatgtttagggaatgccaggactaatagccacctgcaggagggttctgaataggatcgcattatagtccctttgcaaaaaagagcagcttgtgtaaaactcctcatcgtgttytaaaattccttggggtgtatgggaatatatacagattyttataactcactrtgtactatagtgagctaayaatttgctgttttaaaagcatattaytgtgatttgatatctgatatatgaaataaattcttttaaaatagggtcttcctggtccacaaggtccaattggtcctcctggtgaaaaagtaagttactctgttgttctcgtaaagcctggtgaacatgtttgttttagcaatcttaggcaggtataaggtctgccttctgtttttgttaagatatctagatagctcagcacataaggaattaatctggagtcgacatggaaatatagtgtggggagatttcattcatgtgttcttaaactgagaatgataaaacttcagttaccatttaaacagcttccaaatgtggcattctcagctatgttaatttcaggaacrtaacrgtatgagtgaatattttctctttattttaggtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtmtttttccctgatctccactgtgagattccttgagtaatattttgtcccctgtagtcatagcacatttctakctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacagatgtgctgcaatytaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaatgttatctcattgtggttgtaatttgcattttcctaatcactacttttgttgaacatcttttcacrtgcttattggccatttctataacttctttgataaaatagctgttaaactcttttggttaatattctaattggattatttatcttaatattgagttgtaagagcagacatatcagatttaagtggttttgaaagtacttttttctgtggatgttttagacatagctgcacagcactattggaaaatgtcctattagttatgttaggttctaaaggttatttttaatatttagatcagggagtttaatctgggtcactcatattttagattagtgcattaaaaatatactayatttattttgtattgcacttgacacatgcacctattaaattttctaccatgattttatcatgtatgtactagattattaagaggaatttgctcttaggaaaagttgttatatctgaattacctgtgccaagccagataaaatgtataatctagtttactgcatttcyggtggtaagaagagagctgttttatgtaatactgcttctgcctctgatctgaatatatccagcctgtaggttcaaaatcaatctcttaccatcaaaaggagaaaggtactcaaaaatatgaggaaaacactttttaatgataatgtatttacaatataaatgttgtmttacatctatattaaaaaagtagaagctattacttttgtttttaatgataactatgatttatttattctggctcaagagccttcgcttcgaaaatttggtaaatagtaatgtttaattgtatcrtggtataatttaacattttaatacaatttaactaatgtcwtatgtttttacaatccaagagcaattttttgtactaacttatcatagcctgtgcttttatttttggtaaaaatakttcataaaatttaagttaattaactaaaatagataatatattatatttttctgacatttttgataaatataccaaatacatcctatgataaattgtgatawctcctaaatatttcctgtgatttaatttcygagttcactcatataytaattgcttagtagcaattgatgttacataactctctgagtccagtataaaataacaagacacaaaataaatattagttaaagggaggaactttgaagacgtggataggaacctaagttcatccagattgcaacgctgccacatttggttaaaaaatcttcacttttcaatttaaaggttacttttaattcatttttgttctatgctgatttggttgaaattttcttgtaaaactgcaatggcaggcaatatgaatacaatgattgtactttactccctgagaatggaaaaagcccaaaaatatgtccagcatttaggcttgctgatatgtccttgaccttctcattgattctgaatcctggacaataacttgatgtgtcaataacgatgacctgggctctgggaacttgataaatttaatattcttagaagaatgtctacttttctcccaagaaaaggtctgattcttgtagtagtgattcttaccatgttccaaatttagaaatggtcatgttcaatgtgatttgaaactctgtgtggttaaacagggattaatctgttgaattattactttattattatcttattgggtacctattaggatatgttctttttacattaaaatcgatttactttccttcatttcctatgaataactatcataccataacattgcacaaaatattttaataatggtgtttcatcaatgttactatgtaattttttgaattagtacttactaatattattgagggaaataatacaatctttacctctttaatgatatgaatcaatatatttctggcctrtattgctttcctttttgttctctragcttcagtttattgtggtattcaaaaactaatttgctaatttaaaaaaagacctatctaagattataagcaggctaaaacctagcatacctttgacatgttaaatttagttttaatttatctttacatggcatttcctccaaataatwtatttaaaagttatttaaatggttattacttatgaattgaagccagtgactcaggataagaatttcattcatagtatatgtacamgttaaagctttttaaaattatttttatctttttaatattttttttttctctataagggaccacaaggaaaaccaggacttgctggacttcctggtgctgatgggcctcctgtaagtaacagctacctggtcattaaaatttctttacattatctttaaaaatagattttacatgtgttttagaaatgattatatgaggttagtaataaaaataaattgagccagtaattaaacattgatctctctaaaatacctttcatcatatcacttccatattgcaaaatctttaatgarctcacggtggcttttgtggaaactcatttggcactccaagccagaacctccccagaatytcatattttttttcatttcctccttaaccattagctccaggtaagcaggtccactcacatwttcttgcatgatctaaattttctatcaccttacctttcccaagctgtttcctctcctagaaagcccttccatcttctcctccttttcaaagtatctgtttctatgagtccaggtgaagttcctcaccattcataaattttctcagacatctttcatgaaaatatctcagccttcacagatttctttcttttctagaaatatagtaatatttattatttccctttaaatagtaataaacaatgaaattatgtaatctctacagttattatattaaaacatttgttatttacagatttttttcctctttaaactacatatgcagattttgtagtactaggatataagatttctcatcctacctttccttgttattgggtataattgtgatatggctatacatttttatttactgaatctcaataagttgattattaacactgttagcatttatgatctcgctgtattttcagatgtctcatccacatgtcttagtgcccctttgaaggtgcatgtatgatcatttgattaatttgctaaatataaggcagatttaaatacctttatgtaaggctttaattgaggctggggttgaattgttaatgaatgatatgtattattttrtgtgctttttctaagctctctcaaatgcattatgtatttgaagaaacttacatccatcaaatataagcttgtcatgtttacttccaaatgccatagtttccaatttatttaaagccatacacactgatgcaaaagtgttcaatgtttttgaaacttaaagagtaagatcttagtagatttaataacaaaagaaatactttcgtagtattatcaactatgtttatattacatcttatcagtgtatgtttttgctaaatatagggtcatcctgggaaagaaggccagtctggagaaaagggggctctggtaggttccaaagtatccatttaaatgtcctattaataaatttccaagagaaaatgccttaatttggtcatctcatatatataaatcaygttcatatagttattttgggtataaaaaagatatcttagactacttttaattttatatcagtaattttagaaaytagactatgttctctctttttaaaaaatattcccatggctaggaatacgtgcatatttttcatgtgtattatatatggagtaaatgrtaataatataaacaatgaaattgggcaagaattactcaatattactgaactgcttatgtaaccccaattttattattacttattactttctggtaaccattatctaattaaatgttaaattaagaccaatggctattaaaatatcaaagtgaaatgtaatatgtgcatattcaatgttagtactttagattacagtagcaggggtaggatcattttgtttacagttgtttttaattattttaaaacagcattaaaatttcagcattactgaggaaattataaattatgattgatagaacattttatctagatagactagagaaaaaaccagcttttggaagatatataattttgattatattcttgatgaagtgaatgctactaatttataattttctatttgaaattatcaatcttgttagtttttcaataactgtcttttatagacattagtatagcatattttaggttaaaaatctagttattaatttttgaattgtttacattattttacatgcttgtaagatttgccttattagtccatttcaatattgtatttttagtatgaatatatgacataataaatttggagtgagtagtgctagttacatgtttttctcatcatatctgtttctagaaataaagagtaaactaccaaaaagtctttatcaaatattagcagtagaaaaaaaccatatccttgtagattagttggtaaaattatagtatgtaaatgagtagcactttcaatttattacacgtataagtggtaattcatctatttcagggtccccctggtccacaaggtcctattggatacccgggcccccggggagtaaaggtaacgttaaattgttttcacattatttactttcaawgtgaaatgttatattcacttaatacttctaatttattccacagggagcagatggtgtcagaggtctcaagggatctaaaggtgaaaaggtaaaatttaattgtttagatggtattaatttctgtgtattatgttaayatttaaatttattcaacagacattttatttcttgaatatatgagtgattactacatactacgcaatgctagtataattttgtattctttatcctcacaacttaaaaacaatgtcttatatcttgtgataagggttaaataccagaacagaaactaaattatgttacctaagagaattaattctgcatcctttttctttttttttttttacatgtgcttaagttttgttaatcatagggttggccttacgaatggatttgctgcaggatttagatgttatctagttagatgcataacatatgaatatttattccttttttccctactgaaatccccaaaatgtttaaacaaattcagcacaaaacaggaaagttagaagtacactaaattaattggggaaagaggaagtctttctatatagtattacacacaaatcaatagtgttaatgagagagataaaaattacaaccagacagaagtgaatgaaaaaatgtacctaaaactatgaatgcatatggcatcttttatagggcatttataggtaattggcttttgctgaagaacatgacattcagatttttttcaaggatacatttagcaggcctgcaaagccccaaatccttcaaagattatgatgaaatgcaaagggaatgacattactcagtgatagagtttagctgtatgcccacccaaatctcatcttgaattctaatccaaattgtaattcccacctgtccagggaggcacatggtgggaggtgatgagatcatgggggcggtttccctcatgatgttctcctgatagtgagtgtgttcttaacaagatctggttgtttgataagtgcctggtacttcccctttctctctttctttttctcctccaccttgtaaagaaggtacttgtttctcctttgccttctaccatgattgtaagtttcttgaggattccccagccatgcagaactgtgagtcaattaaacctctttcccttataaattacgcagtctcaggtagtatctttatagcaatgtaaaagcggactaatacactcagaatcagtattgaattaattcttactacaaaatttcatacaaagttaaaacaacacatagttgcatagcataaatattggtaggtttggtaagatatacatggatattaactattgttaatatcatactcataagaacatactctattagactgtccttgcactgctataagaaatacctgagactgggtaatttataaaaaagaggtttaattggcttatggttgtgcaggctgtacaggaagcatagtggcatctgcttcttggaaggcctcagggagcttccagtggaaggcaaagagggcacrggcatcctatgtgctgggagcaggagcaggagggggtgaagaaggtgccacatgcttttaaacaatcaaatctcctgagaaggcactcactatcaggaggacagcatcaaggagatggtgctaaaccattcatgagaaatccacccccgtgatcctatcaccccccaccaggtcccactttcaacattggggattacgtttcaacatgagatttgggtgggtaaatatccaaattatatcacatgctaatattttttcaaggacagtcatttattttcatggttacaatattatcaaaaggcttatgtgtggatttgataccaatagggaatggataacaaaaagggatggatttattatatccattatactttatctggaaaaagctactgttatatactaaaagtaaacaactatgttgtcagatttattacatgaaaaaggccatgcatttcrcattagctcacctacttaacrgtaatctcagttcatcctgatcacctagatgaacttcagagtaccagttggctctccctatgggttctgcatccatggattcaataaaccatagatcaaagatactagaaaaacaaaaaattaaattaaaaaattataatatgactgggcacagtggcacatgcctataatcccaacactttgggtggctaaggcagtagaattgtttgagcccagtagttcaagaccagcctgggcaaagtagtgagacgtcatctctacaaaatacttttaaaattagccaggtactgtgatgcgcacctgtggtcccagctacttgggaggctaaggagggagagttgcttgagctcaggaggtcaaggctgcaataagccatgactaagctactgtactccagccagggtgacagactgagaccctgtcaaaaaaagttatagtacaacaatatacaataatacaaatraaaaaataacaactatttatatagcatttagattttcttaggtattatcagtattctagaggtgatttaaagtataaaggagaaggatgtgggtaggctataaataaatactatagccttttatatcaagaactggagcatccacagattttgatatagkaagttgggttggggtcctggaaccaatcacccctagataccaagagaagactgtatagtgtctcactgaattgacaaaggagcacagtggtgagtcaggtagggtttaacatgtaatttgtaggttgcctatacgaaaaataatgtctctgtttagaatttttcttgttaagaaatgtaagtaaaaatgcaaatgtttttctytggaattagtatccatcaaggatttttagaggggctaggcagtgtttaaaagaaaattgcctgactggggtggggatgttgttractgctgaaacttgctaggagagttgtaaagtgacagaggcaaataaaattataaatgactagatatatatgaggacaaagccatacaggaaaaaaaaataagatacattttttgtacataggaaagcttattaacaattgctcattgtttttagggtgtatggtctcagaagatgcaagtatgtatagaggaaaataagtaaaattttaaattgggaaccaaaagttctgkgttattattctagtttttctagttrctttttctgagcctcatttgaagtctgtaaaataaagaaaattccctaaaaaaatttaaaggtatttttcagctatagcttttattctatctaatataccaatcaagtagtaaattatgttttattatagattacaatttagttttctaaattatagatttagagaaactttgtataaatatttgtagaatttttaatggtaagaattctccatattttcaaactctgtgaaggattaagccctgatgactttttaatatgccttatttatttcatttttctgagtatgcaagataattgatcatttatctcttacgagatagaagaaaatggaaaatattttatatataatgatgttaattgttaaccaaaggtgatatagcaagttagtactctaattatgactaaaattmtctcttttttagccttagatttgtcgcttaagtctggagcaacacagctcaataaattaggtggcatagatgaattccacttttatacatcttctaaaactatgttttcttctttttttctttatctgataattttaatactagaaatcttaataacttgatacgtcacttgctaaaaaatgacatttgttataaggaaatacctaattaaatcatctaattgttttttaaacgtgaatatgctgaaaactaaaacatgagaaaaatagcctccctgtagactgaattctcactttaaaaataatttaaaaataaaattctgtctatagtcagagtctataagtgatttttagacatagagtgcagtgttctttaaactaagcatggcrgctgtgtaattatgtttttctctagggaggaggtaatgaagacgttgtcaatagcaagttcagtggtcatttacagctcttaagcctctgccattgcccaatcacrttcagtacagagagcatcctgggcaggatggtgaaaatggcatgactttctcttgaaaaaaaaaaaaaaaattcctggcatgctagagttctttgagtatgcaagataacagtttgaatctctttccagggttaggtctcatattcacaagtacccagtatttggtattttctggactttaatataccttgctaaactcacactgaggcatttagtaaatgtttattgaacaytgtggttactgaaggtccaaaacatgtttgacactggagactcacaggttaattaggcaggattcttgtgttmggccatttagcagaaggaaaacaacctatgatctagaaaatgcaggacggcatattgttgcaataataattattcagtgaaggccacaagatggagaggttaattttaggaggagttcaagacaaaagactgaagaagtgaagaagggctagatcacgtggtgaagggaggtgccttatattgattattagcaatttgatacgattaggatattttaaagtaaaaattgatgtgaccagttttgtattttaaagagatcattttggcagcgagatgtggaagcatttgtgcctatccktcctagctttgttttcatacacagcccaaaatgttcttttctgaaattatcaaatcaaattcatttctaccaactgaaataaaaacccctccatcaaaccctccctattaacctcctgcctcaccacctcctccacaagcaccatacatcatcatcattatcattattttggcattcttctccagacaccctttctacttcatctgtaccaaaataactgcaaatgtcccactttcagttgtttgtttgttttgttttgttttgtttttgagatggagtctccctctgttgccaagcctggagtgcagcggagtgatcttggttcgctgcaacctctacctcctaggttcaagcaattctcctgcctcagcctcccgagtagctgggataataggcacccacaaccatgcctggctaatttttctatttttagtagagacagggtttcaccatgttggccaggctggtstcgaactccttacctcagatgatccacctgcctcagcctcccaaactgctgggattacaggcatgagccactgtgcctggcccacttttagattttactggtaaaacaaaaacctcaaaatactccrcagcactttgaatgagtaattgctcaattaattttattgaacacatgaatgactatttcttagtaatttaatttttttttcttgaacttaagagataataaggttgtttatgcaacttacttaaaaatctaggtttcaataagaatgatagaaaatatttccgtagcccaaatcgttcctctcttcattaaatgacttcattttcagcattgttgctctgtgtgtatagtgctacaattagcaattctacctgtaaaggatattattaattcctattttatataattaattttacctgaaagaagattgtaagatacagaacccattgagctagaaggcatttatctaatggacatgattwaaaaaaaaatacaatataaaatttataggcataaattagtaaattaagggaaaatcattttattcattctgtgtgctactccagagctcttgtaatacaaagttaaaatgataattaagtgtttccttttgttgttgttgttcttgttgttgttgttggggggagaagttcttgctctgtcaccaggcttgagtacagtagcacaatcacggctcactgcagccttgacctcctgggcttaagcaatcctcccacctcagcttttttagtggctgagattacagtcatgcacccacacacctggctaatttttgtattttttgtagagatgggttttgccatgtggcccaggttggcctcaaactcctgggctcgaataatctgcccgcctccgcctaccaaagtgtggggattacaggtgtgaaccaccacacctggctaaatatttactttttatttgtttaaccagtatagaatacatgttgttatgggagaatggttatttccctcataaaataagatttaatgaacatatttgtgaaaaatgtcctagggtaatttatagccaataaatgtgaaaatatgagatgatattggggatcagaatctgtggctggagttggaaaagggaggaggaagtttcacaactaccatgcacatttctcaaaaataattttccctcrttatcagcacataaatttttatagcartattttaggttactccaaaggactgattaaactcctatttaattccttttataatgttttagggtgaagatggttttccaggattcaaaggtgacatgggtctaaaaggtgacagagtaagtatagagaaaatgtacaccagtacacaaaatttaatatatatatatwttttttcctttgcttatctttaaatatagtaagcatatgataaataaaatgtttgtactacctaagtctttactcatttaagtttttatacaaagatttaaggattttaatttttgtggagatagtgtagtatcaattgtcttttagatgttayatttccataggttccataataaacatgagcatgcacgcgtgcacacacacacacacacatgcacacacacgtgttagtatttatacacaggacattagaaagttagatcaaattactagaagtaatttgataagtttgctctaaattttgttcatatataatgagctatgctgcctggaaagtatacgtctgtaactttcatgaattttcattatatggtggtgttcaatttttgaatgtaaaaatrgtagttttttctagtaatacattatagaaaacaaacagaaatattagttatctaaagcaaattaaatgctttattgggaagatttatttttaagtaatatactagtacctaatacatctgaataaagaagcattctatagaaaatatttcttttcctaaaattcaaatgaagtctgcatgcaggattgggggcaataacatccatatacaagttcttaaacgttaaagataaaagccacgtacaaaagagagacatttttcttgtgttccaaacagtaatttccaaagctgctgaacaatctttattattatttttccctctctctataacacaggtgcattaaaagcaatttaatgtcatatatgatatgattcagcttttgtagattttcaaatatcagactatattcagttrtttattaaatatgaaaagattgattaagtcaaacactttcaagcctctttttcatgaacaaaaacatgagtaaacacaccaaagttgaaaactctgactttcaacagactgtaatttatgcctttcaatctccaaatatatttttgtaactgcctgatgggtttatcttgcctgctgcccagacagggcctatttatccagacaggggaattgcaaactctttctctatgcatacagttagctgaataggagactrgagttttattattactcaaattagcctccacaaaaatttggaggatagggttttttaaagatagtttggtgagcaggaggctaggaaatgagaactgctgcttggttgaggatgcaatcatagggrtatggaaaatggtccttgtgtgctgattcagcttctggctggggaacatgaggccagttaaatcacgaatcatgggtctgagtggagtcagctggttgtcagaaatgcaaaagtctgaaaagacatctcaaaaggctaatcttatgttctacgtagtgatgttatttacaggagtaattggggaagttataaacattgtaactttyggaacaatggctggtaattttttactatgactacattttagtggaattcacacccctctcataattctaaccttgtggctttgtattagtttttataaaggcagatttgtttggggaaagactatcatcatttaaactataaagtacatttctcccaatgttagcttgctccatgcccaggaacgatcaagggcagtttgaaggtaaaaggcaagatggagtttattatatcagatctstttcactgtcataattttttccctgttacaatttttgtaaaggacgtttcactcataagaatgttgttattctgtgcctcagggagaagttggtcaaattggcccaagaggggaagatggccctgaaggacccaaaggtcgagcaggcccaactggagacccaggtccttcaggtcaagcakgagaaaaggttggtaaatgactttaaattcactggtactcytgcagctgatgtttcattatcatttaaatttctttcaataactggtgtcagaaattgagttcttactacattaaagataaaatgtttcattatcattttaaatttgcaaccattacatttacgtttcagtgtaatattaggcaacattaaaatttgcctccagaaagtatttagtgacaccttaaattttctataatgtactgtgaagttaaatttaaaaaaaaaaaagcaagaaatgtctatgacaagtgttatcacattatatacactaaagcaaaatatartatcttatggatagaattaaaatgattccttttctttcatatacatacatatatatatatatatcctacatgtatatgtctatattaaatagggaattctgttaaattcctattaaatactcctaagaggtrtaattatgagatgaacacttcttttgtcacttctccttattttctagtcttctatgccctcctcggccatgtggaatcagctactcttagagttcttccacattagatgttgagaattaaaggatgtgtgattaaaggatgaaagaatcaatgaaagaggktctacttaaggtttyacaccaagtagaatcatcttttattttttccacttaaacatgcatttcacataataagtctattaaaaaatactggtattcaggcccaacttcaagagattttaattttaatctgggcttgacacaatatcaatatgttttaaaacatccccagataattatcatattcattgkttgagagacacggggcattatgtgttgcgtcaaaaagatttgcaaccattacatttatatttcaatataatattaggcaacattgaaatttgacttcatgttataatgtaataacatttgtctatgatgacaagcaagaactgtctatgacaagtgttattacattatatacactaaagcaaaatatcagtaatctcttgctggtataattcaaatgtttccttttctatatgtrtatgtctatattttctacaacaaacattccataatttctttattttattttttactatactttaatgcacaacgtgcaggttagttacatatgtatacatgtgccatgttggtgtgctgcacccattaactcttcatttacattaggtatatctcctaatgctatccctcccccctccccccaccccacaacaggccctggtgtgtgacgttccccttcctgtgtccatgtgttctcattgttcaattcccacctgtgagtgagaacatgcggtgcttggttttttgtccttgcgatagtttgctgagaaggatggtttccagcttcatccatgtccctacaaaggacatgaactcatcatttttatggctgcatagtattccatggtgtatatgtgccacattttcttaatccagtctatcattgttgaacatttgkgttggttccaagtctttgctattgtgaatagtgccgcaataatgctatttaagaaaattacaaatagaagcccccaccgttctatctcagaaagaaaatatatgatataggtattagatagagagtgtgaatagtcaaaaagaaaattcctcatgtccttatgaatcatctaatgtgacagttcttatcggktttcatactttgcaacttctacagtttcacactttgaaaaaacattgctaattgtaaattaatgagcaatgktatagtgatttggcagcaaaagaaaaagatcaggggaaaacaaggccttatggggcgtttaaaccctttcccttaaaatgctcaaggccagtggttaaaagggtatcctgggaccttcctgtcttcttaggctctatcatgtgtaaacagtcacacaagctattgtgataaatcaggagcttaaactaccccacagttcttttcttctttaacatttcattagtatatgttagtttattgaagttgcctatcatcctgttgaaaatacaaactttctgccagaatttattttaaaatgactctaaaatgaattagagtatatacatacattctaatgtggtaattaccaaagaaaacaaatagcttgtgatcagaattagataattttacttatcctgaaattgatggtgtaaaacaagctgtgataacttaatatatccaagggaacatcattataagtatgcttcttagggtttgtttgatattttccatctgaagactacttatctatgtaatgctgatcatgacttggacaactctttrgttcaatctgtactaacaaggtcataaaccatgttcttaattttttgccttatttcatccagtaaaatacttatttttatttataagcttctgttcatcttttatcaatgcacatacaaatttgaacttgtgtttgttttccatttttagttgttcaatgtacattgaaaataatgatacattatgctttctaatgtttaagacattagtaaataatattttataaatgaagtgtgcttttgtaagtatcttattaggtaaatggatgcacagtaaaattccacatacatattttattcaattctttttttatctttttacctgtgtttttttttaattaatgttttgttcagatagaaatcatagggaagtaaattgtttaggataatatttgaaaccatctggtatttgttacacattgttggacttcattataacttaaattttgttttagcactttcagattgaaaggtaaccttattgcactggaacaaaatagtatattcagttccctgcttggaggaataaacactccacaaaaaccatcattattagctaaagctctcaacacatattatatttattagtccagatatttcagcatgttagagtgaaagaagaaatttgtcttaaaatttaattctgaatttctttgcatatctaggtttacttactcattgaraaaagttaagtaactcatgatcccttgttttatrtttagactggggtaaatgaaataactgtatcaaaaagatttactctggttgaagggataaaatctaaatattgtgccagttacatcactaatttaaaatagtatttaatgttgaaaaagcttagaagtatttttaaccatgctttagaattcacaaagaagtgcagagttctctttaaaacctcagggttcatgtacctaaagaaggcactaccacttatataataaaggttaagttaggcaacattataacattagaaatatgttcaaagcaacaattttcttattcacgtgaagaaatataatgaaggtaaataatgacaaaaatctgcaaatmttccttttgagtgtacaatatgtgattctaatatttwaaaaaaattgaaatcattatttaagcttaattcaacttaaaatattactttgattattatatattttaactktagggaaaacttggagttccaggattaccaggatatccaggaagacaaggtccaaaggtaaaacagcttgatatttatagtttattaacatttcgtgaagataatattaatcacttatgattaccttacaatttgtaacatctctatattatsatgagtacttaaaaataatttcacaaggaaaatcatagagtgtgtggacgcctggagtgcagggagctcaaagagcttaggtgattatggattgcagtattttaggagaaggaatcatgaaacgaaggcataatcggtaattctttgtaattggaacaagaaatatcctagtatatctggaagttttaacatggaagacatttgatgcataacggcttttgatttcctttctattatcctaagggtttaaattaccacttgaktttttaaaattaatacacctttcacactattaccctcatttccaygagtattttttttccagggttgctatgacaaatctccacaaacgtattaacttaaaacaacagaaattcactgccttacagttctggaggacagaagtatgaaatcatggtgtcatagggccatgctccctccagagtttctagtaaagaatctgtccttgcctctcccagcttctggtggccccaggcattccttggcttgtgacttcatgactccaatctctgttcccttcttaactggccttttttctgtgtgtcttattctcttctgtctcttgtaagaacactygccattggatttagggaccacctaggcaatccaggtggatcccatttccttaatttaatagcatttggcaagacttttttttcttttccaagtaaggtaacattcacagattccatagatttgtatatggatataaattttcaggagccaccattcaattcgctgcatcactcaaatctcatttttggctatttgaaatatacatrttttaagcataaaaaatatggttttcaaaatgcatatttacctcggtgtactaatttttctcaaacctatcataaaactttgttaaggatgcacttgatgcattcagtagttaagtgaatgcacttgatgcattcagtagttaagcctgttaagtgaattaatatataaatgttgattattaattacagaatggttatgatacaggagggagacagagaagtgcgggatagtttcagttttatcattcttttagttatatgtacatgagattatatcaatctatcagtttattgagtttgacccattcaggcataacagaaacaataggtatggcaaatcctgtttctgtaacattcttaaacgtgtgtctattcataagtttcacatgtaattatgggagacaaaaatatccttctccctgaatatgtaaactgcatgtcattgtgttccctcattgccaygtgataacactgtcttaggcttgctatacagctttgtcttayaattttttcattgagtttccccaaaaatacttccttgagtagcaggggmtaaatataatgcttttgaacccttctaaaataagatttacggcatctgtgatttaaaaataatacaggcataatttaaatattttctggctgtactcaggacactgattaatactttttatcatttaaatattatctctaatatactgctctgtctcccagttagcttcctttcaaatgtcaagcattttcacaaatattatcagtaaaagaagccattcactgcataatccaggacctcaagctatccttacatcacttcatgcattcttgatctatttattaagttaaattgcaattgttttgttttgatttaaaaatataggaatctgtcacaatattacatgaatgagtagaattttattttatgaatttatttaaaatcccgttttttccctaagttctctgatcaataatctttgaattgtttttattaacaaaatgcaacagaataacaacagaaatgtttcctcctagaggtatccaacattttttaatccttttactgaaatgtctggaattttattctttatttcttcatattgcttctcttcataactcatttattatttctatgatcaaaaagctttaaagtttctctgttctaaaatgaaaaactgggacatcaaaaatgaaaaactgggacatccaaaatgaaagatagcttcgtattttttcctatgtgtaagctgatgaattttgaataaatttaaattttttttttactaaaatgaaatgcctttaccagtctctttcaagcagattaaggcctgtaatttgacatcttattaattgcttagtagcaatataaaccataaaggtattaaaaagatgtagcaccacatgtgctataaaatgatagctgtttctaaaataaaatctattttaaggtaggatacctttatatttcagacagcattttaaaaatttcacatttttagtttcacatttattgactgagccaatttcacaattaatctttgactttatggcctttgtgtgtttccatataaaaacgggtaatactgtttcatagaaattatatattttggtgataattccttatatgggaagcaaaaaataacatttccatatattcaactgattaattgggtaggttggtcatttttctgtgttttctatcaatttcctagagtagaaactctacgtaagtatatacatttatgaaaaacaaaattggtgcataatatctctttgcttaaatgaagtatctataaatatgctgttacctcttctagtcaggacagaactgaatatttgtcccccccctcaaaatttttattttcatactgtattataatcatttgtccaattcctgtaatagtcacatagtaatactgtgctagacgtagctaactgattctgtgtagagaaagaaaagagattttgaaagctcttcaaaatgtaatgtgcagagatttttttccccagtacgtgaatattacacatcctaataattgttctcaggttgatcacaagttagctgtataggcatgtattgaaacatacaggaaaacatgttataaaaaacagcttagcagtgcatccttcaggttattattttgactatcagctgccatagggcatcacatacaattttaytgacctgctttaatagcatcatgtaggaaatacaaattgctagcatcttaccttcctgataagtgtgtaatattcactgctttcaaattgggaatagggccaaatagttacctcctgtgagtaggtaatactctacacctggctattccaactgtacatgcctgagaatacwgcttcaagacttctaagatttcacagtacatgtgaccccgagaggttggtaaaaattcagattcctggacctcactgccagagagtctgtttcagtttcagtagatgtggagtgtgccttagcaatccatatttttagcaactactctagattattctgatacagaggagccatgtatcacttggagaaacattatttttaggggtatttcaatgcaagtgagtggattaaaaaaagaaaggagtgtattcaagtcaaacaaggctttgttatatttcccttaatatatggggaagtttgtaaaatttgatgtctagtattctcacagaggctagacattttacgtattattgcacttaatccatacagtgatctaaacaggaaaactctccacttcttccttttcagggtctcataattaacaagttgagcagcaaggatgtgaacactaatcttctctattttatgatacagtgatgagggaagctaatcacaatcatgatcaactaaatgagaagataaaaatttagatatatgtgcaagatcatatgggaaatttggttattggggattatattgtattccatctgtaaaatgtggccatttgtaaatgaaatagtgtttttataaacatttcattttaaaataattattaattatacattattattatttttataccaagcattctttttttcagtcccacaaatttcaaattacctgtaaggtgtgtattactgccctcactttgcagaagaaaaatctatacttgatgcgcataagtaatgtaccaaacttacttagctgatacatttagctgatgcataactaacataaatctcaaaattatgtcttcagaattctaaaaaacagagttttaatgcttgggtgcctgaaatagactttcagctagatatagttgtattcaaataccaaatcgaaaaagtggaggaaggtttttagtctatgaattgatccagttttaaaagtgtaaaaatactcaactcaaaagtggtaactrtagacatatgataatattaattcaggaaaaacattttctraaattcctattttaatatttgactattcctgtttgtgaaaataggatttttctttagagttgaagcaaatacaaagaattttacattgcaatacattttctataaaatgtcctataattactgttttataacaagagatgaaataatacttgattaattcatttaytcagaaggttaaaaactaaaatgttttatcaatttgtgctttcaatgcttccaggatttcagatgtcattgtaagttcattttcaattacttcgatgatatcttaaaatttctatatttgatttaaatattaacagctgtgtgaaaatcactctgttccaaaataaattacatcttgtgactgaaaatgttaattkccatgtttattcattatttacttttattattgtagggttccactggattccctgggtttccaggtgccaatggagagaaaggtgcacgggtatgatatataaatatgttttgaactatgtatataagtgttcttagctggacatagtggtgtgtgcctgtattcccagatatttgtgaggctcaggtggaggattgcttgaatcccggagttccaggccagcctgggcagcatagcaagtctgtctctaaatgaatacgaatgaatgaatgaatgaatgatgttcttgcatgactactcagtctcagcaccaggctcataatttactgtgatatactgcatattgaamttgaactgtctttgctagggagtagctggcaaaccaggccctcggggtcagcgtggtccaacggtaggtgccttgatttaaaatsatgtacatttttcatattgaatttagtgtatcaagataatttatttttcaaaaataaaaattgatttagtgtctttggatttgtctggcattagttygggttcatcttttgttctcatctgcagggtcctcgaggttcaagaggtgcaagaggtcccactgggaaacctgggccaaaggtatcacctgtactttttctgtttggatgttactgtagattttttttmcaggcagatgctatgagaaagaattcaaactgatttttcttttcttttcttggtgccagggcacttcaggtggcgatggccctcctggccctccaggtgaaagagtacgtatgatacagccacataatataaaatgaaaattagtatttctgcaagtatttagatttcagagraaagatatatgtctgctaatacatgtgcatgtctatccacaaaatctagtctgaatttaaaaacgcttaktttttaatttattcctcttcaccaataaaaaagcttaatcaatatgttcwactaattttgttatagaaatgagaaaaatgtgtgtaactggactaagatatcactcttatagtcaagacaaaaatagatattttttaaattttaaatacacttgaaacatctttgccctcttctccaatcagcttgctttccatattgatactcattttgttcacagagctggcagcaaaattatgctggtaaaaaacaagctactagtagccattaagccagaatcaatatacattcaactcaagataaaacatctattccagtaaatagaatagctatttagtaaattgatttttaattgatgtaagatgtagccaaatacatatgaacaagcatgccctttgtttggattttttggmaaaatataacatttttgtagccagatttttaaaaaagctatcctcctgatataagtttaagtattataatctgtattcctttaaaaaattagaatcatttcttcatattctataataattttcagtattatggagtcaggttaatatatttttgtatattatgatttgaaatgtataatagkcattttacacaagacagaaataccttgcaatgcataacctaaaattgaaaatgaataatttttatttgagtaggagcaatgagmaaaacttgagtttttatttgtgacgaaaatgggagtagataacacacaagaataaacatttaattagagttgtgttaagtctttggctcatatttaattaattttccgctaaatgtttctcactctcgatgaactgttcccaaattaagtctatcctgtaatttttgagctcataaataatacattcatttgaagtattttatggtcagtcattttaataagggacatttaaattaattaaaawggctaaataattaaatggagtagaacaatttaacaaaaattagcacaactgtgagttttgtttttagagcaccactgattctctcatgcatttggttttgtcttccaaaatgttatgatcaataatatttccttacaagtgaatatgcttttgctgatactgcattttaatttgaaaaacagcaatactgtcatccaacagtatgattacttttaaaaacactttgagagtgagacaagtasctcttgggaatttttgttttgttttgttgttttagtaatctaggtggattcattttcaataactattcatatatgttttcaatgtctatacaggaagaacatatttcctatgttccttgtggttgatgagacatttcatcccaagtatgccttcattttctgccaagaatttttaattatcttaaactatttagttcacgtcttgagcacacagttgaaaaatggcaaaagtaatgccataaaatattttcctcaaaatatatgagttggggaaagttcagggaattagttctgtagtaccattggattagaaaatgaaataactatttttgcccatttcaaaggactctytcatgatyattatatttatatttaactatacagttatacatggcatgcatatatatatgtatacataaacttttattaaagtattctacaaattaaatgtaatccctcataatcataatttgcagatcatggrtgctggttattaaaggttaaatatatcttttagttaggtctaaggttaccaaattaagtgaaaacaaaacaaaaatggaacaacagaaccaagacacctggataaatttgaattttatataaagaataagtcatttttgtcacaactatgtctcatgatatttaggacatattaaaattattcattatttatttaaagctcaaatttaggcactggatattttatctagtcatctggtttcaacaccatctgtacactgagtcattatggatttcttaaaatcccacctggaaactattttgattattaggaaaagaataygccagccaggcgcgatggctcacacctgtaatcccagcactttgggaggcagaggtgggcagattacctgaggtcaggagttcgagaccagcctggccaacatggtgaaaccctgcctctactaaaagcacaaaaattagctgggcatggtggtgggtgcctgtaatcccagctactcaggaggctgaagcaggagaattgcttgaacccaggaggcggaggttgcagtgagccaagatcgtgccaccgcactccagcctgggcaacagagcaagactctgtctcaaaaaaaaaaaaaaaaaaaaaagccaacgttttctgtgaaattttataaagacycaatttttcatttttattttaaagtaatgatttttgraatrtttctttcttaaaagattttaaattcaaattgcatttgaaargcagcaaaattttaggaagcaaaaacatgacattttaataaatcaggaaaatagtttgctacataaccaaaagaatactatttttaaaaatttgtacttaaaatggatttttatttaggaatcatagtgtcatagtttaataagagtttaaaattttgtaagttcctaagatttgcccagtagttttggtagtttcatgtgaaatctatttttgttaactttatatataactttgaagttactttttaaatataagatgctggtaataataaaaacttgtgatgatttctgaactaacattggcttatgaatggtaatgagatttttcttgggaaggctagattgataaatagaaagagtaaattctattgaaggccaacttcagtaaactctatttttgattagaaaaatacataaatcctaccctaaatgtattacttaagacattttacttatgttatctttcataaatcttcttaaataaatgtaactattacgttctgggcatatagaggattatctcttaccaattactttttctgccaacaatggagtcactgtaatgggactttatgcactttttaaaaataggtaaatttgagagatgaataatatagttaattaaaaatcaagccaagaatgatattataatttttatttggactgaacgttaataactacacaataaagttatttttaccttatctacaaaagaaatttatacatgagtaaaaaatatattgacatcatccaaaataaatatattttagatatggagaataaaggcatcttctgtggtctttttgagatagtcacatactttctcttttagttttggaatatacggctagatacagaacagggatagaagatagaataagttttaaaacagtttttttttttttttttttaagcggggctgtggaattgaattgaatcaaaatatcttccttgtatgaatgtttctagccaatgttaaaagtaaagacactgcaraacttctcaatacttacatgttctattcacttttaattgatatgaattctaaatatttacagtgttcctgaggtaacattgatgtgatgtgtagttttgagtaraaatagtgtgaaaatgtatccattttacttttagattagcacttactatcgtgttgtattaccatagttctgtcactgtgatgaagaagctgtatgatacattgtattttgtctatgtaaataaacctcaaagtataaagatgcatcttctaaggcatattgttaacttctccccactgctttttatttccagggtcctcaaggacctcagggtccagttggattccctggaccaaaaggccctcctgtaagtgtcagagcttctctttctctttcttcatttgatatttttacatttttgagagtcacagcttacatttatatatttgttagatataatattgataaaatctctgtaaaattacaattgatgtcaaagaaagtagacatttttaatttataaggttcatagatcgtttctgaatataatttcaacatctcttattaagtattttttgacagtataccgaagactagaaaaacatgaatatcattctctcagctgctcctttactgcaatgaatataattgatgacattacaaattgttatcaactcttaaatatttggtatattcgaatttatctttatcttccatcatcaaaataaccttcttcaaatatcacttcctaaatccctccaacattgtgatattacttaagtcatgctaaaatctatttatattaatattatatctgtctctataatcccttctttttagaaaatgtaatgagaattctcattaaatcttaacccttttatgaaatgtgtttagagcaacacttgaatgttcatcaagcatcttcataaagttmattgaaatactttgttttcatatttaaatatttgtggggacatagaacatactggggtcttttttgtttttgtttgtttgttttgcaacctcctcagtttctttaagagagtgggagtcagcttacccacctgtctaggacagtggttctcaaatgtagtccctggcccagcagcatccacagctcttgggatattgttagaaatgttccactgaccaaatcacaattctggagaggggcaggggccaagtctatattttaaaacaccctctagacagttctgatgcatgttaaagtgtgtgaacctctgtgctagtccagatgaacaatactacccatactttaatgtgcacacaagtcatattggtgaattatttattttgaaataattaaacatcaaatattaagacaatccttaactttttacaataatttttagaccctgcttaaattattatttaccactgaagagttttgcattattactgcaaagatattaggaaagtattgttatctgtattacaaggttatagaaagatcgatacatatggctagtgttaaatataaagtaaccttggtactacctgcatataatgcttacctactatgtcagttttgctccaaatgtaacatgaagactctgcaaagtttcacagagaaatgaaaacagtttcaaaagtcactgtatgtatatttttataaacattcttataattattttaagctgtatattagattattgtttaggaacataaagtttagtgacgtatataacctcagtattgtacsatttatgtttgtatgtattgttgagaactgcttggctcatgtaatattgtttcattgtcaaagaaacccatttgactcatttttttatcagactttttcagcccattgtgttatgtgtctttcaacatgttttgagccattgatcgtgcatgcattttgtctgtaagaggtatcagaagcataataaatgcctacacttgagaagcatgcattctagtaggagagacaagaaggrgtatttctttcactgataaacaaagtgatttttatactatgtttctctaacaagtgaaacattagagcatgaaataaaaataccccatttctctagtatgcagttttatgcagtttgggacagaattggcttcatctgtttgatatagaaagaagaagttggggtagagagatagaaaaaacctcttcctgtaaattaattggttcatctccttcatcatagcaggaaaaaattttatatatatatgatgtatattcacacagacatatatatatatggatctaaatattcccttcagattctgttaatatcatgcccatatcggcatattttgggaatatgcagccatccatttaaaaaacacattaacttgaaatgattaagaattatagcatgactagtatgagaaacattctatttagaatagaaaaagtcaaaactcagtgccaatgagaagtgagaaaacatccttaaacaattacctacaagttttcacagattttctcgccaaatctgcataccctcatttagatgaatttgttctctctgtcctrtaccagctagatcaaagrggaagcctgggaagcctattttgatgaaaaaattattacttttacatagataccgtgaaattatttggtaattagtctgcttatttcattggttaatagtttgtggcctttatatttatttagggctaattgcttgatattagaagtacatacttaaatcaagaaaaatgataatgacaccaattcttaatgcagtatattaacactactccctcagtctatctaggaaagccattaaatattatgttgcattcttcccaggatgtgatcgcttagacctaagatcgctattttaaagtattataatattttgcaatgaatgtgttatctatgtcagcaaatatgagatatttaatcttatatttacagctttgttaaaaaaaagtaagtcttgtattagtggcaaagtacatcatttaagaagcactttagtatggtggaaaaaaaagccagacataattgatatccttcagctgtcatcctctctataaaacttttattattgcccagaattgaaagcaagtttattgccaaatatatcaaaccagtgataaggcacagaaattgttttatttgctattttgtaaaactggacctcaatgaagtctactaccaatcaactaaatacttatttctgtatgtcacctccaaactgagggcaaaactaagtcttagcattagtatacacctagtaaatgatacgtgggtatgtaatatatgttttttaaagaagccatggttaaatgacatccaagaatgttttgggtccttggttaaaaacactccagttttgttttttgaagaagaggatggcagtagtagccctggaaaacctgaagaagtcactgagcaagccatgatgttgtgaagtagcataacggattttaattagagttgttaatttacagggcacccaggatgtcaatacasatgacttaagggagcaaagatggttctggcaccaccaagaacctttctcctgaagtaactagccaacctggaaaaagtctccctcagttggaagaaagctatttgagaaaataacattttggaacaaagcctgtttttcatactcactctataagaacatatattaaaaatagatgttcaaaaacaattttatttaaataattaacatacaatgagaggtgtacctgttataatttaaaatattattattaaaagaatcatttctcttcattcatctagaagggtgatagtatttttatctctacccgttgaccatgttttgaaatttgaacttgatacgtaatggttactgagtagaatgaataatccataaggcagtctaaagaagcagtttctttctactaagtatttaaaatataggaccctcacagagttgttcactttgtttgtagttaattgcttcatttatttcttaagccatgacaaagacagcatcctttatacaaagtgatagcagcagatttgctctgtggtacttcacaaacattatgcttccaagaggacatttaagaaaatctactgggaaaaatttgtcctgatgacttctagaattgagtataacgtattgtttcctttacttgaaaaaatttgagagataaaatgccattttttatgagtttgtatttattttgcattcttggttttttttkgtttgtttgttttgttttgttttttkttttttgagacggtctcgctcggagtgcagtggcgccatctcagctcactgcaacctccgcctcccaggttcaagggattcccctgcctcagcctcccgagtagctgcgactacaggcgtgtgccaccacgcccggctacttttttgttttttagtagagacggggtttcagcatgttggtcagaatggtcttgatcctctgacctcttgatcctcccgcctcgacctcccaaagtgctgggattacaggtgtcagccaccctgcccggccttcttttgccttcttgtcagttagaagctcggattaccactagagggcactatttctctctgttatccaagttttgatgcaccgggaattgaattaggaacaaatcaccaaaaagggggaaatactcatttgtgaagtgctaaagaagyaatatttttcacaaaaacgaaaatacaaacctttgcaaatattattttacaaatgattgatgcaaatgaaatatatttaaatgtaaaatattcagaaaagagttcaactattttattttggtttcagctatagctacagaattatattgaagagatatatgtgcatattatcatatataaaatcaacagaagagcaaagtaaaatrgctaatggaaatataaaaagaaaagaaaattttctaacatgtcacatttagactataaaataattaaatatttatgacatgtggtatttaatatttgtaatttcagggaccacctgggaaggatgggctgccaggacaccctgggcaacgtggggagactgtaagtgaccttgttactcttattaaaaatttccatctctagcacctcatcagttcatacatagaaagctactttattatgaacatttcaattactaggttgagaaaaatggaaaaattaattccattaagccttttattgaaatayayatatatatataaatacaaaaatagatacaagaaatatacttcaggaaataggatgttagttgatatgattgtttttattgtcaatagcagcattttaaggatgagctgatggagaagacaccattattttttggacatctcctcaagattttccctctcactcttttcactgaagactgtttatagatacattccactyaaacccatcatctctccactctaaaggcaacagattacgaatagccatgatcataataccacattcttttatctagaactaagggattaaatacttgctgatattggacccatcggctataactggttgggaactatgtcaaaagcatctttccatgtgaaataggaaaaagtaaatcaaaaacggtcactaaattttacttaaaacctataaagaatataacagtaaacaaattgactgaacaacttaccatgtgtataacaatttgggcagagaggaaactggcagctcagtgatggtttaagaatcctggtgagtttatttattttgcccctttcaaaatcagacatctggctatcccagtggattgtcattctaatcagaaatcatcatggattggcatatttccatggaatcaattcttgyttctcaccaatgattacttttatccagacttctcaaggaaaccacaaatgcagactacctttgactatgtggttgaaaatcatgttagggtagggggcacyctgaatacatattggagttgcatagcaatgtactataataaatctgaaatctgaaaaaaatatgatttttctgctatggaggaaacaatttgtcagcagccacccaattttgccttgcttaccatgtggcaattcttagtttcaccatttcttagttttagccagatgagaaactttggagtcttggatttcaaaagcaaaattgaaatatgatttagtgagacaaaagaaaaaactgtttggatatcctcttgggaaagatatctgtatgaggagcagaaataaactttctaaaggagagtcaacactcaatttgcaaatgcattatcattcaaatctttcagccaaatcatttttaatgaagtcattgtataactttctgggaataactatagaatattccaaaatgtcttgtggggaaaggataccyagagaattactgttataaagtcctttatgtctatgatttaatctggagcttccacttctaacaaaaataattatatcacatataacattgagatttaaacatagaagaaaaacagcataatgtttctwgaatgaatgtttctgttttgtagcttttcacagataaaagccaggattatttctgaaaaaattatattcccgatttcacatccactttaagggaatagtgaatcgtcctatagcctcaaagctttctttctcactttgttctctgctgacccagattcaaaggatcaccttgtacaggagtcacaatctagagtgggcattctttgccatatatttattatcttatttaaatggataaatttttgaattatatttgagatttgtctccagccagaaatccattaattaaatgtttgttctgacatcttacattcatttgggttgtttcagtatratagaaactattcccaatttttcctggtggccttaaacagcttcagaaatggtttctattatattgaaatgacccaaatttgtctcagaaacatagtgccaaatgctgtattggtcctaaaattggcttagtcttttaaagattatcagaataggaatcacatttctgttggattgtaacagcatatttttcaaactacccatgaatatgtccaattaatttccattttcagcaactttgaaaaacataatttgactagctactctgaaattaagtggcaagtgtagtcttattacatgacaatattgaacaagcacaacttgttgtgaactgtaaaagttttcctgtgtagtttgtttgtaagatccccaagatcaaatgtattagatacttgcaaacactctgaatggattgaatgagcagacatatgggcaatgctgtcttccagctttcccaaatccatcactcacacaaatgggctagcagccaagacttcctctctccccttaggatgtatgagtgcaagtctatgttgtaattttgtcgagactttctgcaattaagtattgatttttaatctattacatttaattattattgcaatattttgtgtgtgattcttgctctcacagttagtaagacaaaatgctttataagacttttttaaaaagtttggaattgcctttatatcttcctgttgaatttaatgattaaaaattggaggaagaataacccagacagaggaaacaggtcatacaaatatatggtgtgtggctattcagaaaaaggtaggaagatcagcatggctagaatttaggatacattatcaaagcaaaggaagtaactgaatttgcatactgggcccctattggctagaactttgtcatctatatgtttaaaaatgaatttattggctgggcgtggtggctcacgcctgtaatcccagcactttgggaggccgaggcsggcggatcacgaagtcaggagatcgagaccatcctttctaacacggtgaaaccccgtctctactaaaactacaaaaaattagccgggcttggtggcgggygcctgtagtcccagctactctggaggctgaagcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaraagawtttattatgtttggttttgtgggtgatgattctgcctaatgtaaacaagttagtaaaccttatttgaaaactcaacaatggtgaaggaaagagrtgattatagtttgaataagacaggtctacyaggataagagagaagaagctgtatttgagggaccttctcacgtgacacattcagataaaataactgattaagcatgggcactgaagaaaagtctggaatctgaagacacgccattaaaaaggggaagaacatagaaggaaaatcaaaggagaagatacattcagcaagttccatgttaggaatgttgaagagagagcatgatatacaactggaaatttctagtaggcacttactgagmgagttttagggctcatactgattagaggtttataaatagttgggaatggaggagttcatcagcatagagatggcaattgtggtgatggaggttgttgagataatccagggacacacatacacatatgcacacatgtatatatgtgtttaggtatststgtatgtgtgtatgtaaatctgacaacagatttccaaaccaactggttgatgaaaaaattaagcgactaatatgcttataaaatgctaaataaattttatgacatttccccccagaaatgattgcttttgctattcataatgatagctcaaatagaaccctgaaagtctgaattaatagatttttaaaatagaactctattttctttccctgtagcatcaattgcaataattacagactctttacctacttatacaattttattattgtaaataattcattcatagttattgggaacattgtgatactaacgtgagactgctagttcctacccattttttttctaatcttattattttcagtctgaccagatgttgtagggaataaaatattcagttctttcgaaacttctccyaatattttctatctacttctccagctgttaaaagtaacttaactctcatgggtaagaaatttacctatattcacacaattatgtggaatgaataacccacagcctagagaaaaataaataccagaatatatgcccagaagttttatttagtgagtatattctgctcaaatcaaccagatgatattttaatgactgaattattttcaaaatgcatttatgactatatctcttgagtttcttacaagaaagaatattgataaacgctaaaataattactaactatgcaaagcattattttagtagatctatttttatatcttgttttatgagatttttggaatacaayagagagaaatgtattaatatcacaggctgtgaatttacctttgtataaacaatcagtaaactgtttcaaagaatgtctaaatcatcatttacttcatccataaacattactgggttaaaattctgtatgttgtttgacctagtggaatggggctaagaacacatttttactctagcttcatttattaaaggtaattattgccctaccatgtgaaatattgaaatggcaagttttgaattttaatgaaaactgaaataagtttaacatattaaacatatttaagcatwtgaaaataaatatttttagtcaataggtgactttcttttaatgtgacttattcagctatctcatagaattttgatttatgctttrtgttgtatgtagcttttacaaataatactttgcctccttagggatttcaaggcaagaccggccctcctgggccagggggagtggttggaccacaggtatgttcctttgctttatttcccaagcaagatttattttttgtttacattttaaccttcctaagttgtgtaaaatcttctaaatttattatgattcaaaatgatgtattttttatttcagattgcatttaaatatatgcagctttcgtacatcaaatgaaaccaacaaactattacctaactaaagcaacttttcaattgcctgtaagaataaaagagaagaataaaataaatgaaagtaaatcagaaagttcacactgaatttaacactaaagcctgactatgacaccatctactaataaaaatacaaagttctttgtaaataggtgggccattatctttttctagaattttaaattataaaatgacttcatggttttgagtataaattagatttagaaatatacattctaaaattttaatatttgtaacatattaggtgtttcttaagatttttgccttcataataatgaatatcagaaataaaatattaattatctttgaggatatacaaaatagtggaaaagacaagtatttatttcaagataggtggcagaagaagtctcaaaaattggtgcagtatcctgagttatagtataaaataactacaaagagtaattcatggtaatagaaaataatgtttttcttccctggcaaagcatattgaatgggcagaacacatttagtttctggactggaatttagcccctgctaataccaaattataacaaaggagcaaaagcaggtgaatacgtattttaattatttaattggtttagtcttttctctgtctctaaatagttctcaacactgtaactcacacacatacacacacacatgcgcacacggacacacacatgcacatccaaacacayacacacacacacacacacacacacccctagagaaacaacaaaactgcatcttgtttttaggaatatgtataacagaagcaaaaatgaagaatcattggatttattgattattttatttcagaggttaaccctgaggcaagggaaatacgatgttattttatagagtgtgtaaacrtgactacttacttgtgctgaaggcttctttttaactgcttatcagttttagttaraacattatatatactttctcagtaattagaaagcttcctccaaaaatactttcatttttcctgtttaaaacaactttataactattttctgtgagaaaatttaactagaaaaattattcctattatacttaatatccataaacagaaatggaattagactcttaactaaaatataaacatcatggaatgtaactaaatattttaggacctcacatctttcaaaaatacaattctgktcaatgtggkcatctaaaacttctgagacttgtgttcttttttcgttcccctctttacatgaaggcataaaaatactggtgttttactgaagatgcaccttccttgaattacattttttattggtcctttttaagagaaaaaaaaccaacagcctattttaaatgtagccatactttcatgtgaagacaaaagatttggtttaatgggaataatatagattgcaatactgaatatgcacccttttctttaaacagttatgtgaatctctgatcatttttgtctcrgtgatmgctgttcaattatggttaattctgtattccttactgttcaaattctggtgttcagayagttaagaaaacatcatgttttggataaatgtttacacattaatgttaagttgagaaattacagcaattgtataattaaagaaatttaaacctagaaatgtatacccaaattgggacaggtgtataccttatccaagataaatagttaagamtatgttgcatttttaggaaaaaaatatttatacttcataagcaagtgcaggaacacattctsctgtttaacaaccttagcatctaaaaattttctctttgtttaacttaaacccttcattttgctttttattaagatagagagcaactgatcaccatcctctatttatacatgaaagcctgctatactcaagcaccacaaaacagcaccactcaggggacacgtaaatgacctgatattgttcactttggcatttgctgcaatttaaggcagctgaccatttgttacagcctttggccgagaggaactgctgacccatactcactgccttcaggatcccatgccacattccctagactttgtcaaatgaatatagattaatagtagagaaattttcagtccatggaaattccagggagaaccactggctttttgggttctcatggccctaagtttattttcaagcagtgattcattgagtggctaccaatgtggtttctatgcctctttactactaagctgatttgacacctcatatgaaaagaaggaatgggataaaactgtaattaaaaatcatagttttcataatacttggactggccacactctgcagaaattattgtattaagcaaagaaaacatctttttgractttatttatgtactttccttttacactcagattctaacsaagattatataaaatctttttagactcttacttgatatgctactttcagtgctttatgtgaagtgttttgtaggacatcatgagaataagtgaggatgataaacttttrtaaatgtaataataytgtttttgagtttgtgttatctttgccaaaaataaaagagcaatctaaagtgattttgcttatctaatttagggaccaaccggtgagactggtccaataggggaacgtgggyatcctggycctcctggccctcctggtgagcaaggtcttcctggtgctgcaggaaaagaaggtgcaaaggtacaacatgctycagaaaactttttttggcccaaaactttaatttatgtttaactataytcaccycttgtctacagattccatttaaatgaatgtcagaagatgtgtcaggaaaatatttaatgtgcgtttattgtactccaagatattgctcaacatttatataagaccgttagctccgttgaccataaaatctttaatatatatgtaacgtwaaatgtaggtagtgggtagttcattttaatgcatatggcattccacccaatattctcatcattaaataatattcacattttacttacagtagtttagaggtaatcacaattttgtttgtagaaagatrtgtagaaattaatctgtcttgwcgatgtttattatattctttagggtgatccaggtcctcaaggtatctcagggaaagatggaccagcaggattacgtggtttcccaggggaaagaggtcttcctggagctcaggtataatcaatatctatatagataaagcaagtgattccaattgtttattagaagcattttttctcagaacttaagaagtgatgattaagggaagatatataaacatatatatttgattatcattacatatatgtgtatatatgtagttatgtctataaacattacctgacatccttattttactaatcagatatctcctcctattggtattcaattcatatggattcattttctttatttttttcacttttcccagggtgcacctggactgaaaggaggggaaggtccccagggcccaccaggtccagttgtaagtatgatgatrataaatagccagacaatcatggttgygaattacagctcttctttcattactctcatgctgtgattccacagtgtgtgggagagaaaataaacacatgtcaatcaaatcagtcaatgcctagttcccactaattgcatgcactaatgaatgcagaaacagaagggtttggatgattggaaatatttgcttctgctgctgtcaggaggtaaaaggagatatcttgcttcttacggttcccaaggaaataaatcctcattatgartaatagaagctcatagtcacggaatgcctggagaggctgtagtttgaaatttttacttcatttacatctattattttagaagtacttataaaataagatttgatttcttataaattatattctatcattcatttaytataaaacatatttaatttgtttataagtacttgatgagamttgaatttgtcaatgatacaaaaaacataagcataaaagcataaaacccataagcacaatcttatatattatgcatattgctttatttaatcaaaacattatgaaataattggcaaattagtaaatatcagatttttacctcatttttttcttgagatacatatcaatccctcagaaaacaattgaatgtatgcttcattttttaataaattcacctttattcttatctgcacactgaaatttcactataacagccaaactgccatatttagtgtcttcttctcattttcttatttcaccaatctaaaaagctgaaagttgccttaaaggccctctcaacttcctttcacacaatattcattagttttgcttccaaaatattttactaatttttccgctttcttcatttctaccaccaccattttgttcagactctttcctcttcctttctctttgactaataacatcttatcttttgattcattttcttatccccttcagtcagtttcacctatagaatactagtttaacatacatccttaactatggcattcctctatcatacccatcctatagttccacactgcctttggaaaccaagctccttatcctagccagcaagtcatcttcatagttcaaccccaattgctatagtcctttttttttcccttcatgcctcccttttaattctacccaacttaatgcattgaatgttgtcttgcttctcaaaaccatgaccttttctattttgagaagagtatactgtacacctttcccctttctccaggaaactccagtttttctttctctacttgacaaagatcctacccaaccataaagataactcttaaatgttaaatctctataaagtcatctttggataatttgcctccatttcatgtatttgtaaaaattcccccccccacacacacccagtgacctttattatatctccatttttagaaattacattggaatatagttggctgtctctcgcattaggctgtgagttaccagtattattttggttactcamaatacggtgcctgaagcacagtaatcatctcacacttacccatttgaattattatgaatacctaatattggaataaattttatatagcattacttaatactgggaatacaacaagtgtatcatttttcagattgattcacatgatacttactctttacttcactcacatcatataacaaccattgacataattatggaaatgtggcaaagatattttttaaagaaaatatattttgataactgtattagacttacactggagttcataaaattatgaacattttctaatgtcctcaaaagttagtgacagtagcattagcagcaacaacaacttaataagacaaaagttcttatttagatatagaatcttctaaaatttcagtaaaatgcaatccatttaaccagaccttcagattctaaagatatcttctaggaataaatgatgttttaagaaaaatgcacactgaactaatcatctgagctgtgactataaggattaaattgttttaagttattttttaggaaccaagcactgaagctctctcaagggttgggaacagttgaaaccagtgtatttgtaggctgcatactatgtccaggggatacaattttcaaaatgttaattgaaatatgtatagttacatgtagaataacattaaatgtacttttatttatttggcttcaactgtgtatttgagaattattacttactttgwtatatgcaactgaacatcacagtagatattctttgagataaaataggataaacaattttgaaaagaaatacaccaaagactaaatagcactgtaagttggttggtgattaaatgcctaatgacatacaaacaataaatgttaattctatgagggaggtagaaagagaatataaataaggggaagggccatgtggaaaaggtgaccctcgaacttggcttcacagagtgcagaagattacaaaatcgttgaagagcgagaaaataytaggaaagagatgtgatgtttaattagtatctgtttttgcccaagtgggacaaaatttgggagatggactaacatttgttgaattcttgctagcatctaagcactctgctattttacataataaaaaactaaatcactaatacaacatrtaattactgaagctctgaaattgcaagatgtagtcatttgaatatttgaaatgtacagaacaagtggagtaaacaaattgaagttttaagaaaacaaatctgtcattaatgtttaatatctaacagagataggagagaatagatcacaaaagtccagtgaccaatgtcaacattggagtgagccgatgacttgggcaacgtggaatccaaggacaytgcagatgtagcaaacacggagggggcgaggtagtaggatttatgactaagatttgatgtgggcagtgaggacaaatgaaaactgaacaatgacctcaagcttatgtccttgagagaatgacagtttggtgacgccttccatgcctagagcaattttacctcatcaagagcaagaacaaacaaaaaccagaaatattcacacacaaaaacttttaaaacctcttggcagtcacaaaaaattacaaaggattttatactttgctaatagatatgcttgatagatgctcactgtgtttatttgaaattaataaccattcttatatttgcaaatcaaatatgcaaacatcaaccaattaaaattattccttaaagttgttggaaaaggattcactaaaaggaagacaccatacacatttattagttcctaacactattgttttaattgctgcagaatctagtgaagcggtgcatgatgatgactcagttcataacaagtgctgagcgagccttagtttactccatttaaagtgattacatcacataaaatttgattttgaattttttaattccaaatgacagataaaacaaaaactggatggttttctagatgtgaagtataatttatctagaaaattaataatgtcaattcttattttttgaggttcaaaacttactatgagtttcccttgcaattaatattgaaaaaaaaaagaatcaggagtagggatttctttaaaaggtaacaagttctgctttgcaatgttaatagaaaaggtgatggcaaaatattaaaggggaagtatttgatcagttggtgagaaatgataaaattctgagtcataaggaataaaggcataagaacatcttctaaaaattcattttataatgtatatgtctgagtttatatcaatcttatgttaactttacctttagaatattgaccaaataattgtaagtgcaagacaggaattcacagaaacagagtgatgagtattcagyggttatttgtattaaggaaaaagcaaagcaaagtgatgagttctgaggaagagaatgtgaagtctaaaggaaatagaaaagggaaatgaagtaatattgagtgtttattctttcaactcttatgctaggtattttatatctgttattcttattcttgcaacttggaatggtagattttttttttctattttaccattccatatttaaagacaaaagatctgaggcttgaagaagtatagagcttgcccaaattatctgggcaaatatccatgatagcactttacataaactcattttcaagtcatcttgacccttctaaatctctgtgaacaattttgtcaaaagagagtgagaagagttagtatttcaactacctaggctttaatattactacatattctctataactattgcttattttgaatgaatcgaagatgaaactgattaaactaatatacaggttgattttttaatgacaagatgtttgtcagaatgccattgaactcttagtttctttcacctataatgcaattcataaggaatgtagttgtgctgtgtatttctggattgctagggaaataataaattccctcattgcacaggatactgatgaactaaaactaaaagtcctaagcagagctttaatcagctaaccttattgctcacagtgatatttgcaaagtttgtatgtgtcccaattatgtagcttatgcactatatccttactatatgactctaatctgcaaaaagaacaaatataatatttaattctaatrtatccattcaagtgttctatctrttcatttataagtatatttagcatctattctctttatttataatccatttagtctgaarcataggtcgttattatgacactccatagaagtggatttactgtactcakgtaggtctaggtgtatgtcattgacttatatttagagraactttatttgtaaaacaaataaactaaaaaaatctgtttgaagatatgggatattgctttatacagggtcatctttatgaatatccttggaagaaatctcttgckaaccatagctttaaaaatatttgcaatttctttttttcaagtatgctttttatagaatatttaaaatttttttaaatattaactgacttggttttttttttagtcagtttgaattacaaaacttagaattcttttcactttggcttacagaaataatggagtcaaaatagagacggtacagaagataatgtttgataactattgtaaaaactttttgaacacaacttactatcaaaagtacctatgatatacwttaatattttctattatattttgttatagttaatatttttaaatactgggcaagacctgtgaaatttacctcataacctactcatggagcataacctacagttagaaaaatccttggtcttggtatgcatttttagtttactactactactggctccattttacttcaataaaaagttatttgcttacctgttttccttgcttacctattttaaaatttatattgtctaatattttatgcatactatttaagctgctataagtctttttctgtgaaagtaccataaagaaataaataccagaaaatatcagacaatctattaaactgaagttatattgattcataaaatggaccttcctgcaaagagcttatggtttactgaggaggacaaagagcagataaaataacatagtaaataataagaatatactaaaagaacagaaaacacaaaggtgagaacaatgttttttgcctaaggaaattatgtttgaattgaagctgtaaataaaaaccagttttatctatgaaaagcagcctttttgtgtgctaaatttagtcttgaactgctcatcactttttgtcctcttagtaaagaactagtatttcaaggttagggttatctaaaggttttggtcctgggagttattgtatactgaggaacgttctgtcgtgctaccacttatgacaaaattataccaatagggtgctgtgacgttgggattttaaagtctaggaaaaccaagtgttccctgtatacgtgatgttgtatccaagaactggtaacagatgccaatcaaatccagggcatgtcttctgatctcaggggatgtagtcactaaatggatgtcttgatgcacacacaaggcagaaagtagcaagagactgaayatcaagagagtaaggcagtgcagcatttttctgcatgatgaatataaactgrgtaaatgttttctatgtatgtaaacagatatatgtaaatatatcatgcaacaaattctcagatttcacctactgcatatattttyataaaacaaaatcaaggaaaataatatttagggaaaatatattttccctaaataatctctcctccagatattctttatggtagagaacaatctcattaacaacagttatttatctaaaaatgagattaaaacaaatatagtagtatgttttgtaaaagccttctatctttacaatcacatgtatattttatccctaggagttgtggaagttaacatgcagaaagtatatgagaggagccagatagctggtacagartatatgtccaatatttcaaaattgtgcggtatagcagtctttgctgttttcctgtgactcctattatgtgaccatccccccatgattctgactttattttcctctttatttattatttcttcttcttctcttgcttctctaagagttcacattctcttcctatcataattccyattcctcttatttttttttcttcatcctatttctgagaaccttcttttccttggcttttacttattcttcmagcaagggaataaccaaggtttaaaaggatgtcatgtaccgacatgccaagtcagactctatacattttaagataaagtccattttctccattgtgamccaggtagaccttagtggactatgattacawccaactagggatgagataaatgtagcaatagtgatggggaccagtgatcaaaatctgaggtatttgatttgactttgatcatcagagtctatgctttaaattctgataatgcttgatagttcatctgaatttttagttcacgtaatctaaaatgtatgtcatgtagagagtgaaagtacttcatagttttgacatgaaggtcaacttcttttttttttttttttatttcaagagggagtttcgctcttgtcgcccagtctggaatgcagtgacgcaatctcrcctcactgcaacctccgcctcctaggttcaagtgattctcctgtctcagcctcccgagtagctgggattgcaggcacccaccaccaacccggataatttttgtatttttcgtagaaacggggtttcactatattggccaggctggtctygggcttctgacctcaggtgatccacccgcttcggcctcccaaagtgttgggattacaggcgtgagccaaggtgcctggctgaaggtcaactttttaaaaagacagagcagacgtgtttttgccctctagttgtatagctctggttygtaagcactttatgtgtttatgcttctatttttctctctagtgggcggcatcttaactgaatgctgatgaggtgatttgtctatcactttcatttactttacaaatgctcctcaraatatgaaacatccagtgaaaataactgataaaacatttattttggtgttctcatctgtgtgagggattaggggaatactttctattctcattgctccaggaatatagaccaatgctattgcttcttgtttcattatcattgtaagttttagatgaaggtgcagcaggatttaggggaagggctgcagaaggggataaagctaatacacaagtaaagaaaggtaactaagtagagaaaggtaaattcttcccttttaaaagcatgtaaatgttcacttttcagttcaaaacaagagaaaaatggcatgttttccatagttgttaatatttagtaccgaaataacagaacacttatgatattatggtcattgtaattcatgaaattaaacagatattattgcctttgggaaacatgtttttattgtcatttaaatcacatattaagaaaataatattgctataatttttagtccctcctttgagttctttctagctaagcactttcaatgtgtaaaatatctatccttcttacagagagacaagtatacaaatagttaaaagttaggattaacaatgccatattaatggtggaaaaagccctacccttcttttaacagggtattttatacctgttgttttgatattcatttattaatgtattaaatatgccatataattttctggatcttagtttactttyctgtaaaattttacttctacaaykatttgagattttatatctatttttggaatatataactgttcacttacagtcctctaacatctattacatttatactttttgacaggcattgttcaaagaactttagttatattaaayatgactaaaacctgatgacaaactatttctgtctctattatgacaggcattgttgaaataactttagatgtatcatagtaaacatgacaaaaacctgatgacaaactatttctctccatctatggcaacaaaagtggcccatagagagtttgctccagatcagaaagctagtggttccagtgctagagagggaaagatcatacacttaattgacacacttatttatggcatactrtgtgccagtaactactcaaactgctggagatcattgaaaaaagaaaaaaaaagaaaaatcaaaaacctctacctttgtgaagttgatcattatctattttacctatgcttaaagacaatcattcagtttagatataatagtttatttatctgacaattataaagtcccttgttctttagccagctatacagcaatacaaaaatgtctcactatatatgcctactctttatgcaaacaaaaaaagtatatacacaatgtgagtttctcaagggctgcttcctgccataatacatttcatattcacaatcaagtgtcccaagagaatagattctcattagtgttgaacatggagtttttagttgaatgtctaaatggtaccttcttttcatattgggcttaaatttttgcttaaaaaatataacttctccagtgattctgttgagattaaaggattcataggcttattcttttaaagttggcatgagaatatttaaataagatttgcaagtttgctatgtcatttgcttaatgggtaggtaccatcagagattttcacttttcatttatagatatataaaataaaattatagcagagcatgctgttattacaaayatctaggctttgagagtgtttgaagtaactaatagaaaaagaaattgcagttgtactttagggcatggatatacattccaaaagtcttctcttgttttcatctgttgtttcaaagtttatgagctgtgacaagatcatgagcaatattttaactacagaaaagtaatatmttctckacactaattttaatgcagcttccacaagcaagatgacaatctgaaatttaatcttatgaatgctccaagggagaaattaaaacagttaagcttttaaataaaaaatagtatacagtatctggctgggcacggtggctcacacctgtaattccagcactttgggaggccaagacaggtggatcacgaggtcaagagatcgagaccatcctggccaacatggtgaaaccctgtctctrctaaaaatacaaaaattacctggacgtggtggcgggtgcctgtagtctctgctactcagaaggctaaggcaggagaatcgtttgaacctgggaggtggaggttgcagtgagccaagatcgcaccactgcacttcagcctggtgacagagcaagactccatctcaaaaaaaaatagtatacagtatctacaaactacacacattgccatagagtcaaatcagcattctgtctcttcttgatataygttaaaataattattaaaatatttcaattaattttaaataataaacatacttcggtataaatttaataagcattattttcataagtaaaagccatggcttactttcatataacatgtcaatcataatgcatccagttaaggtaatatttattttctttcattttgaaaccatttcttacagggaaaatatacattcaatagcaattttcctgcaaatttgaaaaatttctcttgactacatgtgtgtacatttgaagcctaatttttattttattttattttattttatttttttaagacggagtctggctccgttgcccaggctctggagtgcagtggcgcgatatcggctcactgcaagctccacctcccggattcacgctattctcstgcctcagcctcccgagtagctgggwctatcacctaccacctgccaccacacccggctaattttttgtgtttttagtagagacgccaccacgcccagctaatttattgtatttggtagagacagggtttcaccgtgttagccaggatggtctcaatctcctgacctcgtgatccgcccgccttggcctcccaaagtgctgggattacaggtgtgagccaccactcccggcgtgacgcctaaatttttaacatgttcaacatgtttgcatacataataaaaacacaaatgcattatagttatttaatgcatacagtcaatatattattgtttgttaatatgaattaagagacatggagatatttactactcagaatgtagtgccaagtgctgcattaattcactccaaaaataatggtagaaaaccaaggttctataagaaagtgtataagaaatactttgaaggatctcatgcttctaattctcaggaaaatacaattttttggtaagatggyatatcagtccattttcgtgctgctataaagaactgcccgagactagataatttataaaggaaagaggtttaattgactcacagtacagcacggctggggaagcctcgggaaacttacaatcatggtggaaggcaaaggggaagcaaggcaccttcttcacaagtaagcaggaagaagtgcckagcaaarggggaagagccccttataaaccatcagatcscataagaactcactcattgtcaggagaacagcatgggggaaactgacctcatgattccattgtcttcacttaatctctcccttgacaggtggggataatgaggattatggaggttataaagcaagatgagatttgggtggggacacaaagcctaagcatatcagatggttattgacctgggtcaaaaaaaagaggctggaattttagtagtataggaaaagaccaaagactttccatgtcagaagataagtgtgaccaaatattcagaagtgaaaattggacatattgtgttagagagacagtgagagatgtaatattttaggataaaataatgttcaaagtagaatgctaagatataaagtaaaaaaaaaattctaagaatgtgagttgaatattttctaggatgactgaggataaatatattctcaaaaagatgcattaacccacactatttcagagttcagcataggtgaactctgaaataaggagtgaaggcagatgaaaaagtaccatggtgtctccagtgaaatgtgttgaaaaattaccaaaagtgaaaacgtcctttgttgttgaaaattwcaaataaacttataaacaatatgacaaagagcagagacttcttttttctttcgagacagagtcctgctctgtcacctaggctggagtgcagcagtataatcacagctcactgcagccttgacctccctgggctcaggtgaccctcctgtcctgagtagctgactataggtgcatgccactacacccagataatttttgtatttttattagagagggggtttcaccatgttatccaggtcttgaactcctggcctcaagcaatctgcccaccttggcctcccaaagtgctgagattacaggcatgagacacagtgcccagccaagagcagagattctaatgaattgtgtatcaaaggtcaaatgaactgaatgaatgatggagaatgattatttggataaaggagacaagcattttcatcaattcctttamgttttttgtttgttttacacaatgttcaaccaaaatgagcttgttttggtagaagtggctcttaagtggctatatttcttccatttattaaaatttagcacaattcattgtacccatgagttgtatgggtacaatgagtcaaggaaattttgttttcaccatttataaactgctaagcrttgtagaaaatacttggtagtgaattagggcacacagaccttgagtccatggtttttaacttaaaaatatacaagtcatacagcaataaaattatattgcatatgcaaagcacttagcacaataattgttaattagtaggtataataattgtaagtcagttaattctcttaaaatggacttcaaacttttgttgattctccctttttcattctagtctagtacccatcaacttcgccatagcctagtgtgatatcttcctagggtattctttgaamagttagggtttaaacaggattaaagagagaaaaattttatggcccgacaaattaaaatcgcacctctttttgtatagccaattacaaataaaatactgcagaagttaaattgaatgcttattctagatttgataaaactaatggatagcaatcattttgtgagggttagaagtgaaatactaaacaaaattgtaatatagtcaccttatatgtacattgatcctcaataaatcagtgtttcagattagtggagatttatctttagtggtattaattttaacttgagtagaataaccctagttgcatcatgtgttgtcttctgttgatgtgtttctgttaccaaaaaaggagcacttttattactgacttttttcttttctctctttttagtaattcaagggacacctttgcattcctctcaattcatagaccttgctcttcttgctcttcttcttatccacctcctatacttttttcttccttcctgacctccctctcaaagaattagaggcaaatatttgtgttctttttactcttagggttgctcattttgaatgtgcaacagtaggaggattctattattttttctactgcattgacttctataatcattcaacaggagtctgttacctggttaacagtaatacaacttgtggttgactattttattcataaaatattttaatattattaaattaaaaaatacattgatgaaaragtatatgtttattatcaaaaaagtactaactgcaattttctcttataactatagcctcctctttagtatttggaatacttcattggtaaaaatagagtttacatacaactcatttattatgcaatataagaatattccctagattagtttttgaatatatacttactcacagctcaaaaatgccacttttrtttatataaagctcaaatttcacaatttycttaattatatttttggcaatgtctctccaaattatttctatcaactaactttaagatacccaataattacaaacattgatgtcctcattagaaagaaccaatgggtggctttgtcaagaaatcagagtagagtccaagctcagggttctcttaactagttatatgattacaggaaggacggttaacttctttgagccagagattcttcatttttaaaacagatgctacaacagctctataaactacctggaattgttgtgagaataaaataagatgaaagttaaactgatttgtgaattgtaaagcattatgttaatacaagttgttggtatagttaccatttttatcacatgtaattagtttcctggttaataaaaatacaaattagaacaaagtcaataatgtaaatttgtataataaaatgatttctaatatatcattaagtataatagtagaaaacataaagtartatattttccagcttttataaataattttctctgagttttgaaatgatgatgttatctaagtatgttaattattaagaaaaaatactaacaattatattttctaatattttacatttagtttaaacataaaataaaaagataaattgtaattcaatcacccctctgagaatccaaagacaattttttgttatcttttagtaactaaaattggaagtagaaatagattatacttgagctttacaatacttagtatgtatgtttgcatttcttttattcttgttttaataatgttttcttaaattgttggtacagataattactataaaagcagtatccatgtgattattttcaaaaatctatatatatgaggttttttaaaaaagmaaactagttaaaagcattacatcttttttgaaactcagttaaaaaaaattaaaaaacctaatcagattcaaatgatctcatcagtgttcataagacccagtggtcctatagaactctaagttgaatttaatagcttatcctttgggaaaacgtccagactttaggatagtgattatcaaatgttattttgtaaaaaattttgtgtgtatcctaatgcaaagaatttctgaacccattttttttattttgaaamyttggttcagcacatttgaaaaaaagcctagaaatwacttcaagaaacactagtttagggattgtattctgccaattcattataatacagggagaaatttatgtaggaggttattagatatattttttataaagcattgtgcacaattatgaacacttaaatggaaacagataacattaaataaatattaaatacatctaattttgatgtattttttcatctcatcaatattttctaacatcaacatctatgcttaatattggggctggaaattagtctctcaaatagtggattcaactgtttctctttgggatcttaaaattatctaaactctaaatgtttctttaacataatttactagactgtaagaagctattgttaaataagtgattcttaagccagtattactttctttaataacaaaatacttcttttcctgtatactagggctcaccaggagaacgtgggtcagcaggtacagctggcccaattggtttaccagggcgcccgggacctcagggtcctcctggtccagctggagagaaaggtgctcctgtaagtaatgtctaggagaaaatatattatgctgctaccctgtacacgttattactttttattcaataatattagcttttcatacaccaccgtattctctctgcatatgtgtctggcatgtaaataccctggctcgtatatgtataatagagaaaatttcaaattcaattaaatgagatgacattttcccacactttatgaaaccgtaatacctgtgagggagttggatattattaatgtaaaaggcttttcattttgctttttttaaaaaaaaaaagttgtgagttttttattgaagctataccttgctgctttacattagaaaagtgtgaactttttacacstcttgtaatacaaattcaatttcaagcatttccatagtctgyaaataagactcatagaaartagctgcccttctcatgtaatctgagctccgatcgccagtgagtgagacrgggaacatctcactaattatttcatctaatatctattggattttaacattttttggggggggtttattatactttaagttttagggtacatgtccacaatgtgcaggttagttacatatgtatacatgtgccatgctggtgtgctgcacccattaactcgtcatttagcattaggtatatctcctaatgctatccctcccccctccccccaccccacaacagtccccagagtgtcatgttcyccttcctgtgtccatgtgttctcattgttcagttcccatctatgagtgagaacatstggtgtttggttttttgtccttgcgatagtttactgagaatgatgatttccaatttcatccatgtccctrcaaaggacatgaactcatcattttttatggctgcatagtattccatggtgtatrtgtgccacattttcttaatccagtctatcattgttggacatttgggttggttccaagtctttgctattgtgaatagtgccgcaataaacatacgtgtgcatgtgtctttatggcagcatgatttatagtcctttgggtatatactcagtttatatttacatgactatggactattccactcattatgtttaggtttctttgttaagatttcttctctattttttttcctgcttttgatatgattgtattttttaaaaatgattctctcttcctacaagattaaaacacaaactgtttcagtaaatgtagataaaaagtattggctctgatacacaaaaatataagttgaatatttttgtatactggtaagtattgatatataaaattaagcttaagcttatattcaaaaatactcctctatcactaagacttcagttttatcaagttgatttgctttcattgtctatgcattttctytgattattctgtgatattattccaatatttctgtttgagaccattttgtgcagttataacagaataccacagactgggtaatttataatgaacaaaaatatattgrctcatggtgctggtggatggaaagtccaagatagtggggccacatctggtaaagaacttcttggcacatcatcccatggtagatggagaaagacagggctrgagagagagagagagagagagagagagagagagagagagtaaaaagaaaacaaattccctttgttttaatgaacccactaatgcaataacggyattrattaatttcattttgccctcatggcctaatcagctttcattaggccctactcccccacactgttgcaytgggaattaagtttccaaaagatgtttttttggtgacacattcaaactgtagcaaataaaaaaaaaatgttttctgtaatccattacctttcagaaagagttagaatgttggaatgggccatgccacctgtggatagaacttttaggtgacagaaaaagcacttttaatatgctgagaaaatatattttatagtgtactgtgtactaggagaagatagaaaatagattcagttcctttaatacaaattaattaaaaaatatagggaacacatattttgcacaatacactaaataatgcatacagagaaaatagacataaattgctttgtatacaaattgagaatatactaattagataagtcaatatttctgtgaagataatatattgaatggtagattttaaagtggataaaaaccttagatttatgaagaataagtaagttattgaaataaagatcagaatatcaaaaaasattgaaaccgataagaaattaattaggtgagacagatgaaaaattattgacattagcctttgtaagagccaggattcaggyctgagttttgttggtaattagtgatatcataactagagaagggaaaagggaatgccttgcytccccatcctctttcagttatcccagccaaggacaacaactccagcatgctcattccattttctattagccaaaattagctatttagaataactaaggggtaggcactgtattgttagcattatacttttgaaggagctgtctgcttagggacagtaacataaagtgggtaataagagtgttcagtgaaaggagttatagatatccattcagaagtttaataaaaactgatgaaaatgttgggcaaaatgttatatctagactttacttcttcctcttttcaaatataaattttagatcttacctctgctgagcagcttatcttataaaaatgttatgcagttatcagcaggtttacatttgcattaaaagaaaggcaagatgtgacctgtggaagacaagcccttggtctacctacccatcaaccctgcttcctagaatggagaaatgtcctaattagcatccctatattattaatcagttagattagaaactctaggaggtgrgtctggaaagcaggtaagaagaaaggggctaaaaccttctccaatttaatttcattgatagaaaattttgatagggaaactgattctaatgaaaactattagttactggatgcaaagattacagagaagaagtgattttaactatgcatctatttggggacagttgtagaaattggggggaagagctagatctaaaacacagtgaagtcaatgcactaactataactgaattaggcaatarcagtttgaaattttaggaaaartattcttcaaatacttatttacaatttctagcatgtatgtgtgtataattgcagagaaaataatcagtgccagaattgtaagtctgggagtcatttaaaataagagtgatgtttaaaagcatatttttggattaccacgtgatgtagtgttgagagaaaacagaagcctggactcaagtcttaatggagaattakaatgggtgtmagttctgaaagcatctaataagagagaaaaatagtccatgagkttgttkgtttgtgtgtgtgtgtgtgtgtgtgtgtatgtgtgtgtgtgtgtatctccagaggcatgccatcaaacagaacaagacataaacaagttcccttttgtgggatgtaaaagatcgagaatactgaaatccgaaagacaaagaaataaagagactgggattttacctgctgggtatttatacctttagattaattctaaattgattcaaaaagaaaaaaaatggactatagaggagtggagtagggacatgtaaatcacctcaagcagggcatggaacccatagaaaaatgagccataggtggaagtactaataagattgaatgcgttgcctcattattattattatgtggtgcatatatttatctactttatcaataataagaaaatagtcagtggaaaagttaaggagttaaggaaatgagagtagactcaagttgcctgcttgaagacaaccagaagtgggttgggagctacccctatcatttatttagttcatgattttggttaagttatttaaaatcaaaacctctgttttctcaactctgaaaagaagatggccatctctgaaaagaagataatcacagtattttgtgaggactagataaaattatagttctaaatcatttttcagaattgtgataagttgtgagaagtgttcagaataatcattactattagtagtagtattatcattaccatcagtgtgtgaatcagagtgccataaaaaaggatgaaataataaactgagaatgaatacacaaatgagctyttgaggaaggagtgatggattttgtgaattgtaataaaagttgtgggtgtgagtataggttaaatataagaccatgccaaatcaaacaaaagacatggggatgtttagctaattctatcattttttaaggaaagatttagttattaacgtaaatggaatgttagaagtggtgaaataaagaacggttacaaggagagatgaatgtttccagtagttgtgcagattgtgggccaagagatacataatggaggaagagttatgtcatcttgrggaattataaatggctaatataaatttagagtgctgtagatctgttgaatttctcccaacatcacacagaccagggtcagaagaaatgaatggcaagtgattcctggctagagattatgtgtactatmatgaaggcagaagagaatatatctgccttatttacaggaaaccttatacaaaaggattgacttttagagtttaaggctagcaagggaattcaaattaaggggaactatctgaatcaactattgtatttaatatagtgaagtttactgtgaatagcacagcacatcctatgagtattgatagatttgaaatatcatatttatttgaagaagataaaaggtctccagagtgacatcaggggcatccttcttataataattatggcatccttttgaaaaacaagaacatatgaaacccaggcaagtaataaattagttaacaatttaattttgccttattaatgttgttacttttgktgtcattaattaagtaatgtagcaacagttccttaagtgactactctggtccacaggccagagatatataatagaatgcaaaatcagacacaattcctaccctcacatagtttattatctgatagggcaatttgataatatgcaaagaatcactaaatacatatataatggcaaactcaggttactcatatgaatggaatgtaatagtgtatgtcagattatagtagagagacctgctagaattggggactttccttggacaaggcattgatggtgagatgtaaaagatgagaaggaattaactatgcaaagagttctcataggggcwttccaggccagaggaaaaaartgtgctcaggcaatgtcacaggaatggacatggcatcagatttaagggactgagaaaaatgtctagaagggttggaatgcagagagcaagggttaggggaggctagatgtgtttgggcaggtagcaggagctagatcatggtaggctgccctaagccatgaagtctttatctgaggaaaagtaaacaagtaaattgacctaagaatgtaggtaacatgatctgattggctttctggatgcagtgtgatgaatagattggaaggaagtaagaatacrtatggggaaaggcaggaggtttttttcagtagctcagaacaaggataccagtattatagagtaaggtgtcagtgatggagataaagtcaatatattcaagagataattaggagataaaatgtctaaaactaagtcattttaaaggagcaggagatgttaagggaagtgagggaaagtggggtaatgaaaaggcaaaacctaatgacttgtagattcccagcttgtataacagaaggacagaaaggacctctgaatgcaatcaaaaatattatcttstgcaaaactgatgaaattttgactcttagaaaataatttattttaaattacaaaaatatattttatcggaaacagaagttgagttcattatcaaggcacttttaaaaaattacacagtataggtaaatttaaacatgaaaataatgccatttttaaaaaccaggagaaccaaaacaaacacttaaaaataagaaagttacatatgaaacatataaagcatatggcaaagttggacatatgagcaactgcattttttgatttctaaagcctaatacccattgcacagctatgccagtggcactaaggaaggggagaagaggctcagcaaagttttgcaaatgtaagaaatctgatttgtcaatatataataattgcatgtttgaaagaaaaattctaagttgggtcctaattatttttgtgtatcatagcctaagatttataagtgatttaaaaaaatagtattcttagtcacaaatgaaggtagggaacatgtatcatttattctttaaaatgtttttctaaaaaacattaaacaatatccttgtcaaatatagaagctagaytattactcttgtagctgcacttcaaaactgtaaaattaatgatctttggatattcaatacagggagaaaaaggtccccaagggcctgcagggagagatggagttcaaggtcctgttggtctcccagggccagctggtcctgccggctcccctggggaagayggagacaaggttggtattcattattcrtgttagtagatcctgtgaaaaagcttaatttttgtcaagaattctagataattctaatctttatgattaggygccaggtgaaaggttacctttttcaaagtttcacacacattttcatatgctcaaaagttttatttaagaggttcagaattagtatctgttccataaaatagtatgtgatacataaacagaaaactcaattaaaagaacagtggtagtgagaaaaactagtagatgccaaaatttatttatttttaagaatatccttctgaaatgaatataaaataaaaaaattaattacatgtatatggttagtcctcatgtcttggatattgtamaataagacttaagaatgagctacatatttacttcataatcctgttatcatttaccaacatgtgagtacagactctaagctcctaattccaaatgtatggctgtgtgttaaatgtttcaattgaatacatcattatattattttaaaatattatttaaaaatttttaaacsagcactctsataatgtgcatcattttagcatctggaaaattagcagaaaagaattttttccattattttgtttttatttttattttttacttttttgagagagagagtctttttttgtcgcccaggctggagtgcagtggtgcaacagggctcactgcagcctcaaactcctggacttgagcgatcctcccacytcagcttcccaagtagctgagactacaagcatgyctcaccatgtgcagctaactttttaaaaacatttatttgtaggacagggtctcactatgcttcctaggctgatcttaaactcctgggcccaacctttcacctcaacctcccaaaacctgggattacaggtgcgcgacccagaacctagctggtaaagtaatttttgattaatgtgtaattatagattttatawgtcagtgtatttccgttaccagtttatacaggtaatatttgagacaaaattgatttttgaattataaattcagttgtagtatactttgaagttaaacggacttgtctgttaacatattagtcaatattagaaagctagaagcagtgggaacccaagattttccattttaaacagtgacattacacactagcatgtaattatattaaaggtaaaatttaactgtttgatgataattaagacaatgcaatagcatgttagagataaactctaagtcaaatctttcaatttcagggtgaaattggtgagccgggacaaaaaggcagcaagggtgacaagggagaaaatgtgagtttcctacttcttactgagagaacattatttatttaacaacttttactgtttaccattgatatttttatatagtgctacttactttcctagccaatacttataataccaatactacattacctctgcagttatatcattctataattttatatatttgtgaagttttctatttctgtgattaagtaaagtatgatgattgtraggccattatttataactctgctatagcacatgaaagagtaacataatgaaatagtctttyttgtatgattatgagaaattttgtatacatatatttaccaaaattaacagtattactatgttctacatgtatacaaattggtcactyattcccatatgttataratacttattttaaaatttttcrtttaaatcataaaacttcaatataattttggttgttcattcaaatggtgtgttcactcttgtctttatgatgtttttctttggtcactaycagtatatattctctttaaattatgtatttaaacatgttcctacttcttaaatgaaataygttagatgatgatactgtcacatgcttcagcacttccttactaatttatactctctaaagaatatctgtggacattattttctaagttctttttttttaattwwtttttccctttaagtgttcatgtatttgytctctgatagaaacataaattgggggagtacagagatatgtccttcaagttttttttttcacctagtatggaagtttatacattatccccagcaatttcattctaacagaccagtctggttctattttgtgatccatcagtctgatgcttttagggttggayttactgcctacattaacacataacggaaagaagatttttattagaattgatggaatcccaaactgaagagttaccatagtcctatgagatgaatttttctaactaaaaagaaaacwctagaatgaaaagagaaaaagcttgtagtaataattgtagtatttaatgcataattcatttttatatgcagtraaacaaaacaccaacaaacaggtgatagcactgatactccagatccatgctgtaaaattatgacaagaaattgtgtacagaaaaccggctgcatatgtttgatgcagttagtattgactatacatttacaaaatgtattttggtatctgccttagtctgttttgtgttrctataaatgaatacccgaggctggataatttataaggaaaatagggttacttggcttacagttcagcaggttgtacaaagaagcctggggctggcatctgcttggcttatggtgagggcttttgtwctgtgtcaaaacatggcagagaagttcaaaggggaaccgggcctgaacaaggagggaccaaaccctrcaggagtgctgactttaaaacaaccctctttcatgggaactaattcattccttcaagaaacaattcaatctccccagagcaagaactcaatcgctatgcagctattcctgatvgatccaccttaagaaccaaaacacctccatttaggccccacccccaacactgggaattaaatttcaacatgagttttagtggggacaaaccayatccaaacgatagcagtaaattactttagattccatttagatttcttaattataaataaatactatggatttaattagactaccttatacactcgacagaagccacatttttaaaagttttatttactccttaaaagcaatgctaaaatgactgcatggccattatatgggccagcaaatctcaaatatttttgccttaggacccttgcatactcggaaaggtttttaggagcccaaaaagcttttgtctatgtgggttrctatcatatgaatgaaagctgatatatttaaaatatttatgtattgatttatttataattaagaataataagcccaaagcacttttaataaaaactagctatatttttgcaaataaaaatatatagtcccaagagtaccattgttacatttgttttgtctagcttaatagaagaagctatattctcatatctagttcagcctgtggtgacatgtttttttggttgaaagcatgaagaaaatctaagctcacataaattatgtagttataaaagggaggggcattttcagtaccttttcagataattttgaatattctttgattttacatagaaattttataagtggtagtttttcttaagggtcaattgcacaacagaatttgaaacaaaaacagtgagctttttgtgctattacattatattccactgctctatcttgcacgttgatgactatgtttcatacataattttgtaatatccttcattgataatttggaaattattgatttcctgggtaaggtcctcaaagtgttgacacaattctttatgcratattaatatcataggaaaatactttcagattgggaagatataaagcctgcaatggcagatgagacatttccaaaattctaatttttgctttaaagtttgaacgttattgacagtaaatactgtcagttgttttctttgaaatccaaggcttcctttatattgaataacatctgccaaaatcatacttactatttataatcacacttattatttataactgattatttataatcacatttattatttataactaaaaaatcatagtttttctgtcagccgctctttcaagtaaaaatagcgttccatgtaaaagttagtgttccatgtaaaagttcagccagcatttcaaactataatccaaatgtttgtagggcttttttttttttttgagacaagcactgtacttcagtatgaggcaaacatactttatgtatgtcttcartttgtcaaatgaatatgaaaagacacatattcaaggtcaatatttaataatattaataactttcaaagcctcatcaatacaattacatccatgacattcttagatggaacagccatttttgtgttgattgaaagtatatcgtggtaaaatacaattaatgctattacaaatggtagctaccaacatgataagcgctaagttaccagcaactttattcaccacggattttacatcattagtgcaaaagtctatatagttaaaggacaaaaaatgccttactgttgttatgagaagagttatgaactagcagaatcctaaaagcatatcaagaactcccaatggcccatgaaccagcttttcaaaatcttgctttaacagttcccccacaagtagtagttacaatacagaacaatacagttcaatgacagttttatttctttaatgcctgaaccttttatattgcctgacccgttactaatgtaagaaaatgagacaatgaagaaatatctatgcatgtaagactcataatgtcttttgaaaactattgctcaaaataagaggtcctggtgtacttaatatataacaattagtttacatgtgtacgcatatgtgaaaattccaaattttcatatattactacattctatctgtatagaaccctcagaattctgatattcactcagaagacagtatatagacaattttttsatgggccctttcctaatcatatttatctcattaaagamatctgatactttgaaaattttcaaatgcgaatcttacaacttgatgtctgatagcatagaaatctatcttgaagattcacaacattacaaatgagagtgttttcaacaaatgtcaacttaaaattgatttcaaatgtgaaagcttgagtctcaaggagtaaaataaataatgattgcagtaaatgcaaaataattctatgtgatgcttctttttttccaaaggagtgcagaagtgtttgatcttggtaggctaaatgttctgtttcatatggctgaggctcttctggcttcactttaaaaattacttatttttatctcactgcagggccctcccggtcccccaggtcttcaaggaccagttggtgcccctggaattgctgtgagtattccacattgttcagcaaatctaaatccttacagctccctgattaaatttgtatactgtcccataaccagtcaattttgtggggtaataagttttgtttgtatgtttgacattaaawyaaatttaaattatcaaatatagctagccgtgctgattcttagaaacaaaacatattgtaacttcatttgaaagtaagtaataatttgttgaraattccttaatagataataattcagaaaattatttccgttattagacagcttttacttcacttggyatacaggatcaaatcaaartcagttatgatccagaagcaaagaaaataagcaaaacaaacaatagtatattggagcagataatgggcattcagtctactttttacttggttattcttaaatacatctgctttgattaaattagaaatggccacatttttwaatgactcatatcgtaatgattttttccagtttgtgataatgtttctttctcttctctagggaggtgatggtgaaccaggtcctagaggacagcaggggatgtttgggcaaaaaggtgatgagggtgccagaggcttccctggacctcctggtccaataggtcttcaggtaagatgatcctgtcattgttkactccatcatttctacctacttctcaccaggttttctggtggatgtaaaacaaagtatttttttctttttttctaygtaagaacttgggtacaatgtttatccatraagatcattttatttttaaatgagcagctgaacttgaaatcattttatcatgtatgattaattctcctgaacatgtatcagccctcgctcctgattctggagtatttttagacccaccttaattattacacttcctttcttcactcccattttgtttggaaaatgaattacaaccttgcctaagtctgatacttaaaagtaagataggaggagccaagatggccgaataggaacagctccagtctacagctcccagcgtgagcgacgcagaatacaggtgatttctgcattttcatctgaggtaccgggttcatctcactagggagtgccagacagtgggcgcaggtcagtgggtgcgcgcaccgtgtgcgagccgaagcagggccaggcattgcctcacttgggaagcamaaggggtcagggagttccctttctgagtcaaagaaaggggtgacggactcacctggaaaatcgggtcactcccaccggaatactgcacttttccgaccggcttaaaaaacggcgcaccacgagattatatccggcacctggctcagagggtcctacgcccacggagtctcgctgattgctagcacagcagtctgagatcaaactgcaaggtggcagcgaggctgggggaggggcgcccgccattgcccaggcttgctkaggtaaacaaagcagccaggaagctcgagctgggtggagcccaccacagctcaaggaggcctgcctgcctctgtaggctccacctctggggggcagagcactgacaaacaagacaacagtaacctctgcagacttaaatgtccctgtctgaaagctttkaagagagcagtggttctcccagcacgcagctggagatctgagaacrggcagactgcctcctcaagtgggtccctgacccctgacccccgagcagcctaactgggaggcaccccccagcaggggcacactgacacctcacacggcagggtattccaacagacctgyagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaatggaacaaagctggatggagaatgactttgatgagctgagagaagaaggcttcagacgatcaaattactctgagctacgggaggacattcaraccaaaggcaaasaagttgaaaactttgaaaaaaatttagaagaakgtataactagaataaccaatacagggaagtgcttaaaggagctgatggagctgaaaaccaaggctcgagaactacgtgaagaatgcagaagcctcaggagccgatgcgatcaactggaagaaagggtatcagcgagggaagatgaaatgaatgaaatgaagcaagaagggaagtttagagaaaaaagaataaaaagaaatgagcaaagcctccaagaaataygggactatgtgaaaagaccaaatctacgtctgattggtgtacctgaaagtgatagggagaatggaaccaagttggaaaacactctgcaggatattatccaggagaacttccccaatctagcaaggcaggccaaygttcagattcaggaaatacagasaatgccacaaagayactccwcgagaagarcaactccaagacacataattgtcagattcaccaaagttgaaatgaaggaaaaaatgttaagggcagccagagagaaaggtcrggttaycctcaaagggaagcccatcagactaacagcggatctctyggcagaagccctacaagccagaagagagtgggggccaatattcaacatcttaaagaaaagaattttcaacccagaacttcatatccagccaaactaaccttcataagtgaaggagaaataaaatcctttacagacaagcaaatgctgagagattttgtcaccaccaggcctgccctaaaagarctcctgaaggcagtgctaaacatggaaaggaacaaccggcaccagccactgcaaaatcaggccaaaatgtaaagaccatcgagactaggaagaaagtgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagacaaagaaggccattacataatgctaaagggatcaattcaacaagaagagctaactatcctaaatatatatgcacccaatacaggagcaccaagattcataaagcaagtcctgagtgacctacaaagagacttaactcccacacattaataatgggagactttaacaccccactgtcaacattagacagatcaacgagacagaaagtcaacaaggatacccaggaattgaactcagctctgcaccaagtggacctaatagayatctacagaactctctaccccaaatcaacagaatatacatttttttcagcaccacaaaacacctattccaaaattgaccacatacttggaagtaaagctctcctcagcaaatgtataagaagagagattataacaaactatctctcagaccacagtgcaatcaaactagaactcaggattaagaatctcactcaaaaccgctcaactacatggaaactgaacaacctgctcctgaatgactactgggtacataacraaatgaaggcagaaataaagatgttctttgaaaccaatgagaacaaagacacaatataccagaatctctgggacgcattcaaagcagtgggtagagggaaatttatagcactaaatgcccacaagagaaagcaggaaagatccaaaattgacaccctaacatcacaattaaaagaactagaaaagcaagagcaaacwcattcaaaagctagcagaaggcaagaaataactaaaatcagagcagaactgaaggaaatagagacacaaaaaacccttcaaaaaattaatgaatccaggagctggttttttgaaaggatcaacaaaattgatagacccctagcaagactaataaagaaaaaaagagagaagaatcaaatagaygcaataaaaaatgataaaggggatatcaccaccgatcccacagaaatacaaactaccatcagagaatactgcaaacacctctacgcaaataaactagaaaatctagaagaaatggataaattccttgacacatacactctcccaagactaaaccaggaagaagttgaayctctgaatagaccaataacaggatctgaaattgtggcaataatcaatagcttaccaaccaaaaagagtgcaggaccagatggattcacagccgaattctaccagaggtacaaggaggaactggtaccattccttctgaaactattccaatcaacagaaaaagagggaatcctccctaattcattttatgaggccagcatcattctgatactaaagcckggcagagacacaaccaaaaaagagaattttagaccaatatccttgatgaacattgatgcaaaaatcctcaataaaatactggcaaaatgaatccagcagcacatcaaaaagcttatccaccatgatgaagtgggcttcrtccctgggatgcaaggctggttcaatatacgcaaatcaataaatgtaatccagcatataaacagagccaaagacaaaaaccacatgattatctcaatagatgcagaaaaagcctttgacaaaattcaacaaccattcatgctaaaaactctcaataaattaggtattgatgggacgtatttcaaaataataagagctatctatgacaaacccacagccaatatcatactgaatgggcaaaaactggaagyattccctttgaaaacgggcacaagacagggatgccytctctcaccactcctattcaacatagtgttgaaagttctggccagggcagttaggcaggagaaggaaataaagggtattcaattaggaaaagaggaagtcaaattgtccctgtttgcagatgacatgattgtatatctagaaaaccccattgtctcagcccaaaatctccttaagctgataagcaactttagcaaagtctcaggatacaaaatcaatgtactaaaatcacaagcattcttatgcaccaacaacagacaaacagagagccaaattatgagtgaactcccattcacaattgcttcaaagagaataaaatacctaggaatccaacttacaaggatgtgaaggwcctcttcaaggagaaatacaaaccactgctcaatgaaataaaagaggatacaaacaaatggaagaacattccatgcaaatgggtaggaagaatcaatatcatgaaaatggccatactgcccaaggtaatttacagattcaatgccatccccatcaarctaccaatgcytttcttcacagaattggaaaaaactactttaaagttcatatggaaccaaaaaagagcccgcattgccaagtcaatcctaagccaaaaaaacaaagctggaggcattacactacctgacttcaaactatactacaaggctacagtaaccaaaacagcatggtactggtaccaaaacagagatatagatcaatggaacagaacagagccctcagaaataatgccgcatatctacaactatctgttctttgacaaacctgagaaaaacaaacaatggggaaaggattccctatttaataaatggtgctgggagaactggctagccatatgtagaaagctgaaaatggatcccttccttacaccttatacaaaaatcaattcaagatggattaaagacttaaacgttagacctaaaaccataaaaaccctagragaaaacctaggcattaccattcaggacataggcaygggcaaggacttcatgtctaaaacaccaaaagcaatggcaacaaaagccaaaattgacaaatgggatctaattaaactaaagagcttctgcacagcaaaataaactaccgtcagagtgaacaggcaacctacaaaatgggagaaaattttcacaacctactcatctgacaaagggctaatatccagaatctacaatgaactcaaacaaatttacaagaaaaaaacaaccccatcaaaaagtgggcraaggacatgaacagacacttctcaaaagaagacatctatgcagccaaaaaacacatgaaaaaatgctcatcatcactggccatcagagaaatgcaaatcaaaaccacaatgagataycatctcacaccagttagaatggcaatcattaaaaagtcaggaaacaacaggtgctggagaggatgtggagaaataggaacacttttacactgttgrtgggactgtamactagttcaaccattgtsgaagtcagtgtggcgattcctcagggatctagaactagaaataccatttgacccagctatcccattactgggtatatatgcaaaggattagaaatcatgctgctgtacatgcacacgtatgtttattgtagcactattgacaacagcaaagacttgraaccaacccaaatgtccaamaatgatagactggattaataaaatgtggcacatatacaccatgaaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagaggggagggatagcattgggagatatacctaatgctagatgacgagttagtgggtgcagcacaccagcattgcacatgtatacatatgtaactaacctgcacaatgtgcacatgtaccctaaaacttaaagtataataaaaaaaaaagtaagatattagaagggtcctctcataggactcataacaagataagttagtacttcagattgatagcaataggaggaacacgaagtcccaggcagacaggggcggatctggagacactttcgcttcctttccccggagaaactcgacctatgactctttactttcaagatggctaaaaaaattgaaagcattttgagaaatrggatcctgccaaaagcaactgccaacagcacatgttaaacaataataggtaaaataaattaagtcgatcatttaagatcgattattatcattttaaaattgtaatttgaattttatgaaacatatccaggaaaataaatattaaattgtagaacactacagcctctgttcaaatatatcttacaattggactcttaaacaacatgttccagaacagataccttctattctgggtttttggttttttttttgtttttttgagacggcgtctcacgctgtcacccaggctgsagtgcagtggcctgctctcggctcactgcaagctccgcttcccaggttcatgccattctccggagacggggtttcaccgtgttagccaggatggtctsgatctcctgacctcgtgatccgcccacctcagcctcccaaagtgctgggattacaggcgtgagccactgcgcctggccgtattctggcttgtttttttaccttccgcttgatgttcactgcttcctataaaccttggaaacgttgagcttttttcttccacttgcttattctgtctcttcctagtgatccacggaaagattatagcattttgtcttaaatgatattgaggtcccacatgagggtaacttatggtatattatttgtattagaaatggtaaattaagtcatctagttcactgaacctagaaatttgtgaacttgtagaaaagcctatgtaaattgaatttatataaaaaatttgtatctttattttwataaatatgattataaaattactgtgttgatattaaatatcttatgtgcataattacacaaattgcatcatgaacacaatataatgaattattactgttaaaacacttaataaatgtttatcagataacaagattttttatttatctcattttaaggtcaaaataattctttttaaacttggagagtgcaaaaacttcactttcatatttgtcatgtttaggttatacttgttagacaattatacgtaaacagtcataagtaccacatatcaatatgtgtgtgaagcatacatatttgaaaacaaggcattaaaattagattgtcaatggktacattaatattcattttcttttttttatttgactactctgaatcctataaaactgtaatttagaaacagttctcatgattaaagtaggtgtcttgtagattatgtttataaaatattcaataaacatcatcttcattttcacgaagaaatgtgctctttgatgagggtgactcaagaaatcaattcatttaaaaaagtgattgcattttcccacagctacttctgtaaatcaggaaactgaatgatgctaatgtaattaacatgttcacaattgcatctgcctcctttaattgagtcttcatggcagaatagatattagcaattataatagacataaataaaataatctaatattcaggttacatgtcttgatttttcaatttgatgtttactgtcatctgcatatgaaggatatatacacacacacacatatatggagtgagagagagtgtgcattcttggcctaacttcatttttcaactcatcatttaagtggcaatgatttwaaattgacagaccttaaaacagaatctctccacgcataaattacctcttkggagaaaggtaggacatttcatgagaayggattaaccctagagtgcttttcagagtgtttagttccatgcaacaagagattttgactcatkgtgtctccactaattgtaataataataattttttgtcttaatcaatacaaactatgatctaactgaattaaaaataaataaatttttttctatygggatatttttattgaactaattggaataattatatgcatwaaaaagatgaaaatgcacaactgggtttgtaataaaaaaactgtgaattaatattgacataccttttaatttggggatactaaattagatgcactctatcctaaaagggtgtgaaaacctggacaaaaaataaggaatgtaattttaaatttatggtgtttttgraaacttaattatgtttaagttgcagtgtatgctatttaagaaaatggtgttaaagtgaaatatttatttaaactgtgttaaaatatacatgcatgtttaagaatttaagtttatgtgtttcatcaaattcagattttgaatttctgaaattgactgatttagaacctaaaattttttgcagtcacctacaatttttaggtctataagatctgagaaatactacctgtctttttcttccagaaacttcacttataattctagaaacagtcatcagatgatggtaacagtttgggaagtatatatagcagtctcttttcttagacatcttactgacatttgagaaaaaaatgaaattctggtacatattttttgttacaaattagtaactaagatttcctcataaaaatgaatatatgccacaattaaacaaatatataaatatattcagtaaagttccttctttacaaactgaaagtcatgtggatatagtaggttataaaaaaattttgtggatcattaccagcattgaaaaaatgaaatagaacaygataaggtaaaatagaatgaaaatatcaaaggctatcatctatgcaaaaggctaagtactgcttttttgaaactcatgtttcagctactttacatgcgcatggttagggagcattaagtaaaatasatttttcacagtggctyacagtcaaataatattcagcaattacagtgcagtgtcaagaagtcagtaatgtcacgaaagtactagcagttatttagagcttttacattgtatttttatgtctaaaatagattacatctaaaatattatgcaaacattaaaaattaattatgtatagcatatataagatgtattaatatataaataattatacactaaaaacatgaaaaactgaaaaaaatccataatcctacaatattagaaacgattactatgtttgctatttgtctgataattagcatacctattctacctacatattttacagttaaacttatgcatattcatttgtattttttatttgttgtatatattattcatgtttagagtattagtatcacattaatagtcacataasattccactactttatgtaactgaatttctttagttcttttttctaagattaaacttttggaatgacaggattttcagtatcatagctactgttagcaagaaacattttattgaatgtagctatccttattagtttattttcttagagttcattcattcaacaaacattttaatttttgattgctcctctgctagttcctaaacagttaacacctaaaagatcactgatgaatgcatgccccagagtagttcatgactgtaaatatacacaaaagtgacataagaaaatttataaatgtacaattgaagtatgtacaaagtattgttgtgacatgaaagaggaaataataatcttcatggaataatttttgggaagatcaaataagtagtcaagaactaaaataatttttcggwgaagacatagacagatgaaatttgagtgcaatctttctgtcttcctttatactgtaacacagagcttttcctaaatakcagttacagtgcaattgaatacaatggaaatagatttgaaagaatttttttgtcttttggagacggagtcttgctctgtcacccaggttggagtgcagtggcacgatcttggttcactgcaagctccacctccggagttcacaccattctcctgcctcagcctcccgagtagctgtgactacagtcgcctgccaccacgcccrgctaattttttttttttttttttgkatttttagttgagacggggtttcaccggtgttagccaggatggtctcgatctcctgacctcgtgatccgcccgcctcagcctcccaaagtgctgggattacagccgtgagccactgcgcccggcctgaaagaatttttaaaagtataatatagtaggtttcatgggctcattgatttgtaagattcagaaattgaattaacaggtcaaaaattcagaagatatttataacctttgaaatgtattggaatatttattttaccagactggtacctaactataaaaacctcatatactaaaatattttgagtcaaaagattccagaaatctgtaccagggaagttctatatattatttgtackggactgagcmaatggttgggtgttcataaattcccagatcaaattaatatttagttattataactaaaaataaacaatataatmttatacaaaacataaattttatttgtaaatgtaggtgtaagattttatcacatgtggtcaacatttgcatagtaggtattttaacaaatgttagtatctgaatcttaatttccatgtacttattgaactttatacttgattttatcttagaaattgaccaaacttttttttttaaagacatcagtgacttttattatttttctattatattttcttagggtctgccaggcccacctggtgaaaaaggtgaaaatggggatgttggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaatattcactcaagatttagataattagcaatttatacagaatcaaaaattaactactttgaaacaaattcttaatttaataattctgtcttaattagaatgctatgacttataattatttgcatttattgattctggctctctaagacctgaactgaaaatttgaaatgcatataattgtttatgaagcactaccttagataagaaaataattagcaaaggtaattgaaatccataatgaaatgtgatgactgcatgtcttaagtggccctttccttcaacattgcccccaattttcacttccttcaaaatacacattttgaaattttaacacttgtctgttaggttttattctccttaggaattacactcaaatctattatattctttgaaatgatccatatcatcattaataaacctagatataagaaatgcataaaaaactttgctggccgggmgcggtggctcacgcctgtaatcccagcactttgggaggccgaggcgggcggatcacgatgtcaggagatcgagaccatcctggctaacacggtgaaaccccgtctctactaaaaatacaaaacaaaattagccgggcatggtggcgtgtgcctgtagtcccagctactcgggaggctgagacagaagaatggcgtgaacccaggaggcggagcttgcagtgagccgagatcgcgccactgcactccagcctgggcgacagagcaagactccgtctcagaaaaaaaccacttttctgattcaaataactggttaatacttccaagcagtaacagatacatagcaagttcctttccagatatggttaccatcgttccatgaatcattgatatattcttcctgattacacggtagtagataataacagaaaagcttttcaaccatggcattagaataaactgagatcttttaaaaatactaatgtccagtgaaatgtactaatgtacagtgaaaaacaaattcgctgtagactattttaatcacaactttgagataggagtttctggmatcagtattttataaaaagttttccaagttaattttactgcactgtcaggagagaaaatctttgttttayratgaaattaaataattattcttatttctaattctagcatatagaacctaagagttgacatagaaaaagctaaaaatacctatcaacaaaaaatacttctattgagttaatgaattctaawtctattcaagcaccatttatttttccaactttacattctctttatgttgtaacatattctagcatgaaatatatctagttatattgtgaacacattataccagacagtagcaataggctttcttggcccattttctaatcaaattgtttmtcttgaaatcctaatttcctcatagctatgtgtaaaggctcatttgctaacatgatgttgtatccatgaaggatgacttataaccctgatgtgcttcactaactatagtttttacaagcttaaacttcttttagatttttcagtcataaaatgaaaatgttggaaacacatttgaatttggtctttgtaaacctcaatatttctctcttacaggggccacctggtcctccaggcccaagaggccctcaaggtcccaatggagctgatgtaagaactctgaaatatatgttaattattttgaagttatataggtattgttattttatagcagatgctctttgtgagttataacaatattaaactattgtttaatattaagtggttaagaactcaagggtcacctattcactccactttattatacaatgaaataaatggaatttatagtgaacaaatcatggaaaatgtaacataggtacacattttccattcaatagatatttactggtgactgagaaatgttataatgttgtrtatattaaaattactacattgttcaaaccaacatacttagactgtgccttgcatatgataactcttatgcacttgttaacagtggctttcatgtaaaagctttgcattttgtattttcagactatataatgttacagcaatatgtgcgtgataggtgcaccctttatcatgtaaaatgttttctcttaattgtataaagatgatattctccaagcttaaaaattattttaatgttataagattttgaaatataatgccatatttatcttactgttaccattaatggatccatggctttgatgatatttttccttctggccarcttttcacaatgaagaagtctatgtttccttcatgtctctggtcttcattttcttcattatttaatatctgctttaattctggcaggccagaactgagtaaaaatagactagaaagagaggaattaaaagagtttttagattttcattcttcttaggtaatttaaaagctaaaagatgttataaggggtttgtttcttgcgtggattatgtaattcttaaccagkgtcataattttgattcactacaaaatcaccgcctaaaaccaatctgactattctattggcaaagagattgaaattatgtttcaggaatcaaccagagtttgaaagtctcctgctttatcttcaaaattatagtgaatttgaaaatcagtgtaatatattgaattatttgctttccaacacatttgacaattctattaagcatcatttagtctcattctttaaatgactaagaatactcatgcatctatttctcttttttgagaacaactagacatatgtttacgaatgcattattttaataagaatatggataattacattcctttttctacactgcagggaccacaaggacccccagggtctgttggttcagttggtggtgttggagaaaaggtaaatatgttagtgacacacagtttgaaacagcatgaattaagaactgtaataatattgggtagtagtttaagtscttctagtatgtgtgtttctaagccttttacatagttatatgattcacatgtcatctagtagttgcaaaaattaaagttaaaatgattttgcaatattgtgttttggttgccaattattatattgaatgagtgcaggyattatgttctttaagcaggaacctcacaattacggtgtccttaatatccacatttataagctgagaaagctgagccctagaggattcctgtaatttcatcaaagattttccttagaaagtgactaagctaggatacactgcagtccatgaatgtctagtaatagtactcaaaatagaagagattggttgatgtaactgacttaaagggaaaaaggaatcctgcaagccacaaaggaatgaatcattcattttgttatattttgagttatattttcattaygaatactctgacctatccttgtcacttgtcaaaatatttggcatgaaccacaatatctggsctcagaatagctttttttttcttgtgaacatgatttcatttaaaggtctgctcttccttttataaaaatgtcaaaatgattcattgatttcttatttatgcattcatgctcacttcttaatagaattttcaagaaaattatcatggatatttgcgtgctttaaaaaataaactaccaattttcagaaagggaagaattatatttataacatcatatattatgcagtgaaaacactaaaaaattccttaatatgctacttgttaaaggatatctgcagtgtagacttactctattcttaaaaatgatttcctttcttggtctcaagttttttgtgtattttatattatatttaaatttatttcttttaattaaagcatttaattctcagaaaaatgtaataagattagattgttattatattttgatatctacttcagcttgacacctgtattctagtattttgattataatcattatttgattaagataatttttaactcattagataaatcttactgcattctttgattgactgccttttttaatatattcttaaatttaaagttgtgtgttgaaactgttccagtagttggtgttgaaactgaaaacacacttttcattccattcagttgtcctagaaaacatttttcatcttgcttagtctcctatgkgagagyacttgtctctgaggatatcatcagrttagacaaaaggcaccaaggcacacaccttttcctcttctctttgcatcatctccttttggctctaatgctgactcaattgttgtgggagctagtctctaggattattagcttttatcggcttatcttgtttcctaaagaatttgaatgcagagggaaagttgtcattatttcagtgctactcttgaaaataggcatgaatgccaggtgtttagttctgagaaacttccttccacattgtttccatttaatttaaagcctatgtatattatagtaacactttgccaactttgactcttatgagaataattcagtcaatctgaatcattttgaatcaatcccagtcaaaatgagttacactaaaaaacacagttttaattttgctcctttcttttgatttttttttatgtgacagcacgatagaagcagaattctaaccttcatttttttgtttgtttgttttttgttgttgttgatgttttttaatcaagaatagtataatttctaatagattacaaatttctaacatcagctttgattctggctgaatgtatacccatttytaattggaaaatttatttccagtcactgacaatgaagaataaaaaaaccagtatcttttagtcacattgcattttgtctaaatatatttaacctgttcttcatgtactgtaaaattgctataaataacttttgcacttcactaattttgtcaatacttggaaatatgtcaggatattttcttaagatttatacatattttataactttgtacatacagagtaatttgttgttctttctgaaaaaatatgtacctaaacaagtgctttatataatgaggtaaatagttacacgataagtgatgaagacttcataatctaacatctccttcatatatcagtgctctatcataaaacatattaattattattcttcagaatgaatagtttgtagcattttggtattagaaatatagacttaatttatataacattagtcttgttgcaatgatttattgatttgtgattttgtcccacctttcttttaaatgaaacattttagataaattttaaatttcattttarctaattgtcattttacattgtgcacacttggatctaacatactaaatggtagttttcatatattttggacaaatgaatattaatatattattctaaaaatgaaactttgtagtaaaaagctcatactttttttgaagcagaakatattttaawwtttttatcacctcaagcatttatcattagaaagcacatacataaattctaagattatttaaacctatctttttaccacatatcatttcactcatttaataaaaagaaaataatcttttcacaatatccataaatttaactttatagttgataagaacgaaaagagaacaacaaaacatatagagggttactacgaaatatttcaactatttcttctgcatttctaactttctgtgatgttaccatgaattaatgtggtacataagaaaacattttggttatttcttttgctgtgcagaagctttttagtttaattaaatctcatttgtctagttgggggtttcttttgcctgtgcttttgaggtcttagtcatgaattatttgcctagaccaatgtccagaagagttttccctatgttttctttyagtatttttatagtttcaggtcttatgtttaaattcttgaatccttcttgagttgatttttgtatatggtaagagataggagtctagtttaattcttctgcttaaggcaaatcagatttctcagcaccatttattgaaaagaggatcttttcctttttgttyttgtcaactttgtcaaagattagtttgctgtaaatatgcttttttagttactacagccttgtagttgaatttgaagtcaggtagtgtgatgcctccagttttrttctttttgcttaagattgctttggcaataagactctttttttggtttcctgtgaattttaggttttttttctaattatatgaaaaatggcatgttcaatgtacatgctcaatagacttatcatatttctaaataaatattttaayatggacattttacaattgatttcaatgccaaactacttgtttcatttttaagatatgaatatcagcccttggaaayatcactaacatcattacattctactgagatgaatgatacctctctttataaataatataaatgcaatttttttttgtaagagttatccaaaaattctggaagtatttgctgttcatcttgagagatgaaataatttacacatcacactacttawaayaaactctggaaaagtacttgatgtctccaccattaagtgggtaatttaagaatttaaaatatttgtgtattctcacagtaagaaactatgtacacaaaatagtctctgccctgaaattatgtttgtatgtaatatgacacrtttatttaagagcagtggatttgtgtcaggaatattggaaatattagagttaaaaagtaagggaaatttaggcctcacttctttttcaatttaaaagaacaatttccacctcacaattgctgagaccactagtgtgactgattttgagtggaaacatggtaaatgaatgtaytgttttacttaaatgattacttgaacaaratgttatatttttgtgcattttgaattgtggggcattagcaacagactttcatagctaaaccctactagttacagagatttatktattagtccactgggctagaaaaaaagccattcatatgtaaacagggagataataaaggctatcacatttatgtgtatactcaaatggagcawttttaattaacgtctaagtacctttacatatattataattattgtctttcctctaagttctttagattcctactaaacaaatcctataaaatatcaacatatgtaccagcaagtcatctgttgatttgttgtagttaagataaataaatttacattttagcaaacaacaatttgaaagtgttcactcaataaactttattgtaatatgaatattgacacagtgcaaatacacaatattttaggaaacatgcatatgtctgttatgatggttttgtggtaatctggattaatatgccaactattaaccaaccagtgacaactacagcatcaagcctgcatatttctgtctactcacctgagaaataaaagcactggagtcactgatagaaaaatttatttttgttattaaagtttttcaatgccttttaaataatataaaaaaataagggctaatctaaaatgatatgataacatttgaattttrtaaatgtaaaagatcatctctgtattctaatactaatttgatcttctctatatagggtgaacctggagaagcagggaacccagggcctcctggggaagcaggtgtaggcgtaagtactgtgttattgttaacatagtgtattattggtttgggaatttcttttacarcattacaaayatgtaacaactcttagctgtggttcraattttactttcccttcccaactcattaaggaaaatcacaaatacaaagccttgtttaataactttggatatctttacatatgtggattgataaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaatatttgacaatatctggagacacttttggtcttcaaacgtggagggttggtatccagttagtaaaggccagggataccattggacttcttaaagggcagagaacagctccccacagcaaaaattgtctggcccaacgtggtaaaaccccgtctctactaaaaagtacaaaaattagccgggcctggtggcgcgtgcctgtagtcccagctacttgggaggctgaggcaggagaatcgcttgaacctgggaggcagaggttgcagtgagctgagattgtgccactacactccaacttggtgacaaagtgatattccgtctaaaaaaaaaatatattctggcccagtgtgccaaggttaataaacttttatgcaaaacttgtaagataactcttctttccttcttcttctttttttttttttaacattgtttagggtcccaaaggagaaagaggagagaaaggggaagctggtccacctggagctgctggacctccaggtgccaaggggccaccaggtgatgatggccctaagggtaacccggtaagtgagtttggtcccctctaatgtggcatttatgccaaactcaccttggagcttttcttagaaagatttgaaatcctgagactctggaacrtagatggtaaatctgacttttcatcatttcatatattygtaagcattctcaattgaattaattctttaraaattttttggcgggagaagagaaatattctcagcaggttttgtcatgactttaacctcttcacctccagaatgtcataattttataaaaatttatttttcatttatttctttttctttcaaaacgtcattctagggtcctgttggttttcctggagatcctggtcctcctggggaacntggccctgcagtaagtatcagggaaaaatcaagaaattattttggagkgaatgtttccaatttctgtattgttaataaagaaaaaaaaatctaataacctaagtgaactcccaaaaacagaaagaaaaagaaaacataaaaagtaattgcaaatgyaggaaaatccatatagttggagactattgcaccaacactaagtgattaagctcttcatgcaacataggtacaacaattggattagattcctagactttgatgggttgtaaaaacaagttatctgagtagcatcattattattatttcaaagttacaggatctttgcttttctgtttctcttctataatgcaaatcctatttcaaactataccayatwtgttcatggtgaaatgattcrctgacattgtatactaatracatcttctttcttccttatataaagagcatgctggattttaaatttgatatattaatagtagcagttttacaaatttttttgcrgagagtgagaggtaccacaatctttttaaaaaaggttaaaagaatataatgattttacttgtccatctgataatttttctcaagagatggcctaacatacttttttcctgataagtagtgtgatttattgatactgagatatatcttgcttcatattttattgcctcttatagggtcaagatggtgttggtggtgacaagggtgaagatggagatcctggtcaaccggtgagtaaatgcactaatttatttttaagtttttacatagtctcaaggcattttaatgagataattagaagtaatcagcctttgaaaaacatagctctatgtatatgcacttttttgaaagaattatcaaaaaaatttttgaattcccattaaaaatcaatcttacatggagtgtttcttatttgatgtaaattaataaacagwatttataatgaaaagtgtaatcatattatactaataaggttgtcacaatatatcaaattcagttatctatccattgtgttaaaaaattaaaatcactaataatactaaaagcaaagttatttcctatcattagcaaaagttattatcccatcattagcatgaattatattaattgtgaacctaaatgaactctcaacatagtataggcctttttaaaaaaaacttgtgaatgatacaggagtgtactttgaccacatttagttatttagggagaaagtaagggagggaactcactttaggagccaaagacaatggtccctcaacacaattttgtctctggggccattcccactagatgctttgctatcacagatacaggcttattctgcatagacagacctgtggatcatatctcagcatgtgtattagtccattctcatacwgctgtgaggtacacaagaatgggtaatttataatggaaagaggtttaattgactcacaattctgcatggctgggaaggcctcaggaaacttacaatatggtggaaggcgaagcaagcatgtctttcttcacatggcagtaggagagaggagtgcaaagtgaagggtgaaaagccacttattaaaccatcagatctcgtgagaactcactcactatcacaagaacagaatgtgagtaaccacccccatcactcaattacctcccactgggtccctctcaggatacatggggattataggaactacaattcaagatgagatttgggtagggacacagccaaaccatatcagtatgtyatatacaacttggcatagaatgttagtgttgtacaaaaataaatttaaaagtaatagtattatgttttcacatatttatgtgatatgagcagaattattaaccatatgattatattaattagcatgcmtgtttaatgcttgccagatataaattagcactttttaataggacacagttttaaataaagagaatttgattcactttgttctaactataaataaktttaccatctaaatttaccarctctaactataaatatctagaggaagtttaggtatctgwaatagggctgagattttccaggaaatattgacatgtggaaatgaagaaagagggttggtttccatccagattttgaaaatttatgtgggccacaaaataatatccaattttgttaaaggtattttttcacattttatagggtcctcctggcccatctggtgaggctggcccaccaggtcctcctggaaaacgagtaagtttctttaattctttatttgaaacatatgctcattagtcaccatggataaatttatataatgtgtgtaagctgcaggcagcatgttataagaataatgagaaatatcataaatcctaaaaacaatttttaaatgtgccaaataataactaaaatagaacatattctaactatttcactgtcacaataaaaatgagaaaaacaacttctacttaaagagctttccactcctctgtgcttagaactcccctttgtacaaatgtagtagattattataaaagactttggtggtatcctgaacattaactcctattgtaatacatggggatgagctgtcaaaagtccagtgctagcttaaaacattgtaaaaacatgaatgcatcaatgaaatgaggtgaaatgagctcaggaatcagtatataatgttaaattgctttacactgtcaaacttctctggctcggaaacagtattttaatgatgtgctatagcaaaatataaataaataggtattgctgacaatattggccacagtagaccctaggagatttactttcctgtccttttctcactgatgcattcttttcataataaagcaatctctgcagacctgcctcttacagcagctatctcactttagcgtgttcttctgtaccacctgcagtctattttcaaaccggcacatgagtaaaatatgtgataaacatcaaaatatatttatgaggctgattccctcttcagtaatccaaagtcacagggcaattggggccactactgttttctaatggtatctttatttcaggggtatttttcacactgaatatcctcacattaaacatagaatgtgaatgrgttttacttgtctctcagcaatacaaatttgaatcaatatttacaaacatttctctttccaaaaatatatttaatttataataaaacttgtctctgaaaacaatttgctcttcattggccaagtacattttcttacattttcttttattattattattgtgtctacaaccccaaagcatggtctcagtgtcaatagatttatccccaaacaaccatgggactattattcttagaaagtaattggaaagtgtacatgatttttgatatccattgcctctttctgctgtaagtccagctgctcataaaactgtgatgcatagctgtctattatactatttcagaccttttggaagaataactrtaaaaaacatccttgagaatgagttgaaatacttcttggaacaacaggaaatcattttttttatcttttttctggcctcagatggtgggatgctatataatgtggttagtagaacaatgcagtcacaatagctggctttcaacccagctwcaccagttattacctgtattacrttgggcaaattgtgtattttctgtttctcagaggacctaacacccaccctagtgttgggttgaacataagataaatcatgtaacacaataaaaaaaaaaatcacctcataactgttgctgtgttagcactgagttatggcatagttattaaacacttctgagcacagggataatcatcatacaagtataaagtatgatgcttttaatataagcaaggaaattaaaccttgcttcaaaatgtggtagcagctagaaaaggagagactatatcaaaattgattttaaatattctattacatattggcagcttctcagctcatttcattactcaagtcaaactctcagcaagtgctatctagtctagtttcattttaaaatatgtcaaaaaagtacatatttatattttttaataaatttaagtaattatcatttgatatttgagatgaagtatcttaacatggtaacagagttatagaatgtatttgtttctttagccattcagtggtgggtcacatgaattattcattttgaaaacaactgaatatttttgaaaaattttttaagtaatagaataaaataamctattaaagagtattaatgcaaacataaaaaagagacatatatgtgtgaaccagtaaatctcatgagccttttagtataataatatgacccaaaacttatatataaacctataactatcacataaaaatattatatgttaaaactattaaactgttgtgtgaagctattttgacataataatgttgaygctattgatattataaactttcaaaatattttcagtcatatttactaattttaaaatcatgataatataatgcagcaaatttttattctttattataacatatttttaaaatatatttgtgtttattactttggaatggataatgatcgacaattataattttagtgaataactcagactcctaggaagacctcccctcaattctggaattgagaaaatatcrtagaaaattcaatacatattcagatttagattatatatttgctctacaacaccgaagtagttttgagtaagagaaagtccatgtatttacattcttattcatttacatctgagttggacctctgcaatttctagttaaatgagatataattttaaaacatgagttaattgctgattcttaattcttgtctcttataatgaaggatgcattttcatatattagaaataatcagttataataaaatatagtagtatattaatgaaaatataatgtacaaaaaaatttagttatttgttgctttaagaacatgaagcatccttttttagtacatttagtgttgctataaaagaatacctgaggctgggtaatttataaagaaaagaggtttatctagctcacagttctkcaggctctacaggaagcatgatgccaacatctgcttctggtgagggcctcaggctgctcccactcatgctggaaggagaagcagagggggtgtgtgcagtgataacaaggtgacagaggaagcaagaaggggcagcagaggtgccaggcactttttaacaaccagctctctcaggaactaacagagtgagaagccactcacacccatcctggaaaggtattaatctattcataagaaatccatccccatgactcagacacctcctattgggctctaccrccaagatttggaataaaatttcaacatgaggtttggaggggagaaatatccatattatagcaataatcaatrattattttttcatccaaaattaaagattacatgatattgtgaaattgtaagcaattggtaaatttttctttagatataaatgtcaaatacaattagaaaatagaaaaattatgttactctcattcctgccagtatttctaactagacaacattgttaactcccctgattaaaatgtatttaaaaacccttaaaaaaataaaattatggttaagtggatttatgaggtgggtaaaaaataagaaattaagataatttacttgcaaagttatacttgatttttttatatagayatataggcaatggtctcattgaagaaaaagaccagaaaatacctaagggtatatgtaaaccttatttgtaacaaattggacattacacatcaatggaaagtggatagactattgaaaaaattctgctgggagaaatgattttctatatggaaaaagattaaatatacctcatctagctcattkaacagaattcagttctaattgatttataatcataaatgtcaaaggtaaactttgaaatattttaccaaaaattatttgagagtaattttttgacctccagtcataaattctgatcacacaggtgtaatcagaaaggaatagattgatgtatcaaatatatgaccattgaaatttcytatttatccaaaaatacttagaagacattggaacaaaaagatccgattaggagaaaatatttgtaacatacaggaaacatgcatagaataatttgttagaatatctaagtatttcttacaaattataatagcaagaaaaaacaatagaaaaaaatatgccaaaggcatgaaaaagtatttgwcacaaataccccatgaaacaagaaaaaatatttgtagaaatcaggaaagtgtgtaccagaaattacactgagatactatatcacatacaccaattaacaaaaatgtactctgacaaaccaagtattgggaagaatgttttcaaaaaacagtgaagattattatgcatggctgttttgagttactgggcactgccactttagggaaatagttctatgttacctaatagaatctaacatgaactttttctgtcatctggtaattccatttctaagcacatatcctagatgacattttgcacatatccaccmaaagactcaaggaataatgttttgttatccttgttaataataactgtagacaatataagttaattgaagtatattaataaactaaaattttgtatgctaataaaataaatgcactacagatgcatgcataacatagatgaatctcaaaatctaatattaaacattaagcagaataaatatgtgtatgtgtatatgtatgtcttgtgtgtgtatgtgtatataacgttgaactggaaaatatatattacattatttcatttatataatatgcagaattgttmcagatatgtttagcattttaacataagtggtaaacatgataaagaaacataagccaatgattaacaaaaatttaggatggtagttacttctgtggaaaaaaagtgggttgcaattgttacgagtggtatgtaggaagcttctaagttaatgatactgtattatgtagtgcatttaggttgaaagcctaaaataatataatattgagtcattctagcatatgttctttaacattatgagatagtacattagttgagttccctttgatttttgataaattattttaaaataacctcrtaaaaattttagcactgttctatcctctctttttaaattacaatttrtagaaagatgatgagctattttaatccattctagtcactttgtaaacaaaattagaaggctttgtattcatgaattaataataacatgagaacggtggtgactatgcattgcttacaaagctattcacattcattttcatataatagaaaaatcaaccttakgtcagcccgatcgagcataatatgcagggttttctcttttaaaatatggcaacaataaattgaaactgaaaaccatttaacacaatatgttaaattgttttctatattaggtttggataaactggcatgcttaattgcttctttctgttttacataataatctattttcttcaccagagtaaaatatattttaatggtgtgaaaaattactcttatgtcaacaatcttattaccaaaactatgatttgttctgatttaacactagcaattaatgcttgcaccattaatttacagcctacagcactagttaatttagtcaataactctacctcaacataaacaaataggtggcttagcttgaaaaaagaaaaagaaaaagaaaaaaaaaatggaaacacaggtcaagtgcagtggctgacacctgtaatcccagcactttcagagacttaggcaggagtattgcttaagcccaggactttgagacaacatagtgagaccctcatcttcacaraaacttttaaaaattacccaggtgtggtggcacatgcctgtagtcccagctacttgggaggctgaggtgggaggattrcatgagcctgggaggtccaggctgcagtgagtcatgattgttctactgtactccaatctgaacaacagagggagaccctctctsaagaaaacaaaaagtaaacccaaaaattgaagcccaaattacttactaacattatttgcaacctataaactgacactccttttatcttaatttcactgaaaagtagagaccagaatgctgttgcatcagaatcagacagaacttgtttcaaatccttgctacttaaaaatgtgacttgggataagttaatttatttgagtctcagttttctcatttaaaaagcrggcataataactaatttacaatactgaagtgaggactaaattaagaaaatgtatatttaaagcacaaagcctaatgcctgaatctatcagaatctcaaacagtggrtgttattattaagcattgaataagggtttccaattgtagtatcatttataaactaaataaacctattattaaataaaatataaaataaggagtaaaatattttcttcyaatatcctagttgtatacatgaaatgatagctcgttagcaataaattcatggtaaagttagttttgtttattgttgattttgctttgttgtttgagttcagcrgtgaccaatactgaactaactgggtgatacacatacaaaaaggatatagaatattaattaactgcactttcagagtatagtatattgtgattttaaggaaatttatatttgtaatactaatataaattggttatcccttggtacaaattcatgtgacatatatggtaaagaatttcctatgagaacaattaccaaaaatagaagcatttaaactcatgacaacttcatgtatattttaataaaatggatttgtcaaacagtagatatttaagaccagtttaagaaataataaagttattaaactatgagtcaactgagaaagaggtatttggtcacacccacgatcccagcactttttttttttttttttaacttatatgggtgctttagcaactcagggtacaaataaaggcaccactaattttccttcctccctccctccttcttttcttcctttcttccttycttcctttctctctctttcctttttttttaatttttattttattattattatactttaagttttagggtacatgtgcacaacctgtaggtktgttacatatgtatacatgtgccatgttggtgtgctgcacccagtaactcgtcatttagcattaggtatatctcctaatgctatccctcccccctcccccsaccccacaacagtccctggtgtgtgatgttccctttcctgtgtccatgtgttctcattgttcagttcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtrccacattttcttaatccagtctattgttgtcagacatttaggttggttccaagtctttgctattgtgaatagtgccgctataaacatatgtgtgcatgtgtctatagcagcatgatttataatcctttgggtatatacccagtaatgggatggctgggtcaaatggtatttctagttctagatccctgaggaattgccacaccgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctgcataaatrtcttcttttgagaastgtctgttcatatccttcacccactttttgatggggttgtttgtttttttcttgtaaatttgtttgagttcattgtagattctggatattagccctttgtcagataagtaggttgcaaaaattttctcccattctgtaggttgcctgttcactctgatggtagtttcttttgctgtgcagaatctctttagtttaattagatcccatttgtcaattttggcttttgttgccattgcttttggtgttttagacatgaagtccttgcccatgcctatgtcctgaatagtattgcctaggttttcttctgtggtttatatggttttaggtctaacatttaagtctttaatccatcttgaattaatttttgtataaaactggctagccatatgtagaaagctaaaactggatcccttccttacaccttatacaaaatttaattcaagatcccagcactttgagaggctgaagcaagaggatcacttgagctcaggagtaggagatcagcctgggcaacatggtgaaaccctgtctctacaaaaaaatacaaaaattagtcaggtatgatgacatgagcctgtagtcctaggtactctgaggctgaggtgggagaatagcttgagcccaggagttcgaggctgcagtgagccaagatagcaccactgctgtccagcctgagcaactgagtgagaccctgtgtcgaaaagaagaaagtactgtacataagtgagatcactctgtttatacactgtacatatgtgaggtcactttgtctataccacaggtgaacacaaacatctaatcatagaggggtataatgcagagtgaattctatgaattgaaactgatttgagaatactgtcaccacaaacctttgagttcaatatctgatgcagcaatcaatttaataccacttttgtgaaaatagcaagagcatatttctatgcagtaaggtaatatctgttctacaggcttgtgctttggttgaatacagatttgccttacaatctgtttccctttagtccatctagaaatgttaatcttaaattaggtttgtatatattttgtggaaattaacatttctcagatccttactttcccactgtggaaacaataaaaaagccacaattttttttataatatcttatggcrgaagtagcaatgacaagaaatgtgttcaaaagtattaccactttttttctgtgattgaatcttacgcatgaatgataataaaacttcctaacagaatattgatcataatgttgtaagtggcagtgatactgagaaagaaaattctartggttattaaacaagtaggagaattacattatcattcatagtacatgtactttctgtcatgcatttgtaatacttgagaatgaatgtatatttccttaagggactggaagatttgtacagcttgtttcaataagccatggacttctaatactaaagttatcattttagctagttccatgtccttttactgaaaaaaaaatctagagctgaccaaaataatttaagcattataacctgaaaatgcacatattaaatggaaatttgaattcggctcatattgccaaagggaagttcwcaataaaaaattaaaatggtaactgttrttattaactggttataatgacagatgaagttttaacttattatgcacacacacatcatatatataatatagtatatatatatrtgtgtgtaccttgtatatgcatgtactatgtgtgtgtatatatatatatgcacacacatataaagtattattatatatagtattaattcaaatttcaaattcagacattttcttttacaaagtcctttgaaaaattctaatataaatgtatagatagaaagtacattgtaataataaaataaattataaatcctcytaaaatttctgtgtggtacaaaactgtgccttccaagtaaggtcattatgaaaacaaggtctgcatttaatttgagaatcactgaagagattatatacctttctaggagattcatagttcaagaagagtattaaaggttctaaaaattttgaatcaaatttatttatttttaagctattttaaatattaatgtttttaatacttttgggaaaattgttctaattttttaatgtggggaaacaaaaattcttgttcatttaacatgttcaaaaatgtctgtttatccaaatagctaactgtatactaaatttggcagtttattttgctaatattaaaaaatcaagatctccatatgccaagactctgcctttctccaattctcttttttcctccctaactctcaagtcaccacatactcatgcaccctaatattctgactcatagcaagacaaatgcatagatgcttagctactggcctaagtgaactcttaacaggtccatagagactatcatgtactttccattcttattcctttaagcatgcacgtgagtgatcagaaggtaaagtgttagaagaagccatccctctctcatcaactcacactgtaagattcagatcagagactaggtttttaggaaaatcctctatactgccaaactggatcattgtacctattttgtacactgatatcatctttgtttattttacagtgttctatttgttaatttttgtatctgtgtttgtgactaaattctrtgaatttcttagggatttgattttacatgttatgtatatgcatagcacattctggaatataagggatatttaaatgtttgtgacatgagtggaaaaatgattaaattacagaatcatactgtaaaacttgaatagtgaaaagaagattatattagatgctttatatgaagaatagttctcttgagtagaaaaatctgttataacaataactactggtggagaattaactaggccctattttagtgggttatgtttttatgaggtatttttcaataagaacactcattacttcatcaaagtgcagcaagagctcaccagattaagtttctgccccttcgtttatgcaaacatatgaggaataagttattgggacaacaatttgtcygtaggcattgtctttgttttgtactactataacagaataacacagactctgtaatgtataataagcacagatttattggctgaaggatgggacatccaagattgagtggccacattttgcaagggccttgttgcagtgtcataccatggtggaaggacaaggagcagacttgaaagagcaagacatcaaattcacagcctcagttttttttttttttttttagacwgagttttgcttttatttcccaggctggagcacaatcgtgcaatctcggctcactgcaagttctgcctcccgggttcaagcgattctcctgcctcagcctcccgagtagctgggattacaggtgcccaccaccacgcccagctaattttttgtatttttagtagagacgggtttcactgtgttggcccagctggtctcgaactcctggcctgaggcgatccgcctgccttggtctcccaaaatgctgggattacaggaatgaactgctgtgcctggctgcctcagcccttttatatttattattaatcaattcatgagccctcatgaccttaacaccttctattaggtcccacttgacttactactctctcaggaaaagtatatctgcttttgtcgtcatttttcttatttttttgtcatctggaaaacatataaggaataaataaaattgggaaaaatgagaaaaagaacagaayaaagtcatttaataaaatttttactatgacagatatttgttcacagaaggaagaaattatttagacaagaagccctttattttaatcacaacttagttgctgtattgtcatttagttatgttaaaattctctgggctcttctaatactgattttctttctcctttgaagtaaaggtgatattttccttccaattttagacaatagatggcttgcttttttaaaagccatgtattgatatatcttttctactataaacttcatgtttgtaaatgcaatcttttcaggttaagcccacatatcattatgttactagtttaaggaaaaactgtcattgaataaggaaaagctattatttcattgaatgtcattatttctatttcccaaataataatcattattattgttgtatctactttgcatatgttattattttaaagatcacaccaaaataatttctggctcaacattttaacaatagaacaaatttgaaattcatggctcaacacagaattccttttgcttaaatatgaaatttgaaagatgtcctttgaagttttaatgtatatattattattagcatattgattccacctcaagagattacccataraatttatacattttttatctttgggttgaggtacaatgaatgtctaataatagatagttataggaatgatattgagaaaatcattactaatgatgtcatcattgactctttctgagataaaatgagttcgtggaattgaagtgcttgatactcattttattcatctttactttgtgtataaattcatggggtacacgtgcaattttgctatactgatattacattgtgatgaagtctgggccttcagtgcatccatcactgaagcaatgcacgttgtaccctccaagcaacctctcatcatccaccactattgatactcagtttaaaatacgatataaaaggctgggatatattcaccattaaaatattaatatggcatctgaaaaggaacagtcaccctcctgcctcaccttattctcaccaattaacaccaccatgactactctctgcaaccaccaaccccaatctcagttaatgattttgagcacaatttattatgaaaattaaggtaaatgaatggaaaaacaagacagtctgagggaaaaaaatgaaaagcagtttcttagagatcattaagtttctttttcagtcattctgtacttatgcttttggatggcatctaaagtgtaatttttttttcaattttacttctaatattaggatttaaaaagtgatatttgctttcattttacctayttatgtgaaytgcatagttctcaaaaatgaaaatactgtgtctgttgaccatcataatttaaaatattgtgtttctttagttgttatgtgatcctgtaagaatgcatgaacatatacatattctaagattaaggaaggggccattcttaaaacacatatgagaataaaagtagaatacaagtagatatattaaattaatttctaataataaacataaatgatatatcagtatttaacacactcagggtggcgattttaattcatcagcatttctttaaaaactttatttttactgctttcttatattgatgtgaagtgattgtwgtatacttaatttgtgctgtttttcagtattctaagaggaagtttgtacataaaatgggttttgattttygttattatgttttaaaccaaatagtgatagaaaactacaatttattcatctgttacaaactaaagtttagtgtttgwaaacaagtgctcattaacattacttttatatgtgatacatattttacaataaatcttatgtctatagggtcctcctggagctgcaggtgcagagggaagacaaggtgaaaaaggtgctaaggtaaaaaaaaaataatatatacataatatatattatatattatatatacaaggtattatatttgaaaatttcatgcataaactgatcwacttttttcagtrcatttaataaaataataaaagtattttctcatcactaatgtgctcccatattttactttctaacagggggaagcaggtgcagaaggtcctcctggaaaaaccggcccagtcggtcctcagggacctgcaggaaagcctggtccagaaggtcttcggggcatccctggtcctgtggtgagcatctgtgttaaaaagatgccattttgaaaataacatttttattttaaaaaaattttgaatgaaggtgtctatgttagcattatttcataagttatmacgtggataattttgtgggaattctgtaaatataatgtaaaaaagatattcttcatatatttaagtatatcatttatttaataagttcatggtgaaacactaacttataaagagaaaatagaaaaccaaattttaaaatttcaatgatgtgaaatgtttatatataacctatgtatatgtatatataggtgtgtatttgaatatagacatatacacataktaaagacacaaaattatttacaatatttgtagatgtcctccatatggtggaacttaagggtgatatttcctttgttttcttattgtatttctaaaatttaaaataaataaataaatatgtattattttattaattttaaaaatcaatcatttttattttctctagggagaacaaggtctccctggagctgcaggccaagatggaccacctggtcctatggtgagtaagatcttttcagtcatttaaaaagtgagaatttctaaaacaaaattgtttattagctagaatttttgacattttagtttataaatagktttgtattttttctaatagtccaagaagtatattattttgtcttagaggaaagtaatcctaactgataggtatatggaaaataaaccacttgatcagaagatttgtttctttcttatgcactttggatgaaaaaatatttccactctgaatgaaatgccactaatgatccagccagtgtttttcctagtctggatagttccctaaaaygyttgcagttacacttattttcctggcatttcacyttaaaaagtatgctggcaccagcatagagtgattctttgacgaaacaaattgttctcttcgtgagtcatacaggctgaaacataaaacagtaaaactcagtgaaaaaagatatggctactgtaacactgaagcttggtcactatcattaartctgtgtgcaaacaacatgcttgagaaatgcaataaagtattttgttgactgggatactattcataggtggagtttattataggatctgaggctatacttgatacaaatttgggcaaaaagtgagaataaaagacttgccctttaaaataattccttactaggtgacttagttgctttatatatatatatatwtatatttttcttatggtagagatttttgagtgtcattatccagtaatagttaagtgtggagtgattaatcaaaatggcaaatcatacatatrgcactcgtatgtgtggtgagtattagttaagtcctgctatatggtattttaaaatttattcaaatgccttttatcataaatatattaattatctcagagatagaaacatacgcacaaagccatcacaactgggattcacagttcattcaggaaaaattttggttattccttttaacaaagatgccacagcatctttggtatgcaaagcatacctaccaaatatttcataagttttaaagagattatttaaactttcactgaagaatttaamgatcacttatttagtaactagataaaagttatcaaattttggtagatttcaagcaggagatgatcagttctgcccattatctcatcagcttaggaaaagggccccggttgaagcaggatcagctccacatctgtaccattacttatgaatattctccttagatatgataaactcataactgcccagagtcagagcctggaaggaaaaaataccttgccttaatgtcactctaaaatttgccagagattttttcttgttatttcagattttccrgtaaatattttgacctttctgcagatgaaataaaaagcaccatgctggagatttccttcagctaatattaaaaataaaaccttctgacataccacctgatttggcatacaaacttttgtatttttgtcttttaaataaatgtgagtttacagcgcaagaggacagaataatttccaaatcctttaggtaaagcggaatgataaacatcagaagtgggctgcatgggcacattccattctgactgcttgttttatggcgagtacttacgatgtgaatataatgtgtagttttttcatagctttaattagtcttgacttgtgataygtaatctcaatgaaaatgctacttggtcttcatgaggtgaggatgggcagataaatcatcttcaaaatgccatttatggcaatttaatgagcctttcaactcaactaagaaagatctattttagtaggtaatttttaaatcagaatgagaagtaacttattatggttactagttaaggttatcgactctagagccaaactcctgggttcagaaacaatcactaccacttacttggtggatgactttaggaacattaccttttttttttttttggctttaagttcttcatttataaaatgggaatattgctagcctctatccagtgatatttctaaagtttaartgagttcaattgggatatggatatcttctaccccatggggttcttaagttaattaaatgaattgcttgtaaatcacttttatatcaacaattagcactagtagcaccaaatcaagaatcattaaatgaatgaaataatgataaatatgttgaaaaccaatcaattttatattcttagtggaaagtwactaaatttgacctcattcaygcatgtgtgtcatcaataaaccttatgcaagttgttgactattaaagcaaatggaagagatcaacaagtacaattatacttagaaaagttagagtgttaacatgttaagtactatgatagactcaagcagaggatactagatatacacagagttggaccatttaaatgtaatttcctctagggacccttccctgtttagaaatatgatacgattattaaagaaggaacagagaggtgtaagtgtggataacacartggctgtgagattaacgagatttggaaattcatagaggtttctattaatctctgaaattaatctgtgtgaaagctataataataatactttctccatgatgaattttttcctcattataacatatattcacatccatatccaaatctacacaggcttcaatttgcttatcattggagttccacaagtacctattgggtctcttttccccttctagaagctgcctgtaactacctactgtattgtttctactggtgagataaagctaccaagacattccccttttycccaccttttaaatacaacctagctgttcagtaagtacaacttacctactttcatctctccagattggcagctacctatttagacaattgaaatatctaacagagcatccattagacacatagataagtttaacaattttataggaagtttctggatatgaaattctttggggtagagtaaaacaaactgattttttaaactcttaaaatgatttctgcttggtgtctgcccacactatgttatcagctctactagagtcagatgtgatatagtatttattttttacttgaaaaagtacatatttcacatggtaaaaaacttgtttataaacatgaattcaacatatatttacatttgtatatgtgtataggtgtmcacacacacactcacacacactacaaatgtgtacttagatcaccgtatggaactgaagattgacaaatagcacataagggttgggcatggtggctcacgcctgtaatcccagctactcgggaggctgaggtgggagaatagcttgaacctgggaggcggaggttkcagtaagccaagatcacaccattgcactccagcctgggtgactgagcgagactctgtttcaaaaataaaaaagataaatagcacatatggaagctaatcaaaagctaaggatgatgatcagcctatataaataactctattggagtttgtttttttaagtgggactctgctagagtcggtataatataattttattagggtttcttaaaggatttttaaaattttcattagaattttgtattggttgaattatactactattttagtagtcaaccaacattaaatgggaataagactgaatgtttcagtatttatttattgagacagagtctcactctatcaccggggctggagtgcagtggcacaatcacgagtcactacaaccttgtccttctaggcttaggtgatcctcccgcctcagcctctcggttagctggggctgcaggtttgtgccactgcaccaggctaatttttgtcatttttagtacagataggtttttgacagttgcccaggctgctcttggactccagggctcaagcgatccatccacctctgtctcccaaagtgctgggattacaggcgtgagccaccaagcctggccaattgagtgttttaaagagaagaatgaagatgtctaaattctaccctctgatacaaagtcaaaattaaaatgatttagtcacttttaaaactaaaatrtatttgattttttgaagtcagaattaacatctgtcttagctttaaggttttattttgttttgttttgtattcttttaagactctatttgtttwaatgcagctgaaaaattattcagcatttatgttcaaaaaagattatttagtattatcacacatttctgcttttgataacaaaatgttaaataaaatatctgatagcattattttttaaacaataaaaacttaaaagataggatgggatactgaattagagtttatttctttaatsctacatttaagttatctgtagacaagggtgatatgggtagcattccacaatgattaaaaaggtttaaataaaaaagcatttgcttttcaccagattaaatattattccacaattttatattttaaataaagtgtaggatctgcagtttctttaaatttcaatgaactagagttttgaaatgcagatcaaagcaaatattccagaaagtataatactgcaggggaaaatgtttgcttgtgtattctagacacttaagaatgtatcatccctgttttccttttcactttattacttatgaattatgtatttccctgggggttttcaatttacaatatccgaaagagaaaaatagaaaatatgtatagttagaataacatttttatatgcagagttgatgtttttgatctgtttcaggttcaaagggttatttataacygctctcgatatcataccaatttctatttccagctgatgaaaataaaaactgattttgtttggcmaaytcatctttagatgtagtttataatgttaagagagattattagcttagataaattaatattcattatctttaacttcatgaataatatttatggaaaggatttttaatgcatttaaaacacaaataatgtctaatatatttttcactaagcttgagcaattagaatcactagtagttcttttcttgccattttagctttttctattagaatgggatgagaaagttgacaggtatttatctgtagcatatctaaaactaatgataataattcaaatttatattatgcttcactgtttatacaatttttactatggagagcaaagccccagtaatggggagataactatatacttgaaagtgaatttgacaatttcattgtggtctttytgtctgagatttaacagggcaggatgattgtttattcttatacaaaagagaatgtaactaaattcayataaatttgactctgaggattagtaattttctccttattagaagattattattaagcatatctacacttaaaactgcatgtgcttgtatgaaaataacttttgtctgttgttaattgaataatatagggaaattgtccactttaatacttagagaattccaaattcagttatgaattaaaaaacataagtatacctaataatagtctraaataccattgttacacaagggctaatttatattaacactattcttgctctttcctgatattcacagttttggtttgagaagcaggcttcagaaactaaagaatagggagggcccatcctcattcatgcagcagctctatgagataggaattgtagtccccagcttgtagatgagaaaactgaagctctatttgtccaattaatttaagtagctaagaagagagtttggtatctatgccagaccttatctattctgaacccatacttttcctagtacatcatactgcttggatcagatccatagttcttaaggctttaaattcacaaaaattatggaccaggatataatgtgctgttttacactgaagaaatagtgtttccagatagaggaaaatattactcatggtagccttgtagaagatacaatagtggtgactcatgatgtactttggtaaaaagttaaaacaatttgctgtcatagagccatgatgaaaattattactgaaattataattgagctaattgaattctatcaaaataattctaattcatagagaaaccatatgaacagtttgcttttgttgctgggtgccttaggacttgcggcaagcagtagtgacatagtgacatatctaggttatcgtggccctaatttcataagtcacatataaatcatttttttagcatcagtttcacttccaacagcatctgttgcctgcgtagtktcacttgtataatttcacaaggactgtattttgtgttgtcttcaaaattgtagtacaacaatttggcttgttagtgtggtgtgtttttgtgttttgttttgtttactttctctagcgacagggtgttcctctgtcacccatgcaggagtgcagtggtgtgatcttagctcaccgaagcytcaaactcatgggttcaagtgaccctcctcccttagcctctcaagtagctgggacagcaggtgcacaccaccaattattctagtttttgcttttttttttttttttgtagacaaaatgtctcactgtgttacccaggctggttgcaaattcctaggttcaagcggtcctcccacctcaggctctcaaattgctaggattacaggtgtgagccattgtgcctggcctagagtacaacaatttatagataaaacagtttgttcgaaagtcatcagtatgaaaatttccttgggcgggggggcaggacagagttggttgctaaagtcatgccataattttcatagaatgtaagttaaaaggataaatgtcttagtctgggactattaaaaacgttaaattattgaaatagaagtatatttatataaaaaataaatttctttattaatttcataaatcatttagatatgaggtgcaatttagaaattacagctgaaagtaccatcttgatgtagtttgtaacgtcttatactttagcttagagaaattaatagtcatgatctctaacttcttcatgaataatatacatgcaatattttattgggattattaagtattcgtagtatatgtctctctccagtaatcatagtgaaggacatctgatttcaagagaacaaagaataagaattgagatcagaattcagaaaattggccatggcctagaagaattacagagttccatgttttaatttagtatatataggaattatcttcttattctatagaatattattaggcaaccattctaacatatacaaatagagkttgttatttaaatacaaaccaaacagtgtattaaaattttgtctattttttttcctgtggttatcaaagatctattractgttcaaaagtttattgagttttttcaaaaatgttactaaaaatatcataaacttttaaattcatgtaacataaaaatgtttgagtaactggatatataatttggaaatcccttccaaaactagtgtacttaaaaattgacactttattcttaactgaaaagccatataaccatgttctatttctaactttacattcatttaatcaaaattatcaatattatggttacaaattaaaccrtagtgttttaaatatataaatttacttagaagccttaaaaataaagcaacattaatcattactatttkcaactccgtattttcaaaactaaactaggtctgtgactagttataggattctctaattcayacctactctgtttttgttttggggttttttttttgttattatttagggacctcctggcttacctggtctcaaaggtgaccctggctccaagggtgaaaaggtgagaataaaagaatgtgttattaataaaagaatatgcttttatatactaatagccctgcttttgcagattaaaatcattcaaaagaaaatttcaaacaatatcttcattctaaccctgaaaaaagcttcaatccttagcttcccagatgtatgtagaggggagaaaatatgcaaatagtgaaaaatgtgctggaattcagtgctatatcttctcaaggttccattatagcaaccatatgkagaaagcatatggttatactaaaataactattcagaaaataaacagactgaataacaaaatatctatttttatgtttttaaatgtgaaaataaaaattttaaactagaaatatctttcaaatactaatttgatgtactagaatttatgctgagttgcaccaagtacttagagaaattagcctttttaaaaatggtattattattgtttggattatttttaaatcttcaaatgccttttaaagactgcagagtctctgaagagtagaaattatttcatattaaatgagatgcctattaaaataatgagttttstgttatttattcaacttatattataggagatcattattggtttagagattcctcaaatggaacacttaaaatgatatttttagaaagcattttgttttgtaatatttccaatgcttaataaagccctcacttaaagtaagcagtaaaagatccagttaggtgatgagaaggagattcttaactgtatatttcattcagaagggtattttaatgttgttttatcagcattgttcatttttatgctttagaaatttaatgtgcaaatattttataactaaaattttatgaagatagtaatgtacatgttattattttttttctctgcctttcaaagggacatcctggtttaattggcctgattggtcctccaggagaacaaggggaaaaaggtgaccgagggctccctggaactcaaggatctccaggagcaaaaggggatggggtgagtaaaaatataggttattttttctactcatttccaataatacacacacacacacacacacacacacacagtcctttaagtatgatcaaagaaagaatttagagtgtcttaattctaatttaagtcagtaatgttcttaaaaagatatttttattcagccctagagtaaataaattttaaaatatttaagttagaaaccataaaaattacagttgagtattatttaaacaaacatgtactaaattcccatcacctgtaaatcatattctgagggataaaggaatatacacattaacacatatagattgaaaacaaaaacctcattgatattgtagcaacataggaaaaatcctgattattttgcacaagttattttttagattcaccatggaaaaatgtttaagccattcataaatatttttgcattctctaaattttacagtgtatgctgttatgaaaatattgaaaagttatgaaaacatgaaaatgaaatagctgagaaaatccctttaaattggctgattctctctctagggarttcctggtcctgctggtcccttaggtccacctggtcctccaggyttaccagtaagtacaagacaaaataaccttataaggtagggttaagttacaaatataacagagacacaaatgctccagatttttatctgtgcttttgcatttgcattttgtagggtcctcaaggcccaaagggtaacaaaggctctactgtaagtacttttccctttgacaatttaattttgcattgaaacctatttaattgcctcttctttatttatgtcctctctcttctttctaacagggacccgctggccagaaaggtgacagtggtcttccagggcctcctgggyctccagtaagtatatgttaacaagagtgatgttctgacagtttgcatctggaagctgccaatgatttctctgaacttataagatagacaaaaagcacattctgccaaaagtgctgattttataggaaacattatatcatttaagtawtcaaatctacatgccaagacttaaattttaattgatttcactcttcaaatataaatrmcttaattgtatattatagtcttgtttttattawtttttcaagagaatcatatactattttgtcacrttaatgaaaccaacttattttatgccgtaaagatacatttttacttgactctaggaataatgacaaaaattcagrtgcttcacattttttcctagtgcattataaagatactaataaaaacaatagtaatagctaccactttattaatactaaaatgttctaggcttcacataactaattaaatggtagaattaaaatataggtccatgtgaaagaaatgttattcttctttcttgagctaaaatctttccaactatatgtatactagtttgctagggctaccatagcaaagtaccacagagtcggtggctcaaaccacaaaaatgtattgtctcccagtgttggaggctagaagtcctagaacaaggtgtcagcagtgttggttccttctgaggtccatggcggaagggtctgttctgcacttctcttcttggcttgtggtggctgtctttcccctgtgtctcttcacattatcttccctctttgggtgtatctgtgtttaaatttctcctttttataagaatatcacttatattggattagggcccactctagcgatgttatcttaactaattatattttcagtgactgtatttccaaatgggattacattctgagatactgagaattaggacttcaacattacaaatttttgtgggatacaattcaayccatgacaatatgataactatttgatatagctctgctcgtaatgtaaattcaagtckggttgcattgattttaagtttgttaatttataatgatttaagtcacacatatttgaagcaaactaatgtgtacatattttttaaagtttaatgttttataatataaattatcatcaaatataatacacagttgattagatagcrcaatagctttaaagtgctgttctaatcctcagagactttacaatctagttgtggagttagggcatataaatgatgactaattaataaacaagagactaacatatataacatatctacacaaatctgtgctatattattgtatagataaagggtgagaaatcatctaacttattcacctacctcaatatctccaycaagttcatcatagaagaatctatgacrtttatatatttataaacttatcctatagcataaattttgtagctaatgaaaagctaaaccaactctaatttcttataacaaaaacataaccagtaataattaatatctgcagaatattccactttatgaaacaattgcactcacattatcttctttacagggtccacctggtgaagtcattcagcctttaccaatcttgtcctccaaaaaaacgagaagacatactgaaggcatgcaagcagatgcagatgataatattcttgattactcrgatggaatggaagaaatatttggttccctcaattccctgaaacaagacatygagcatatgaaatttccaatgggtactcagaccaatccagcccgaacttgtaaagacctgcaactcagccatcctgacttcccagatggtatgtaaataatacatgacaaagcaaatgtaccgagcccctgagtttctgaggtgcattggcagctcattcattctagttaaatgtttaatacagtctctaaataaaatgaaacagttattaattatcttctagacagaaaaaatcatttatactgcataaatcaagatttgctttggaaaatccttgtctgttaaatgggattttattaaattatgacaagatcatttttggatgattacagctaacacaaatgtactttgcttgtaataactatcacagaatgratactgtgtatacacacatgtgtatattgtaatatgattactaacttcatgttaatgtgaatacttacattaatatgattattattttagattaatatgaatatatggataygtgtaaatrgcataactgatgtatatttgatctatcagtttggcaatgatttggtgaacagaatattaagaactgggatagcttggggcaaaaatgtatctttaattgakccacagatattccaaacagctgtgaatagcttacttactaataacaattaggataattcatcataccaactctttgacaaaacctttatatacctattggtcagagaaagaaagagtttcaggttgctaagttagttgactaaactcttacaattattaaagtagcaaggggcagatcttcatctgatttttaaatttcccactgcatgttgaactattttgtctcccctttactctgtagaaaatattgttttgcactaccaatcatataatgtcagttataactgtgatctaagtaactcaatgcagatagaaaagttcagtgtagttcagaaacagccagcataaaaaaaaggatgtcacaaaaatcttcttatcttaatcaagcatagcctgttaaaggtaaaacacaggtaattattagcgttcctatacaaactggtatctaacatcttcatgtttataatatgtttatctgaaaaatatacatttagtytagtgatttataaggagatttacttttaactggtrttatttaagcaaaagatgtagatgatttagataattcaatgttatatactcctaaaaaccatgtaagmtatatcaaaggtttacagtggttatctctacttggtaaaatcttagatgattttttttatttccttgtatttttttcctgggaattctaatttgtttcagacatgattatattaatggtataatctgaaaaaatatagatgtttttgttaaagatattaaagttatgcgactattagaatacttttcctgtttatatacaagtagtagcagaagataaagcaggttgatattgcattgtttagagttccagcaccaagataagcaatttgagcttttaaaatattaaaagttcataaccagtggacttatataattcaaatatttcaaatgaagtggcagcatgaaaaacakttggaagtataaaggtagaaakaattygattcctttccttctcagtataaaggtcaaagctgacacccctataaaaaaaaaggttaacaagagaaaaatattaaaaatgtatttgattatagttcaacataacataggcgccttcagattcaagctcgaaagatacagaggaagctatctgattttatgcttaggttcgataaggcagggacagctgtgtagaaatgcaatataatattggacaaaaaaagggtatgagctaatgatactaatccgagtagggaaacctagtaaggccttctgttcagatactccctggcctgtgttgtagtattccatcctcccaggtacggggtagaacccctctggaataagggttttaatttctttatggccagctgttacacagaaaggtgggtgaaggttatgttaacagtggcaaatccatatggtatactaagggttrtaggagtgaaagtttattaaaaagtttyagaacagaaatgaaagaaagtaaagtacacttggaagagggtcaagcggacgactggagggcttcaagtgcatggtttgacctttgacttggggttttctacattggcatgcttctgaggtttgcatctcttctcgcctgattcytcccttggggtgggctgcccmcaagtgcagtgggctgccagcacttgggaggggccacacacacattttgtttcctggagctgtgcgcatgctcacttgaggcgtcagtttagtgttcccagaggaaggttatttaccagttaaastccaaccatttgcatcttagtgcacatgcttgagcccagtagcccacctcctgagatcgtataaagaagctgctggtcaccagtttcaggtgttttctatgaggaacaggaagactgccattccctggcaccagctgcaaccaattgttttagcaagacagtttaacaactgcctgaccttcatctgatggtcgcctgacattcctggtgggattggcagggctctcctgccctgtttatgtctgactacctactataacagttagagtagtatgtttaggttttatagctggctttgcaaaaaaggggttctggtttctatgacccactttggggaggagggattctaatttccatgacttgcctcgagggagaatgasggatgagagacaggagggcagaggtcagagaaaaactgcctcagcggctttcactttggggtatcattttctgagtcccaacagaaggaagcaaagtaatgtttacatgtatatcacttttggctcctagtaacttttgttaactaaagccgtattgtcagttatctaaagaataactttgttactcccactattttccatgcttactcacataacaccaaatgaatggtgatgattattcacataataaaatgtgttctgcaacatttcagcaatggcattaatagcaggctgcattaaaatataaagtagtccttcttaggaccccccttcaaagagagagtacatttattgcaagaagttttttttttttataaaataaggcagaggtatgatctctgaggctaagtagatacgatatcacctccactgttacaaatgaataaactaggaagaaaatatattgattacactactcagattacttaagtagtaaataatacttatgagatttggagtcaagtatatcttatttcaatatgcatgcaatttattacacagggataaatggaatgttaatatttgaggagatgatatttaagttgaaaccaaaaagtgataggcatgctaagaattttaaaaaggtattccaggtagaacatatggggcatttgcaaagctttgaggcagacaagagaaagtatcactctttattaaaaaccgtaccccaatatgcccaaaagcttaaaaggcaaaagatctattaatatgtattttccttatttctctttctaacaaaatttgacatctaatgcattcaacaatgatgtcaatgaatttttatatgacatattttttgctaccttctaggtgaatattggattgatcctaaccaaggttgctcaggagattccttcaaagtttactgtaatttcacatctggtggtgagacttgcatttatccagacaaaaaatckgagggagtaagtaccaatctgttttggtggtgaatgttgacagttcctgccatgttttgcaatattgaactaaacaggaaaattatactgtcatattttcatttatcwgcttttcttacaaaataattagagtacttcatttgcataaacatgaataagcaccaaattgatgcacagagttaacaaatacttctcttctttattttttacccagatgtattmtttctgcacctgcttgctcactaaaattctatggatttccatgacacagcacagctgaatctcaaattttagtgccacwaaagtgttcttctgcccaattaccacatcagagacctcacagctgcatattacacccaaaatatctaattttataaagaattaaacttttatatacaagtmttttctgcacttacatattttttaaatatttagtttctttaaacaaattctttaatttttacctaacattattaccagtacactgagttctgtcttcaaagctaaatgcaaatcattaatgtaaagaaagtttgttcacgagcataactatattctccaaacattttataagtggacattttgtctttattggtattcatgtaataaatctcattcttcctagtaaatggtgtggacaatagaggcacagaaactcctkaaggcaaaacaagtagctttatgtgtgactaatggttttgggagaaaagttaagtttctgagtaaagagtgggtagtaagggcaggagaaaaaacaacttccatcttccaacactacttggcatgtaatgaagcacagtaaagctcccctagcctccagagaaatgtggaaaaacagaaaatgttgtttcttacacagataactcgagttccctattgtgaagacttatataccytttgctgttcttcacaaagcagaacaataaatgcagatctataagattctaaatattctaaccagcagggagtaattcaggttgcttccaatcagtgcctttcacacagtatatctccttagctactggctaaatactttcaaacatgttccttggctatggagtgaagatggtacctgccttgcttgatgaagctgactgacattttgaggatttcctttgcaaagggtttctgagtgttccaccaatgtcccctataacccttagwatgcctatacccggttgtctttccccttttcctttagagctgataaagacaacaaaaaggaaatgactcaatcttcactacrtagaatgtacaggatctatctcaaatttttctctttgtctcattttgtataatctaatttgtgtcattttaaaacgattttaagcactctttattttcytagtcttactgaaaatgaattatatgtatataaaaatactgtttatattgtaaattttcacctactcrctaacttttctgttcctttgcaacaggtaagaatttcatcatggccaaaggagaaaccaggaagttggtttagtgaatttaagaggggaaaactggtatgttattacctcaacatgaaacgatttttcacgaactcaagaagtgacattctgattatgtatttctggactttaacagtgaaagtctaaattatgctaaatgaggattccctgtggtctctagtttgttccacttaatatctcttagaccactgtggtatcttaaagcaacctaacatttttgtataaaagtaaatggaaatatgctaaatttatggaaaacaaggatcaaatcatgcatacaatttattaagtacctgagatagacatcataaaaattgattatgttagaaatatcaggtataaagaatataatatctacttaatatcttcctattatttcactttctgtctgcttgaaacctaattccttctttattcttcatatcaataagttggaatgtgcaactttttctgattgttctggcacaaatttaaagatttccatacaattaccagttcatttcaataattttctaaagatattttaagattagatgtcaaaattaaattaatctttaaaaggtgtttaatcatatacatgtgtttaaagtattttatttagaagttattgaatttaaagtgttttccagttatccagataattattcagttgtttaattttctttgaaaagctattattttccatttatgattatttatacagttattatttctatacaaactcatgcatattaaccacttttattgacactctccactggagttataattctctattacagtcttcaagttgcatattaaatatccatattacattattatctttgtataagtttaaaaatatatacagatagaactctatgtgtgtggattgaattttcccagtagatttttttcttcaacccccaagaatactcatgatctgacctactattcagtaagaactaagtaaaatctgttttaaggaagaaagtaacaaataactgcctttacattgacctaatctataatctaggtgaacatcttaacctttwttttttyaaatttaagtgtatatgttacagctkaactcagatatttttattaccaaaaataagacaatttataaagatgatatgagacagttgctaataaattacaactgagactattttcctgctataatttcagaataagtattgactcaacaaatattaacttgccttgtcttgcacattatgcctgctgctggcaatacaatgttgaatacacacatcatctaaaaatagataaacaggcatttctgaaaatattaataacctttgaggactatagccccaaaatgaaaagtgtaggaacatgtttacagatttgggtaaagttgatacattttgaaatgtttgaaaggaatagtcaaaatcaaacaacataaaaccagctaatctttgcattattctgagattccttggttttcattgttccattattttaccaatttttttttcaaaaagatacagaaatatattgaaacatttcttggaaactaaagcattttttatagtstttactgtttaggaaactaagacttagagataaagtggttttttcaaagataagcagtggctacagtaacttaggtgggatacaattcataaaatcttgtctctgggtcttctgaccctcaatgtacactttttttcattaggttaaggtgggtcttttgattcatctacatgcttctggcatcacagttcactgtctgcagtgatttaattctttgtagcataaaagaggaaaagagtcattaggtgtctttttattcctttattcctagctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcggtgagtataagttctgcttgtctcccttcwcagagatgataggcagcatgtcaccgtttcagtcggtccttagccagatttttctcatgaaatggaygtcagttgttattaacatttgttgcttaatcttgacatgttaaactatggtatgtgagaaaccagtaatgttaacacacacacagttatgcacatagacactctgaaacatttttaaaggcatacagaaggtaatcttggattatatgttattttattctgacatttgaatcatatcacagctagttattcctaaaatgaaaaagaaaataaaaacacttatttcatttgcctccttattgctgattttaaaatgacagataaaggaatcaccattataccatttataatatcaataatttttagccctatattttgtttataagaagcttgttaatttgtactatatcagtttgagatccagtatcattattgttatctctatcttatagaactaccttgttcacacacataagattttacataagaaaataataaataggtgccctaaaaagttcattgctttagctgagtattgatgactgaagagaagtcacaattgtaaataagtaagttcatgttttcatcaaaatgagtggagtgcaagtagaatgaagaagagagagtaaagcaaatgaatggagcaagagttgggaaaagcttttccaatatagtttattgttaaatattcataaaattaacatatagcagaagaaatttttttgacatttgaccttgtgtgttatagttgtgaacctgtatttaactttttctgtaagagaatttgactatgtatatcttaactrtaatggtaaagatgtattatttatactggaggggctgggtgtggtgtcttacccctgtaatcccagaactttgggcagccatggcgggcagatcacctgaggtcaggagttcaagaccagcctggccaacaaagtgaaacctcatctactaaaaatacaaaaagtagctgggcatggtggcacatgccagtaggtccagctactcaggagactgaggcaggagaatggcttgaaaccaggaggcagaagttgcagtgagctgagatcactgctctccagcctgagcaacagagcaaaacttcatctcaaaaaaaaaaaaagaaagaaaagaaaaagaatatatatatatatatwtatatatatatatatatatatatgaggattcaataccawcatcaattttcatattaaattgtatttattatgaaactcaagactctttttaattacaaaatatatagcactatcatagttaagtaattacagctaagtattaaatgtactaatcaatattcaaaatttagaactatacagtgataagaattattacatagataatagaaaatttgtttttctattctcttctctctcagcttcttacctccactcagaagcccaagaaaaaataagatgcatttaaaaatattaaaagattgtataactttttatttctgctttattttacagtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttyttggctaagattaagacaaagaacatatcaaatcaacagaaaatataccttggtgccaccaacccattttgtgccacatgcaagttttgaataaggatggtatagaaaacaaygctgcatatacaggtaccatttaggaaataccgatgcctttgtgggggyagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaratatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattarraaaaaataaagttrtaatttctgatgactctaagtccctttctttggttaataatraaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcytttcaagataattttataaatcatttgacctacctaattgctaaatgaataacatatggtggactgttattaagagtrtttgttttaagtcattcaggaaaatctaaacttttttttccactaaggtatttactttaaggtagcttgaaatagcaatacaatttaaaawttaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctggattggtcattttctttcttaaataggttccaaattattctcaatttcagataaagcttttgattctttcttgaccatccagattagaacagttttacacttctgaacaaacatattaccattcagagataagttgtctaaatcccccacatgcataagatagtgaaaaggacatggtaatactgaatttataaaataaaggtagattatacttaaaatttcaaagagatatttttgtaattacatattttacataatgatgaaagtatagcaataacagaatattttgcatattagcctgcatcagggatgcagtgttatccatttaaaccaaataaactttaatttggcactcaatagaatgaatagataattgaatgtctatgcttttatattctttccatatatagatatagtcttcttcaggacgtcagacttttttctctcccttatgattgatgtaatctagacaaaagaaagctcaccagaatagaaaaaacttgttagatgacattttaatcctggccccagcaggtatgttattcatatgaatacaaagaacagtattgaccttgaaggcagggtaaatcatggacttaatgcacatgaaatttgatctaactttaagaaatamaactacaaacacaaggtacagaagtgactataatgagtaaagatattacaacaaattattaattttattaaaaagttaaaaaaacaggaaatctgggaaaacaatgttttttctttctgaaacacttctgtgattttttaatattatatttttggctgcagtctctttgagtgcctctttataagagatttcataatttaacttaatatagagtaagatactctaatatgcaaggtgaaaaaatgtttcttattgataccttagaaatatttctgtttcatgtcttgttattggtaagtaagtattataaaatttttagattatttaaaaatttaggaaaatctctattacatatatttcatatgcactacaaawtttgtgagaaatttccacagactagcttctgattctgtttatttcaaatcttgtttctcctccactgcctatagattttatgttctgggaaccataaaacacatggatgccatggtacaaactcagtcttctttgtgatcatcataacatatcattagttcattcttccattgctataaagaaatacatgaaactgagtaatttataaagaaaataggtttaattggctcatggttctgcaggctgtacaggaagaatagcagtttctacttctggagaagcctcaggaagcttccaatcatggcagaaggcaaagtgagaatgagacgtctcacatggctggaataggtgcaaaagagagtgagaggggaggtgctacacacttttaaatarccatatctcatgagaactcactatcacaaaaacagcccaagaggatgctggtaaactcttcatgaaggatccacccccaggtccaattacaccacattaggtcccagctycaacactgcggattacaattcaatataagatttgagtgtggacacatatcccaactatatcagtggatgacagggttattccagaaagccatttacactaggattgccggcattaatatacataaaataatgacaggttgtataattataccccatcatgtaaatatagtatacaaaccccaaataaatgaatctatatttgaattttctccttgctggccccttccactctacctaacaaaaggcgaaatgacaaagagtagttgcagtggtaaaacaacgttcttaactaatcatggtcaatcttactctggcaaattttactaataatatgaccatgcagacatatttctaggagacctcccagggtcttaaatggagcccatgcaaaagaagtgtcctggagcttaagctttatgagattcatgttaaatagatggcttcatactggataactgtaaaacatatgagttacctaacacaaaatctggcatatatcagctataaagaaattgctgctactctagatttctttgtgctgctattatcaccacagtataagtccctttctgaaatgtagctagtaacacctgtgctacccaatatcatataatttttataaagatttcatttgaacaaagtaaatattatacaaattgcatgatcacagagacccaaatcatcaaagagacttacatacaaactttacaaatgatttgcaaaagataccaaaaaagaacagcagcctaaggcattttaaatccagcaagtctgaattcaccagacatagcttatcaaatcttctttttctatatataccaaaatgtgttttacttgccagaggatgattttaataggtctttggggtctctcaactttggtactttgctagtttcatatccctgtactggctgtatgattaaccattgctcagtayagctgcagtcaggagatccatagattgcagaattatttacagaaaattttttaaagaaaaatatctcgcttaaaccattccaagttcagtaagctgtacatagcaacccatgcagaatcctcattcactattcatctaataaatccaactgtcaatatttagaaggagatggttcagggttaaaaaagaaacaatataaaaaaaaatttacaaatccacggttaactctttcctaaaaccacaacgtgaaataatttcagaaatgtttcatgctatagtaactgtgacttattttacaataacattataatggtagttctgtctataatactataagtatgagataaacaaaaccatggggatatggtttggctgtgtccccatccaaatctcatcttgaattcccccttgttgtgtgagaacccggtgggagacaattgaatgataggggcaagtcattcaaaygctgttcttgtgacagtgagtaagtytcacaagatctgatggtttataaagaggtgttcccctgaacaagctctctcattttttgcctgccaccatccacgtaagatgtgacttgttcctccttgcctttcaccatgattgtgaggctttcccagccaattaaagcccattttaattgaactgtaagtccaattaaacctctttcttttgtaaattgcttggtctagggtaggtctctatcagcatcatgaaaacagactaataccgtaccttgataccagtgaagtgggcactgctgaaatgatacctgaaaatgtggaagcagctttggaactaggtaacaggcagaagttggaacagtttgaagggctcagaagaagacaggaaattgtgggaaagtttgaaacttcctagagacttgttgaatggctttgaccaaaatgctgatatggtctcagatggaaatgaggaacttgttgggaactgaagcaaaggtgactcttgttatgttttagcaaatagactggtggcattttgcccctaccctagagatttatggaactttgaacttgagagagatgattcagggtatgtggcagaagaaatttctaagcaactagcattcaggaggtaacttgggtgctgttaaagcattcagttttataagggaagcatagcataaaaattcaggaaatttgcagcctgacaatgtgataaaaaaataaaatccctttttctgaggagaaattccagctgcagaaatttgcataagtaacaaggagaggaatgttaatccccaaaacaatggggaaatctctcaatgtatccagggcatgtcaaagatcttcatggcagcccctcccatcacaggcccagaggcagagcaggagaaatggttttgtgggccaggcccagggtcgccatgctgtgtgcagcttagggacttggtgctctgtgaaccagcagctccagctgtgsctgaaaggggtcaatgtagagattgggccttggcttcagagggtgcaagccccaagccttgacagcttctatgtggtattgagcctgtgagtgcacagaggtcaagaattgaggtttgggaacgtctgcctagatttcagaagatgtatgggaactcctggatgcccaggcagaagtttgctgcaggggtggggccttcatggagaacctttgctagggcagtgcagaaagggaatatggggtcagagtcccccacacagagtccctgctggggcaccacctagtggagctatgagaaaagggccactgtcctccaaaccccagaaatggtagatccatcgacagcttgcactgtgtgcttggaaaaactgcagacactcaatgccagcctgtgaaagaagtcaggaggagggctatactctacaaagccacagagtcggagcttcccaagaccatgggagcccacctcttgcgtcagtgtgacctggatgcgagacatggagtcaaaggagatcattttggatctttaagatttgactgccctgctggatttcagacttgcatggggcctatagcccctttgtttggccaatttctcccatttgaaatggctgtattttttatttatttattttatttatttttttgagatggagtctcgctccatcaccaggctggagtgcagtggtgtgatctcggctcactgcaacctccacctcctgggttcaagtgattctcctgcctcagcctcccaagtagctggaactacagatgccyaccactacgtctggctagtttttgtatttttagtagagacagggttttaccatattggccagtctattctygaactcctgaccttgtgatccgccygtctcagcctcccagagtgygtaagcccccacacctggctggaatggctgcatttacccaatgcctgtactcttaccgtatctaggaagtaactaacttgcttttgattttacggactcatagtcaaggagggacttgcttattctcagatggaactttggactgtggacttttgggttaatgctggaatgygttaagactttgggagactgttgggaaggcatgattggttttgaaatgagaggccatgagattttggaggggccagtggtggaatgatgaggtatggctgtgtcccaacccaaatctcattttgacttcccacatgttgcgggagggacctggtgggaggtaattgaatcatggggcaagtcatttccatgctgttcttgtgacagtgaataagtctcatgagagttgataattttaaaaagaggcattcccctgcacaagcgctcttattttttgcctgccaccatccacgtaaaatatgacttgctcctccttgccctcttccatgattgtgaggcttccccaatcacatggaactgtaagtccaattacacctttttcttaaattgctcagtctcgagtaggtcttcatcagcagcaggaagatgaactagtacaccctgattcctattctaaaattacctctrtatgtctatgcagaaataattaagtagcctttcttcccacaatgtgatgatttcctttttgtggaatctaaaaagcaaaacttacatctcagtagcaggtctcattccagtgataacacagtataagmtattgagttgactgacttaattcacccccatattagggtgcatggtgtaactaaaatatttggctgctttttggctcatagagtgaaatgattatttctggggcccaaaggaagattcacatgaaatgatgaaaacttctttgctcaaccctatgtgagatgtccagactttgaattaaataaaacaaatccactacttacagattcctccagtcactgtggttcaaaggtctgtgcaaccaattccttaacaacacaggtttttgtatcttacctatttctgggaaataaaataaaacaaaataaaaataagacatagtaaataaatagtttaagccactaaataaaaaattgttcccatagctaccattcaatgggtaaaagtattttcaagactctgaaagttttcatgtaatttttatgtaactttgatgtttcttttcta

SEQ ID NO: 13328 - DNA, 14670 bp, Homo sapiens
atgtccctggttacctccctctcctgctcccatcctatgcactaattcttttttttttttttttaaggtggagtttcactcttgttgtccaggctggagtacaatggcacgaccttggctcactgcaatctctgcctycccggttcaagcgattctcccacctcggcctcccaagtagctgggattacaggcgcccgccaccatgcctggctaatttttgtatttttagtagagacgaggtttcaccacgttggccaggctggtctcaaactcctgacctcaggtgatctgcccgcctcagcctcccaaagtggtaggattacaggcgtgagccaccacgcccagctacctacgcactaattttctaccttcctcatgctcaaagtgacttctgtttttcacagagattaggcaatgaaggatgaataatttcaatttcccacctcctactgacaaacagtgacatctacaccaattctcctacacaaccaaggttaagatgccttctccagttcaaagctaatccctccacctgtgctcagattgctgtcctcccacctccattgagaccttgattcaccaaaccacacccctctcctacctgtgtctatggctcttcctccatggtaaataagcccacataagtctattccatttaaggaaagaggagggaggaagaaaaaaaagaggaagaaggaaaggacaaaccaaacaaaacactctcctctacacttacgtctcttttttatttcctctcttctttggttttgttttgttttgttttttgagacagattttcgctcttgtcacccaggctgragtgcaatggygagatctcagctcactgtaacctccgcctcctgggttcaagtgattctccagcttcagcctcctgagtagcttggattacaggcacccaccaccatacccagctaatttttgtatttttagtagatacagggtttcaccatgttggccaggctggtctcgaactcttgacctcatgatccgcccgcctcggactcccaaagtgctgggattacaggcatgagctactgcacccagccctctctcactcttcattctttctttactttttgttttcaaagttatatatacatataaagaatcagatagtactacaagacctattacaataaaaagcagacccttcccactctaatttcctcctcctcagaggcaactactttcaccaccttttttttgagacagggtcttgctctgtcacccttggcatgatcacagcttactgcagcctcctcgatgccccaggctgaagagatcctcccacctcagcctcccaagtaactgggactacaggtgcaagccaccatgcccagctagtttttttaacttttttgattattttattartttgtttttttgagacagagtctcactctgtcgccaaggctggagtgcagtggcactgtgtcggctcactgcaacctcygtctgctaggttcaagcaattctcctgcctcagcctcccgagtagctgggattacaggtgtccaccaccatgcccagctagtttttatatttttagtagagacggggtttcaccatgttggccaggttggtcttgaactcctgacctcaggtgatccacccaccgtggcttcccaaagtgttgggatgacaggcgtgagccaccgcgcccggccagtttttttattttttgtagagatggagtatcctcacgtygctyaggctacacctggcctactttcaycacctttagatgtttattttggcatttacctccctatctctaaacatgcttatttggcaacttcatgatttttgtttttgtttgttttttttgttttgagagagggtcacgctctgtcgcccaggctggagtgcaatggtgcaatctcagctcactgcaacctccgcctcccatgttcaagcgattctcttgtctcagcctcctgagtagctgggactacagatgcgtgccaccacgcccagctaatttttgtatttttagtagagatggggtttcaccatgttggccaggatggtttccaactcccaacctcaggtgatccgccagtcccggcctcccaaagtgctgggattataggcatgagccaccacacctggcttgtgtgacagatttttttcattacttccctcatggtttgatttttcaagggtgttttgtttgtttgtttgttttgtttttgagatggagtcttgctccaaattgcagtgttactgataccttctagtcttctgaaaataatgtttgtggaggaagggatcaagaaatgtagcaccatcatttaaattccctcaggaccaaccctactggacacataaacaatagcaacaacatctactttcaataaaatgttggcattgctctctgccaattaccttgagagcctgactctggaatgaaaagctctataccgaccctggccttgaactcctgacctcaagtgatcctcccgcctcgacctccaaaagtgctgggattgcaggcataagccaccatgcccagccaaggatgctttttckgattcaatcatgttttatactatctcttacctaaaagcttcaacagttgtccccacctccccctttttattttggtttctgtctttcatgttagaaagtttctttacatacctagaaatttttgctttctgctcacatttaagagcgggtgcttagcttgacatggtggctcacatctgcagtcccagctactcaggaggctgagacaggaagatcacttgagcccaggagttcaggactacaatgacctatgattgcgccactgcactctagcctgggtgacacagagaggccctatctcaagaaactaaaaaaaaaaaaaaaaagagtgaggtgccaagaagttgactagaatttccatgtacacagttgggacttgccaactgtgagtttcagtatgaggtgatctggccaactgactggttggagaacccctgacgttcacatcstaaggtcttttctcacttaccaaattccccagagaagagtcttccagtctcttacctggaaagtataagccttgtgctggagttctggaaactaccactcactatataaactttcgtttttgtttttgttttttcttggatacagggtctcactctgtcacccaggctggagagcagaggcgtgatgaggactccctgcagtctcaactcccaggctcaagcaatcctcccacctcaggcccctccaagtggctgggactatttttatactttttgtagagttagggtcccactatgttgcccaggctggtctaaaactcgtgggctcaagtgatcctcctgccttggcctccaaaagcgctagaattacaggcatgagccaactcacctggccctaaactttcacttaatctctgtttttcttttttggagactgagtctcactctgttgcccaggctggagtgcagtggcacaacctcggctcactgcaacctcctcagcctcccaagtagctgggattacaggcacccgccaccacgcccggctcattttttgtatttttagtagagacgggggtttcaccatgttgcccaggctggtctcgaacttctgacctcaggtgatccacccgcctaggcctcccaaagtgctgggaatacaagygtgagccaccgcggccggcttaatctctgttttcaacgcagtacccttgccctcaactgtactcaggtgctctctaagctaaaaaacctgttttccatttccgacaaactccagtattctgatgggttgggggagatcggttgccaagatatatagagtcaataaagagatctggaggtctaacttcaaataatcctcctaattttagtaccactttcaccccagctgtaagcgatgctactaatttcatggtaaatcaggttgcttgtaagctttctttgctgctggcttagttaccacctcactgcaaaatgagtctgttttccagcatctgtctaaagttttgctattaactcctctccctttgactcctttttaaaacaactttaggccaggcacagtacgctcacacctgaaatcctggcactttgggaggccaaggcaggaggatcctttgagtccaggagttcaagaccagcataggcaacacaatgagaccctgtctctacaaaaaaaattaaaaattagccagatgtggtagcacacatctatggtcctgactcttcagaaggctgaagtgagaggtcacttgagyatgggagtttaaggctgcagtgagccatgactgagccactgcattccagcctgggcagcagagtragaccttgtctcaaaaaataaaatttttttaaaaaagcaactttctgttattttattagcatttagggaaggattaagtcaaatgccggacccatcaagttttttgttttttgagrcagggtcgcgttctgtcacccaggctggagtgcagtggcacaatccatggctcactgcagcctcgacctctcaggctcaagaaatcctcctatctcagcctcccaagaagctgggaatacaggcatcagccaccaagactggctattttttttaatttttaatttatactttttaaaaaattatttgaatttatttatttattagagatggagtttcactcttgtagcccaggctggagtgcaacagcgcaatctcagctcaccgcaatctccgcctcccaggttcaagtgattctcctgccttagcctcctgggtagctgggattacaggcatgcgccaccatgcccagctaattctgtatttttagtagagacggggtttctccatgttggtcaggctggtctcgaactcctgacctcaggtgatccacccgcctcggcctcccaaagtgctgggattacaggtgtgagccaccaaacccagcctttattttttaaatataggrgatggggtctcactatattgcccaggctggtctcgaagtccttagttcaagtgatcctcccacctcagcctcccaaagagctgaaattacaggagtgagccaccatgcccagcccccaaatttttttataaagacagtatctcactatgttccccaggctagaccattcagtttaactgagtctaaccttcatgtgctaaccttgggcaaactagtttcattcttgataatctactataaactgttacaaacgatctttccaaaaaaggtaattctggtcataacacacttcttaaaaaccctttaaaggctcaaatgtcttcagactcaagtccaaagtacatagcttgcaagccttttcctgattccgctcctctctccagcctcaccattgtcatacctaacccccaccacgctccgttcactccaggcaggcagaatcccttgctggactccacatgcgctgttcccgtcacagcaccatgctgttgcctatgccgtctcccttttccactacaagctytcatccacgtagttcacctttaagattcagctcacgcctgtaatcccagcactttgggaggccgaagagggtggatcgcttgaggtcgagttcgagaccaacctggccaacatggtgaaaccccgtctctactaaaaatamaaaaatcagccgggcgtggtggcgggcgcctataatcccaggcacccgggaagctgaagcaggagaatcgcttgaacctgggaggtggaggttgcagggagggagatcttgcgactgcactccaacctggacgacagagtaagactgtctcataaataaataaacttgtgtagaataaactagaggccacagacagtgtcaagaagatggacaggtctgaatggcctcgggctaggggatattccactgtcgcctctgactacgggtggtcctgtggctgaggcgcagcgggccctgggagttgtagttcatcaagckgaccgaggaggcgaggctgcgctgagcatcctgggaatcgtagtgctcgctacacggtgccctctgcgcaggcgcwcaccgagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggttcgggatgcgacaacctggacagcggggagcgaaagcgtgaccgggctgcactggcagcctgacctgggacttggagcagggttgggragggaatcctacgtgcgtgcgcagcgaaagggcgggactgagaggggctggcctagggagaggctacactggcagtctccgtgtgtccccgccctctctccgccctggcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaaaaaaaaaaagccgggcttggtggtgagtaccggtaaccccagctacttggaaggctgaggcaggagaatcgcttgaacccaggaggcggaggttgttgtacttagccgagatcatgccattgcactccagcctgggtaacagagcaaaaactctgtctcaaaaaataataaataataaaatgaaagaattaaaggtggccctgcatacctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatggaaaaactgaagcccgagcctgcccacagctatgcyttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaartacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgytgcgggtacaggaggatgcaggagagggctgaggtgggggaggaacaactggtgtactgggagagagatttgggacgagggggaaccatcagcaaaaaatgaagccaggaatcacagtaagggcgcaagggctgaggccagttgtttccataaagaagactcaatcattacaaaaataatttttagtagttaaaaaacacacatagggccaggcatggtggctcacacctttaatcccagcactttgggaggcctgggtgggcagatcaccaggtcaggagttcgagaccagcctggtcaacatggtgaaaccccgtctctactaaaaatacaaaaaattagccgggtgtggtggtgagcacctgtagtcccagctactyaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcrcaccttcagaggccaaggtgggaggatcacttgactyaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaarcttccattcttggctcaggtattagagtcaggtgccacaggtatataatgaaccggcagatctggaaaggataaagaaattgagagatgagctctgagatcaaggacagtgtttgggggatgakagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctrcagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggacyggcactgtggctgatktcctggctgtgggaccagcatttttttccggctgcttctggttctccccagcctcaggcccarctgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaarttggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcacccatcgcaagggtcaaggctgatacccctataaataaaaaacattaacaagagaaaagcctaacatttatttaatcacagttttacatgacataggaaccttcagaaacaaagacccgagaaaagtgcatttttatgcttargcttgctgtgaagaatggacagctgtatagacgtatgattggattggccgggcgcggtggttcacgcctgtaatcccagcactttgggagsctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcytgaacccaggaggtggaggttgcagtgagccaagattgcacaactgcaytccagcctgggcaacaagagcgaaactccatctcaaaaaaaaaaaagtatgattggacaaaaaggrtatgatctaatggcaataaatggggggtgggggaccagcaaggcctgtccagattcttcttggcctccaagtatagggcaggacccmtctgaaatgagagcctatgacctacttccacgtgaagttagagaattcctttatggccagctctcacagaaaaacagaaagagcagagtgagctacttacttctgctgttttcktaattaccaaggtgccatgttttggagtgtcatgttctgagctccaacagagggaagagtgagtcagggaggttatcacgctgaaggccagaagaggaaggcagatgacagacggaaaaggtaggggacaaggaagtgagcgaaccacgagacaagtgggtgtcatgaactgggaaatcagaagaccagggttggattccaagctctgctgtaaagtagctgtgtaacctcaagtagctgtgtaacctcaccccttgtccctaacctctccggaagtgatatcttccagctgtaaaatgaggataattgtagtaccaagggccakggttcctgggaggatgaaaggaaatcatagaggtctaggcagacttaaaggcagtatggatgacacagatcctacaaaactttagctaggacatggaagaaccttttgtattttaatggttgtatatttattttaagagaaaaatataaccaatgcatcaaacttgtgacttcacagatattattgcttaggataatttactatttaagttttctttctttttttttgttgcccaggctggagtgcaatggcctgatctcggctcactgcaacctccgcctccaggttcaagtgattctcctgcctcaacctcctgagtagctggaattacaggcacatgccaccatgcctggctaattttgtatttttagtagagatggggttttaccatgttggtcaggctggtctcaaactcctgacctcaggtgatccaccggcctcaacctcccaaagagctaggattayaggagtgagccaccgtcctggcctctacttaagttttcaaaactagtttgtgcacacttaaaagtaattcatttcattgtatgtaaatttgaactcaaaagaaaaaaaagcattaaaatattgaactctacttaatatacatgctgaaatgtcttgggatgaagtgcaatgatgtccrcaatctgccttgaaatgcatcaagaggccgggcactgcggttcacacctgtaatcccagcactttgggaggctgaggcrggtggatcacctgaggtcaggagtttgagaccagcctgaccaacacggtgaaaccccatctctactaaaaaaatacaaaaattagctgggcatggtggcgggcacctgcaatcccagctactcggaaggctgtggcaggagaattgcttgaacctgggaggcggaggctgcagtgagctgagggcaccattgcactccagcctgggcgacagagcaagactccatwaaaaaaaaaaaaaaaaaaaaaaaagaaatgcatcaagaaataaggtgatggatgatggatagaagaatgaatagatggatacttaataaagcaaatatcgtgtaattgctgtaaaattgatagtgtaaaatatatgtttatgtaaatatgtaaaatatacatatataaataaaattgtagaatctaggtggaggcactggatattcagtgtgccattctttcaacttttgtatatgtgtaaattttcataataaaatattggaaaagaaaaataggccaggtgtggtggctcacgcctgtaatcctagcacttttggaggcygaggcgggtggatcacaaggccaggagttcgagaccagcctggccaacatggtgaaaccctgtctctactaaaaatacaaaaattagccaggcttggtggtgcgcgcctgtaatcccagctactcaggaggctgaggcaggagaatctcttgaacctgggaggcagaggttgcagtgagccaagatcgtgccactgcactccagcctgggtgacagagtgagactccatctcaaaaaaataaaataaaatagtactttgatttcaagaaaaatattaataagtagacaatagcacacgtggtagaatgaattggcaaaactcatgaaggtgatggtgaatgatcaccccgtttggcaaacagggactcgagtctaagtactttggacaggatcagaagaaggttctaggaatgtgcggccccaggggaaaaggctcaggtaaagaaaactgtcaggtggaagctgctaagccctggaggcagagcctgaagagcagtggaaaagtctcacctttgagatcaagacagctcatcaattcctgaacccatgggtccttgttgccyccacacacgctccaggaaaggagctggaacctgcggaggagagacctgggcttagctgcggcgccttctttccttccccggctccttcctcattccagaggcgtgamgttgccaccaagaaagagccctttctcctgggactgggaaactccccagtaggtgagacggagtcatgaagtttcggggaatgagagcaaacggaacccggagatggggctcggtgagccgggaaggagttcaggctggaccagagagggtcctggaggcacctgcaaggaggggccgcccaggcgctgccctcgcagaggcaggtraaattacctcgtgtagtatagacaccgatggtaagctctcaggtgtttccggagacgattcatgaactgaaccgatggcggggagtcggaagaaattcttttaccacaataacaacttccagtgacgctgccctcgttgccattgcctgcgcrggacggaggtggtcggcacccattcccaggcccagggtccccactccgctgttccctggcatccaatccacagccccakgacagcctctcggtggacccagggtcagagcgccaggctcaacccacacatcatcacgccccckacaacatccataatcccgcccggagccaggcgtccccgggcctctgtccccaaccccaggcggctggctggctttcctcttgtccccgctgccttcatccactcaactccgtgggcctcgtgtcccctccccaactcacccccttcccgtgacaggggaatctgggtcccctgccccgcccccggctaacctggctgagtcaggtacaccagcaggagcagaagcaggagcaggagcacgcgggacccgggccgcaagtcccgtcccrtctcggggctccgcggactctgcggggatggagccacctcgctctgactcccagacatgctccggcgcgtgacgtccagctggtgtctcaatggctttcgccggggaccggaggagacggcggccggagaggaggcgcgagccagctgcacccmccggccctgctgtgccccgaccgtgckytcagtactcggcccgcgccatgccagcctctggacgcagggaaagccgaggaggtggagctcccgcgccctgcgcccccgcactgggcccggctccgtcgagggaaggccaggaatcttggaagaaaccgaaagaaaactccggcggcgggcgaggaggggcgggaggacgacggcccgaggagccgattcggttcggttcaggaggccgcccgcctggcccgtccgccgacctgtgaggcggctgcactgccggaccggccctcctcctccgaggcactttcacttccccgatccgggcgccgcgggacccagccgcgctgcatgagcctcccgggcggcccggtggagagagtcgccgccagccccggccgcgcgcacctgcggggcagccacccgcggacgcaccgagcccggggggcgtggccgcccgctgagccggcgagggctcgggcagccctgacgtcacaaccgcacccgcgcaccctccaccgcgaggtatttaccttcgaaaagtggtggcggctgcaggtaccggaggagtggggcgg

SEQ ID NO: 13329 - DNA, 18895 bp, Homo sapiens
cggcgggccccccgcccaggtttcttttctcctcggcgccttcgggtgggggcaggaggagcagagggagttggggatgggggtgggggcccgggcgccgggcgggccccgctcccttgagcaggcttgtaaaccaggtggaagatgaaggcattgcagtacctgcgggggcgcggggcgcagtcagggaccacggggcgggactcccaggggtcggcgctcccaggggtcggggctcccaggggcgcggtcagggaccagggggcggggctccaccgggcggtcagggaccagggggcggggcttgcccctctgagttccagggcgtggggctagactcagggttgggtctgttggagggtcgcggggtcttttgtgggttggggagattccgtgagctagatctaaagaggggtgtgctgggggatgtcgagacctcccatsggggcgacgagtagtggggacagagaaggcaggttgctgggctgggggcaggagggccccaggacagcagggactagggtagaggtgggccttcgaggatgtggagccagagagtaagagaagttaagggtcaggaaggaaatagggtcgcagacccttaccaggacatgcagttgtcggccgctctgaggcgaaagggggagcggaaggggttgggctggggagggctggtgccccctccagtggccaccgccatggtctggccgtccatcacacagctgtactcgctgctctcggtgaagaaggctggcactcggagggactggggtggagcgagagtcgctctgagaggcccctccccaaatccatcccagcagccagaatgacagaccgggctgaaagccgaggtccccggacagaccgggcggaggggagcagggggaggacggagacagacacagagagaggcagggggacccgtgggcactccccaggtttgtggagcaggtgatggtgaagaggaggagagcccagagactttcagaaaaggagatggggaggggccaggcmggaggggagagaagttcccttttgcccccattgcccacctgtaaccggggcagagacctcagccacgtatccttgagagcaaacccrgagttaaatcctgcagacagagaggagggagaagctggctcccacggtgggcttctctcccaccttccccacatgcctaaccctgagacccaggcttttaccaataaccaggtcaggcttgggcccctggaacaggtggtagggccttgctgacaccttgatctgcaggtccctgcggccccctttctccttagtgccagagctgggccgtgctgatatgccggaaccaggccggacagacacctccaggctgtcctgaggggccccaggagtggggtggaaaagccactggaagtcagggaactggaggatgcaccaggcaagatggggagtggggggcagaagggcaggacccaaccaggaggtcactggaggggtcagggctgaaaagcagggccccctcagccctcaccctctgcagggtaaaatgctgctcgtcgctttcggggggcaggccatcacctacaaactgcagctccagggccacatgggggagcaggaccaaaagctcctgaaggacagaaagaaagaaagatctggggtctaccctgtgcccacccccataccaaaatgcccaaccttcaggcctggggtgacttacccaaaacaccatgacaaggtcaaactccttcccggcctccaccacgtggatcttcagtgactgtttgttttggatgttgagctcagggactgggtgaaaaaccagcgctttaaggatgtggtccactctcactcccccatcctgctccaccccccactccgctctccttacaggactggggcaccaggtgggtgatgacgtagtacacggtcagcgggtaggtgagaagcacggctatgggggagtccaagctgaggccccgccatgtgtagtaatcctgccatgagcctggcaggagagggttgctagaggacctggccctggaccsccaccccytctagtctaacaaacctcttcttcacagccacccaggctctggttctccagtccctggccctacccctagcttccacagggcccctccagctcaccaaaaacaccccggggtggatgtgggggcacaggaggcatcagggcagtcccgtctccctggagaagctggtaggggtctcctgagaggatgaaagaargaggggcctggggtcagggagacccccacctgacccatytcyttcttccttccaaaggggctgtattccctgagacagccgcagtaagaggaatgggggtttgcatagggatggggtttctgggtggagttggtaggggtgattccattgagggctgggaaaggcctgaaatggccctggtgctgttggtaggggtcagtgtgtatgtggagggatcatctgggacccagacaacttcttcccagtccttccctctaggccaaggggcccaygcctggagagaccccacgcaccaccgcgaagaaggctgagggatggcgtgttgcctcgggggtgtctggagaagcccgggcctggaatcagcatgctgagctgggtccaatagccaygagtgaggccccgagaggccaggaaggcctctttgttgaaggtttcactggtcacctctggagaaggagaaggggaggagttgaggtgctgggctagaaccccagacatttttttttttttgagacagagtcttgctctatcacccaagctagagtgcagtggcgtgatcacggracactacagcctcgacctcttggactcaaacgattctcccacctcagtctcccgagaattgtgaccacaagcgagtgcmccatgcctgactaattttttctattttttgtagagacagagtctatgttgcccaggctgatctcaaattcctgggctcaagttggcctcccaaagtgctgggattacgggtgtgaaccattgcccggcctagaaccccagccttgaactctccctagcctcccgcgaggaccctggttctaagtctggttccagtcaggccgggaactaccatttctgagtgcctccagcgtaccaggcaccaagccaagataatccttgtaacaattccatgggccttctccgtatccctcatgaggacacggaagcttcaagaagtaaagtggtttgtttaaggycacactgcagttagtggtggagctgggaagcaagtaagtgtttgaatccctgtcccccaatccctgcackctctcagggacccagacactcaggcctcggcttcagagaccctgtctccagccccaaacacccagcccctgcccttgttccagggatctaggctctagccccagacactcagccttcaactgcaggaccctgttcccagacatctaattcccagtctcaaagacctggtcccagtttcccccaaccattctgacctccttatggtacctgcrgtgtaggtaaaaggcagggttgccagttctcctgcccgctccatgaaggctgcaagccttgggcaccaaaatcggtgactcacatcatctgggcaccgctgccagtcagcccggagacaagcctctccacaatacaagacagcactacactgggggctggggacacagcrggtggtgggcacctagtgttaacctctgtaggtcctgtctgctgttcaactgcccagcagctgcccatatgtcactcggtctgtttgtcttacaccctctaaccgcctgtaacagtctgtattgtttcctctgcatcttctcatgtccctgcctctccttctgtctgctaggcgccccccaccaccctgccttccttctatttgyctattggggtcttcctctcccccagctttggggctgctcaccaaggtgtcagcttcgcttcaaagctgtgcctgtgacacacrtggcaggttcgagcacgaagggaagcaaaggtgaagcctggccggggaccccatgtccgcattggggttttggctaacttcacacctagccttgggaccaagctctccagctctctaaatgcagttgggggggagatggcatcaggctggaggaggtgcttgggaatccagggcccgagtcctccccagcctcagataccagatttctataccgatgcagccgggcatctcccacagtaagctgtcggggctttcggggatccccagagcccatgggacaggccatgctgtgacagaggagagcataggcccaaggagccaggtccttggtccctgagccccagcttgcggttccctgggctccatccactagcagatcaatgcccaagatggtgccatgctcatccgtcacaagtaagagacaggaaacgtgcaggggggcagcctctggggaaagagggaaaagttgaggtggtagggggcagcgagagacaaatgtggtcagggtcaggagtaccaaactcaaatacctacggggctaggcaagtaacctcactgagtaaagggctctgggtagagagggcacgctccttctaaaggggacagctgctacagaggaccagaatgcgctgccatgcagaaatgtaggcccactgtcagagcttgagatttttcttgggaatgtgtaaatccagacttctggatactttttttcttgcaatgtttaaacattaaattaaaaaaaaaaaccccactgtgggtcaataaaaacaccttttcaggccagattggcctgaaggccagcactcagaactagtggcaggggagggctyccgaagggaggatggctgggcaaggggtagggcagggccagccctgggttcttaccactcctctgtcccttcctcttctggggtcttgtttcgttctccaccctgtcctctcggcagccatccttgccacctcctgcctcccgggcagcctcctctgactctcctggagggtttgtttcctggggggactccctgctggtaggggctagctcccggtcctcctctggttccaccttctctgtgctgcctgcacccccgtcctctctcttctcytcttcttcatcttcctcctcttcctcctccccttcctccccatcctctaggctgacaaagctgatgtaggggctcaggtctcgcaggtggagtggagggttgtctcccaggagccaggcagtccccaggcctggtccaggacctggttctgccccttgccccaggctgatgcccacactatggttgggcaggacatggagcacccaaagggcagggtcctggggtagccttctgatctgggcctccagctgccggcagcggccctcaaggctagtccctacagctccacgctctgccacaaactttcggaaccagccgaagagaagggcagtgaaatcaaggaactcatcccggtatccagacacaaactccatgtcttcagcggcacagggccccggcccagactgagcaaaagaagggatayatggtgagggacaggagagcaatgatggagtttggggctgggtcacaaattgagggagagggtaggtttgagagtcacttagggttggatccgtggatatgctaggagcggagaagaggatttttcagggctgaggatgggagtttagggaggaaaatgggggctggacttgaaagtgggtgaccagggttggagaagactactcagggatgagatggtatttggggcttaaaattggagagttcacaccctcaaaagcagagtttaaattaaggctagagaggagagagggctaatcctatcgggaacggyttggtggggagggaagcattttggatgcgtctgtggggtatgggagtgggagcgagggggttccctgggctcggatctgcgtggcgggcagccccggtagacctagcccctcccggccgccccactcctccggtacctgcagccgccaccacttttcgaaggtaaatacctcgcggtggagggtgcgcgggtgcggttgtgacgtcagggctgcccgagccctcgccggctcagcgggcggccacgccccccgggctcggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgarmgcacggtcggggcacagcagggccggkgggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggttagccgggggcggggcaggggacccagattcccctgtcacgggaagggggtgagttggggaggggacacgaggcccacggagttgagtggatgaaggcagcggggacaagaggaaagccagccagccgcctggggttggggacagaggcccggggacgcctggctccgggcgggattatggatgttgtmgggggcgtgatgatgtgtgggttgagcctggcgctctgaccctgggtccaccgagaggctgtcmtggggctgtggattggatgccagggaacagcggagtggggaccctgggcctgggaatgggtgccgaccacctccgtccygcgcaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggtaatttyacctgcctctgcgagggcagcgcctgggcggcccctccttgcaggtgcctccaggaccctctctggtccagcctgaactccttcccggctcaccgagccccatctccgggttccgtttgctctcattccccgaaacttcatgactccgtctcacctactggggagtttcccagtcccaggagaaagggctctttcttggtggcaacktcacgcctctggaatgaggaaggagccggggaaggaaagaaggcgccgcagctaagcccaggtctctcctccgcaggttccagctcctttcctggagcgtgtgtggrggcaacaaggacccatgggttcaggaattgatgagctgtcttgatctcaaaggtgagacttttccactgctcttcaggctctgcctccagggcttagcagcttccacctgacagttttctttacctgagccttttcccctggggccgcacattcctagaaccttcttctgatcctgtccaaagtacttagactcgagtccctgtttgccaaacggggtgatcattcaccatcaccttcatgagttttgccaattcattctaccacgtgtgctattgtctacttattaatatttttcttgaaatcaaagtactattttattttatttttttgagatggagtctcactctgtcacccaggctggagtgcagtggcacgatcttggctcactgcaacctctgcctcccaggttcaagagattctcctgcctcagcctcctgagtagctgggattacaggcgcgcaccaccaagcctggctaatttttgtatttttagtagagacagggtttcaccatgttggccaggctggtctcgaactcctggccttgtgatccacccgcctcrgcctccaaaagtgctaggattacaggcgtgagccaccacacctggcctatttttcttttccaatattttattatgaaaatttacacatatacaaaagttgaaagaatggcacactgaatatccagtgcctccacctagattctacaattttatttatatatgtatattttacatatttacataaacatatattttacactatcaattttacagcaattacacgatatttgctttattaagtatccatctattcattcttctatccatcatccatcaccttatttcttgatgcatttcttttttttttttttttttttttttwatggagtcttgctctgtcgcccaggctggagtgcaatggtgccctcagctcactgcagcctccgcctcccaggttcaagcaattctcctgccacagccttccgagtagctgggattgcaggtgcccgccaccatgcccagctaatttttgtatttttttagtagagatggggtttcaccgtgttggtcaggctggtctcaaactcctgacctcaggtgatccaccygcctcagcctcccaaagtgctgggattacaggtgtgaaccgcagtgcccggcctcttgatgcatttcaaggcagattgyggacatcattgcacttcatcccaagacatttcagcatgtatattaagtagagttcaatattttaatgcttttttttcttttgagttcaaatttacatacaatgaaatgaattacttttaagtgtgcacaaactagttttgaaaacttaagtagaggccaggacggtggctcactcctrtaatcctagctctttgggaggttgaggccggtggatcacctgaggtcaggagtttgagaccagcctgaccaacatggtaaaaccccatctctactaaaaatacaaaattagccaggcatggtggcatgtgcctgtaattccagctactcaggaggttgaggcaggagaatcacttgaacctggaggcggaggttgcagtgagccgagatcaggccattgcactccagcctgggcaacaaaaaaaaagaaagaaaacttaaatagtaaattatcctaagcaataatatctgtgaagtcacaagtttgatgcattggttatatttttctcttaaaataaatatacaaccattaaaatacaaaaggttcttccatgtcctagctaaagttttgtaggatctgtgtcatccatactgcctttaagtctgcctagacctctatgatttcctttcatcctcccaggaaccmtggcccttggtactacaattatcctcattttacagctggaagatatcacttccggagaggttagggacaaggggtgaggttacacagctacttgaggttacacagctactttacagcagagcttggaatccaaccctggtcttctgatttcccagttcatgacacccacttgtctcgtggttcgctcacttccttgtcccctaccttttccgtctgtcatctgccttcctcttctggccttcagcgtgataacctccctgactcactcttccctctgttggagctcagaacatgacactccaaaacatggcaccttggtaattamgaaaacagcagaagtaagtagctcactctgctctttctgtttttctgtgagagctggccataaaggaattctctaacttcacgtggaagtaggtcataggctctcatttcagakgggtcctgccctatacttggaggccaagaagaatctggacaggccttgctggtcccccaccccccatttattgccattagatcataycctttttgtccaatcatacttttttttttttgagatggagtttcgctcttgttgcccaggctggartgcagttgtgcaatcttggctcactgcaacctccacctcctgggttcargcgattctgcctcagcctcccatgtagctgggattacaggcacatgacaccatgcctggctaattttgtatttttagtagagactgggtttctccatgttggtcagactggtctcgaactcccgacctcaggtgatccacccacctcagsctcccaaagtgctgggattacaggcgtgaaccaccgcgcccggccaatccaatcatacgtctatacagctgtccattcttcacagcaagcytaagcataaaaatgcacttttctcgggtctttgtttctgaaggttcctatgtcatgtaaaactgtgattaaataaatgttaggcttttctcttgttaatgttttttatttataggggtatcagccttgacccttgcgatgggtgaggaaaagatattactttttctcccctacacctctatctgctttttcaccttgtctcctgatagtcctgattcctcatttctttcctttccagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagytgggcctgaggctggggagaaccagaagcagccggaaaaaaatgctggtcccacagccaggamatcagccacagtgccrgtcctgtgcctcctggccatcatcttcatcctcaccgcagccctttcctatgtgctgtgcaagaggaggagggggcagtcaccgcagtcctctccaggtaaactggacctttgaaccctccccccagggacccagagccttcctgacaggcatcctgacccagtggctctcaggtggctggaaacctggccttggcacacaagtatcaaggttgtctgcacaaggttgactctgggccctctgaggacagtcagtcggggactgyagacagtggagagggaaggaagccaccacaggcacaaggactagtgcttggagcaacatcatggagaagatggctagagcaagctagtgggagatgaagctgtggagggaggtgagggccagtcattcaattcacaaattttcactgagcacctactgtgggccaggtcatagtgttgatgtcttcatctgattccctagttcaagctmtcatcccccaaacactgtccttgatctcagagctcatctctcaatttctttatcctttccagatctgccggttcattatatacctgtggcacctgactctaatacctgagccaagaatggaagyttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctragtcaagtgatcctcccaccttggcctctgaaggtgygaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctragtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcarcgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaatgaagaagtatgtaytttcattaggccaagtctgcgggaaggctggggcagcagcatgaagtgtttgaggaagtgggttgggtatgtcagtttccatctcctctctgagcctgtcagggtgtttctggagtgcagagcaggagcaccctgctggagaggccaargcatagctgtgggcaggctcgggcttcagtttttccatgcccaccatttgcccctttgtcctagggtactttgaccagcagggtatgttggtgctcatmctccccaccctacatgttcccaggttctgtcccatggcacaggtgatggtctccctctcagctctgggtccatctccctggcctagttctccagcatctgctcacaggttcgagccacatcactgagcttgaggcgggcatagtccactcgcttcagagccatctgacagtccttcctcgaagagtagctggagccctcatggggctgccctgtggccacctacaagacagactatcaatggagcaccatctcctttaccctaactccaaccaggcatcaggtctcgtctcatttcttccctgagtttgaatttgttaggccatctggtagctgggtaaataaatcatttaacttatgttaatcttgtctgtaaaatgggggtgacaataactacttcctagagttgttgaggattagataaagtaatgcagagtatctggcacaccgtaaaaattagtaatggtagtggtccctgcgacgatttcagaaccttctcaatcctgtccctcttctcaggatataaggatttgggacctcgtggcctggaggtcaggccaagtttccagtgacaaagttctgtagttctagcattatttacacatcttctgctaggcacatgtgatgttacccagtgaggtatgcagggccacctttaattctttcattttattatttattattttttgagacagagtttttgctctgttacccaggctggagtgcaatggcatgatctcggctaagtacaacaacctccgcctcctgggttcaagcgattctcctgcctcagccttccaagtagctggggttaccggtactcaccaccaagcccggcttttttttttttttttttttttgagacagtcttgctttgtcacccaggctggagtgcagtgctgcaatcttggctcactgcaacctccacctcctgggttcaagcgattctcctgcctcacccttccaagtagctgggattacaggtgcccgctaccagcccagctaatttttgtatttttagtagagacggagtttcaccatgttggccaggctggtctcgaactcctgacctcagatgatccacccgcctcagcctcccaaagtgctgggattacaggagtgagccaccgagcctggcctaatttttatatttttagtagagacgaggtttcaccgtgttggccaggctggtctcgaactctgtcaagccactgcgcccggcccattctttccttttagaggaagaaacccgctctggatggccggctggggaggtctggtcctgcccagttaatgctccaccctggatcacccaagcctgaggctttgacccagagctggggttcgctcgcagaaccccccagacacaccgacctgggtgaggtagcggatctgagctgacagctccgcctccacgtgttgcactgaagcggtgaaggccgccgcctgccggtctaggagccgctcgttagttttttccttggacaattctaggatcacagtacctgccagggcggagagagggcggggacacacggagactgccagtgtagcctctccctaggccagcccctctcagtcccgccctttcgctgcgcacgcacgtaggattccctycccaaccctgctccaagtcccaggtcaggctgccagtgcagcccggtcacgctttcgctccccgctgtccaggttgtcgcatcccgaacctgcattctgaaggatggcgccgatttcccgttcaatgtcttccagagcgcgtagtctctcgttcgccaggctgtaggtagccattatcactctgggaattctcaccaagagtttctcctcagaaacgcgacgcttgttccggaagtggctctcggtgwgcgcctgcgcagagggcaccgtgtagcgagcactacgattcccaggatgctcagcgcagcctcgcctcctcggtcmgcttgatgaactacaactcccagggcccgctgcgcctcagccacaggaccacccgtagtcagaggcgacagtggaatatcccctagcccgaggccattcagacctgtccatcttcttgacactgtctgtggcctctagtttattctacacaagtttatttatttatgagacagtcttactctgtcgtccaggttggagtgcagtcgcaagatctccctccctgcaacctccacctcccaggttcaagcgattctcctgcttcagcttcccgggtgcctgggattataggcgcccgccaccacgcccggctgatttttktatttttagtagagacggggtttcaccatgttggccaggttggtctcgaactcgacctcaagcgatccaccctcttcggcctcccaaagtgctgggattacaggcgtgagctgaatcttaaaggtgaactacgtggatgaragcttgtagtggaaaagggagacggcataggcaacagcatggtgctgtgacgggaacagcgcatgtggagtccagcaagggattctgcctgcctggagtgaacggagcgtggtgggggttaggtatgacaatggtgaggctggagagaggagcggaatcaggaaaaggcttgcaagctatgtactttggacttgagtctgaagacatttgagcctttaaagggtttttaagaagtgtgttatgaccagaattaccttttttggaaagatcgtttgtaacagtttatagtagattatcaagaatgaaactagtttgcccaaggttagcacatgaaggttagactcagttaaactgaatggtctagcctggggaacatagtgagatactgtctttataaaaaaatttgggggctgggcatggtggctcactcctgtaatttcagctctttgggaggctgaggtgggaggatcacttgaactaaggacttcgagaccagcctgggcaatatagtgagaccccatcycctatatttaaaaaataaaggctgggtttggtggctcacacctgtaatcccagcactttgggaggccgaggcgggtggatcacctgaggtcaggagttcgagaccagcctgaccaacatggagaaaccccgtctctactaaaaatacagaattagctgggcatggtggcgcatgcctgtaatcccagctacccaggaggctaaggcaggagaatcacttgaacctgggaggcggagattgcggtgagctgagattgcgctgttgcactccagcctgggctacaagagtgaaactccatctctaataaataaataaattcaaataattttttaaaaagtataaattaaaaattaaaaaaaatagccagtcttggtggctgatgcctgtattcccagcttcttgggaggctgagataggaggatttcttgagcctgagaggtcgaggctgcagtgagccatggattgtgccactgcactccagcctgggtgacagaacgcgaccctgyctcaaaaaacaaaaaacttgatgggtccggcatttgacttaatccttccctaaatgctaataaaataacagaaagttgcttttttaaaaaaattttattttttgagacaaggtctyactctgctgcccaggctggaatgcagtggctcagtcatggctcactgcagccttaaactcccatrctcaagtgacctctcacttcagccttctgaagagtcaggaccatagatgtgtgctaccacatctggctaatttttaattttttttgtagagacagggtctcattgtgttgcctatgctggtcttgaactcctggactcaaaggatcctcctgccttggcctcccaaagtgccaggatttcaggtgtgagcgtactgtgcctggcctaaagttgttttaaaaaggagtcaaagggagaggagttaatagcaaaactttagacagatgctggaaaacagactcattttgcagtgaggtggtaactaagccagcagcaaagaaagcttacaagcaacctgatttaccatgaaattagtagcatcgcttacagctggggtgaaagtggtactaaaattaggaggattatttgaagttagacctccagatctctttattgactctatatatcttggcaaccgatctcccccaacccatcagaatactggagtttgtcggaaatggaaaacaggttttttagcttagagagcacctgagtacagttgagggcaagggtactgcgttgaaaacagagattaagccggccgcggtggctcacrcttgtattcccagcactttgggaggcctaggcgggtggatcacctgaggtcagaagttcgagaccagcctgggcaacatggtgaaacccccgtctctactaaaaatacaaaaaatgagccgggcgtggtggcgggtgcctgtaatcccagctacttgggaggctgaggaggttgcagtgagccgaggttgtgccactgcactccagcctgggcaacagagtgagactcagtctccaaaaaagaaaaacagagattaagtgaaagtttagggccaggtgagttggctcatgcctgtaattctagcgcttttggaggccaaggcaggaggatcacttgagcccacgagttttagaccagcctgggcaacatagtgggaccctaactctacaaaaagtataaaaatagtcccagccacttggaggggcctgaggtgggaggattgcttgagcctgggagttgagactgcagggagtcctcatcacgcctctgctctccagcctgggtgacagagtgagaccctgtatccaagaaaaaacaaaaacaaaaacgaaagtttatatagtgagtggtagtttccagaactccagcacaaggcttatactttccaggtaagagactggaagactcttctctggggaatttggtaagtgagaaaagaccttasgatgtgaacgtcaggggttctccaaccagtcagttggccagatcacctcatactgaaactcacagttggcaagtcccaactgtgtacatggaaattctagtcaacttcttggcacctcactctttttttttttttttttagtttcttgagatagggcctctctgtgtcacccaggctagagtgcagtggcgcaatcataggtcattgtagtcctgaactcctgggctcaagtgatcttcctgtctcagcctcctgagtagctgggactgcagatgtgagccaccatgtcaagctaagcacccgctcttaaatgtgagcagaaagcaaaaatttctaggtatgtaaagaaactttctaacatgaaagacagaaaccaaaataaaaagggggaggtggggacaactgttgaagcttttaggtaagagatagtataaaacatgattgaatcmgaaaaagcatccttggctgggcatggtggcttatgcctgcaatcccagcacttttggaggtcgaggcgggaggatcacttgaggtcaggagttcaaggccagggtcggtatagagcttttcattccagagtcaggctctcaaggtaattggcagagagcaatgccaacattttattgaaagtagatgttgttgctattgtttatgtgtccagtagggttggtcctgagggaatttaaatgatggtgctacatttcttgatcccttcctccacaaacattattttcagaagactagaaggtatcagtaacactgcaatttggagcaagactccatctcaaaaacaaaacaaacaaacaaacaaaacacccttgaaaaatcaaaccatgagggaagtaatgaaaaaaatctgtcacacaagccaggtgtggtggctcatgcctataatcccagcactttgggaggccgggactggcggatcacctgaggttgggagttggaaaccatcctggccaacatggtgaaaccccatctctactaaaaatacaaaaattagctgggcgtggtggcacgcatctgtagtcccagctactcaggaggctgagacaagagaatcgcttgaacatgggaggcggaggttgcagtgagctgagattgcaccattgcactccagcctgggcgacagagcgtgaccctctctcaaaacaaaaaaaacaaacaaaaacaaaaatcatgaagttgccaaataagcatgtttagagatagggaggtaaatgccaaaataaacatctaaaggtggtgaaagtaggccaggtgtagcctgagcaacgtgaggatactccatctctacaaaaaataaaaaaactggc

SEQ ID NO: 13330 - DNA, 101046 bp, Homo sapiens
  misc_feature (1)...(101046): n = A,T,C or G, or insertion/deletion polymorphism (see Tables 1-2)
tcagaagtaatcctaaatcaagacaatggggacaaaattcaagaatatcagttatcagtataaatgtgaaataaccaaattctctgcttaaaggagaagacagattggcctgaaaaaccaagggaaaaaaaaaacaaaaacaacaaaccgtccagctataacgtatatgcttaaagcaaaaggaacaaagagaggctgaaaataaagggacaaggtaaaaaatagcaggctagtgcaaacatggaggagagacaacactactatcagccaaggtgggaattaaagtaaaaataagcagaataacagggataacaagctataatgataaaagaaacaatttatagggaagatgtaatattcataagcctgtatattcaaataatcactgtagataaacacataaagcaaggactaggaaaaatacaaacttaaaaaaaaaaattcaagtgagaaactttaayagagttctctgagaaccggacagattcagtaaacacagtatgtgcaaggacagagaagaactgagtaatacaacaaatacatctgatttagcagacatagagaaatttgaatcaataccttaaaaaatgtttgaagtcatgtatctaccataaaaaaaagcctaaacaaaatttgaaaaacatttttacagtcaatgttctcaaataattatctgcttaaattgggtggaaaaagatgaaaagtaactcccagtaatttgttacattactggatatccccaggatcaaggagggtaacaaaagcaaagccataagcaatctctagaaagcaatggaaggaagataaaagcaaaacttaggagataaaacaggaaatcaataaagagaaaaaatgaattatgagggggggaaaaagaagggtaaacaaatccaaaagctggttttctttttgttttttgagatggagttttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccttggacaagaccaaagtcatttaactattccaagcctctatagagaaaagggaaaacaatttgttttatgaagacagcacagttttaataacaaacccagatggagacataagaaaggaacaaaggaatgaatgaacgccataggccaatctcactcacaaatataaatgcaaaaatcctgaatacaatatttgctagcaattagattccaggaatgtatcaaaagcatctaccaatattaatccaacaacacagtataggggaaaaaaaatcatgcattaatagatgctgatgaggcatatgaaattcagcaaccaatcataatgaaaacagtaagaaaactgctggcagagtgtggtggctcacgcctgtaataccagcactttgggaagctgaggcaggaggagcgcttgagctcaggagttcaagaccagtctggacaacatggtgaaacactgtctctacaaaaaatacaaaaaaattagctgggtgtggtggcgggcacccgtaatcccagctaagtgggagactgaggtgggaggatcccttgagcccaggaggtgaaggctgtagtgagccgagatggtgctgctgcactccagcctgggtgacagagtgagactgtctcaaaaaaagaaaaaaaggaaaactgcttaaatctaattcaggatatttctgaaaaccaaaggcaaatactgttttctaaacaatagaaaattaaatctatttaaattacaaccgataattcggcaggaatgcccttccataattatttttaagcacttacatgaaaacttttacatgaagacctatacaaaaagcaaacaaaacccccatgtgctatccattatccagcttcaacaattagcaactgaaggtcaataatgtttcatctatttccacaatcatcaatgccactgcctggatgattatgaagcagatacgagatgtaacatttcatttatattccactacacatatctaaaaataagggcttcctaaaatgacaaaccttacacatagctagttctttaatgcaatcaaatatccaatcagtattcatattctctattctctcatttttttcatgtgaatcaagatccaagtaagatccagatattgcaatttcaccatgattatttaatactaccttggtgagtttactgaatataatgaaacaagaaaatcaaaagaaaacacttttttgctgattggactgaatacacagaaaatacaaatactcggctgggtgcggtagctcatgcctgtaatcccagcattttgggaggccaagacgggcatatcacgaggtcaaaagattgagaccatcctggccaacatggtgaaaccccgtctctaccaaaaatacaaaaattagccaggtgtggtggcgcctgcctgtaatcccagctacccaggaggctgaggcagaatcacttgaacccgggaggtggagggtgcagtgagctgagatcgcaccactgcactccagcctggcaacagagcaagactttgtctcaaaaaaaaaaaaaaaaagaaaatacaaatactctggttaaaaaaattctagaatacgataatttagtaaggtagctaaatataagatctcaagtaagtcaagtaccagcaacaaatatcaaggaatagaaatgggggcacatcatttacaacagaatttttaaaaatccaaacaagtagggaccaaactagaaaacaggtcctacataaatcaaatcatttttattttccccaaatgagtatgttatttagtccatttctaactggaatccctaayggtgtggcttttttcttaaaggattggataaaatgagctttaagttcacatggaaagattaaatgccaatgctgaggatagaaaagagcaggcacttaccttatcacctattacatgtatctgatttcaaacccacacagtgcaacatagaaataccatagagcacctctcccgcacctccacagaacccctcagcctcactgaaccctgtgcacacatatgggaaaatggagaaactatttgtcttaaactgacatttcaactttgctttgactttaccaagtttctcctgccatcttttttttttcctgtttttttttttctgaaacawaacttggatccacaatgttttctctcataatttattaactaatgtgaaatggaaggtgaaagaggaattatgaacctctgaagcacatggttttcagtgagaaagccttgatccagcaacacaaactgccaagcactgtgattaacttaaacactgggtgcaaattggaycaaaaatgtagtcaaatgaaaattttgttccttcagatcgtgtttattccacatgccagaagttgtttaaagttctttaatcttgacccacagcttatttcttccacagaataaccccaatacacataaaaaaccaattttcgcaaaacaaaagatagaagatgaacaacatctggcgatgtagaacccggaaggtccatgatcttattcaaagcatctggattctttggattcggggaaggtccacgttcagtatacccacataacactcctaacagggactggggcagggataagtggcatgtatgactactaacagaacagacaatacaaatggccttacctcacctctgctgccaaatgagttttggtgtccccattcctccagacaaaaaaaaaaaaaaaaatacccacaacttcttcttttacagcagtttctgtatgctggtattggggataaaaaggggccctgaattacatttatgaatgatagagggaaaccctggcccctttccctaggtcaccttgctagtttaagagccagtsagaatgtaaatctgatctaattaaaacgctcttgttctttattcctggctgtggcactggtgagagaaatcaaggtggaagttgaggaaaaaaaatcaggacaacctttatagctaatgagatcaatgccaagattatacataacagtacacatcatgagttaggatgctgggtggtgcaaagaacccattaatgggagctatcaaaaatcactgaaaacaatgaggctcaaatcagaagtatcaagaatcagctttcatgacccctacaccatgatgtttttctttatgacggcagaactattttgaaacattaaatatatcggcaggcactgtgattcaaaaagtatttgagaacctactaggtgctagacaccaaccgaggcaatgagtatgggtgacaacatgtgccctgccctcacagcaccaatagtccactggacaaataccatctggaacatcaggtaaacacctaagcctgtctggaggaaatctaatttgggcggaatcccacaagcacagactaggtaaggagaaggcagttaaggtgggaagtagccagatttaagagtttgggcaatggccaaaggtgcagaagtttgaactacaagaagttcagtgtagttggttcgtgtgtttccgtggagagaggacaaggtctggtggcactgacaagaattagaccgaaaaggtaaaaaagcaagccaggtttgtctgggccagtaggccaggtcacagttgggactccactgagaccacggaagccacaggtttgctcctcatccccgggccaactcggcggccyccaaccctataccctacmccctgctgcctgtccgtgcctcgctggtgcagaccttcgtcgcctctcctcgccgaaggtacccgcagacagggyctagtcgctctcccctcgcttatccacggcatccagccgatgggcttggaggtttgggggctggccagtcctccacgcctcaggraggaaatggcaccgttagaaagacaagatggccacacaagctctaagtgtttgtcgggcctaaacctgtatcctccctccaagcaccaaacctcccgacctcgaccgcactcgacgccccgaggcccagcaccgacgacagtgcagaggaattcccgcagggtcaacaaggggtcaccggaatccccactcccgcgcccgggcctgcccgtgtcggagccactgtcgccggcactaggaccgcccgggacgggggagcccacgataagtgccraagagcctgggctcggccgcccctcccccacaccgccccgccggcaccccagagccagccgaccaccgcccgagagtatgggacgagcggcgcgtcccccgcagctcctcgggagggccggcccacaacttgtgcggggtacaccggcgagacactcacccgccaaacagcccgagaayaggcgccgaccgaccgcgccgcggacccgcccagcgctcgcggtccgctcacagcccgccccagcccgccccgccccgcccagcgcgcaggcggattgcgtcaccgcgtcaccccgcccctttgccaactgcttcctggctcagtgcgacctggccttcttcccctcccccatgcggccggcttccgagtgcgcaagcccagagtcgtccgcgttgtccgcctctgcgcaagcgccgtgctcctcccacggcagttggccatatagaggctgggggtggggggggaggtcaagcgtagcctcttctccttttaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtcaagagattctttgccttcggtggtaaccgaatgggggaaagccctttgttaaaaggaaccaagtcccccttaaaaagaaaaagccgtcccggaagggcaattgttgcgggattccggaccattcccggggagggagcccttggcttctcttcctgtcttccaagaagatggcgccagccccgagctggggcgccgagtacgactgggcgggggacggcgagcgcccgcgcgaaactcgtctagcccaccaccgccgccgtctcgatgatcggggggcctctctgggattggctgcgcgcacgtcacgtggggccgacgggccctgcgcagaccatcgagtcgggcgtccctccccggggacgtggccttcctgtgcccgggctggggcccgccgccccgcgggggagggcggagctggcgcggcccctagctttctccttctggtgtggggcccgaggtgagacctggggagtgctccgcgagcccacgagcagcgacgtggctcggggacgggagggtgccgtgcctggctgcggcctgagcgggatgggcgcgggcggctccggcccgcgggttgtgccccggcccggggtgtcctttcctccctcccgcgtggcctggaggcactgcaactgttcgagactcacgtcaaggcttggcgcaaatacccctcgttcaggaagccttcctaggtttcccccgcttagaggaaacacttcctgagttcctaatggctgacccgcatggtgttgggaacctgagcctttctgacaccgtggcatgttgctagggtatttttgtgcgtagctcctttgaaaagtggttaggtgctcaaggctagctgctacatatcctctccattcgacttaaaaaatgagagggtcagacttgacatggtgtttggacgccatgtaaaatcgaaggaagtcgacttgggctttgcttattaaacagtgcctattatggtgaaattaaacgkctgaaggaatgtggatgagtcgtaatcttaaggaacatgacgatttgcccctcagttttgcgttttatgtcctcagattcatagctacctataccctaagccctcaatcaatgacttcacatttatttggtgtctgcttaaggatagtcactttcttagcagctaacttccttaaaaccctattaagataggttaagtcacaattagggttttgtctaaggctcctggtagcggcacattgcataataagcttaatgttcatttagggaagcaaatctgggatgctgaaacactggatgaaacgtagtgcttaggtttatattttgattttttgacatgtaaaagtatccctaggctaaattcattaagtacacatgatattaggatgcttggcaacagtatttaaaaatagttgaaaaggtgtttgggtaagaattatttccatcatttggattaccgaatctctgagtctgaaacatcaacctatcaagttttagacttggggaaaatggagctggagcctactgcctcaagtctcagggacagcgtttgaaaccccattaaataattcatcatgaggattaaactttcctgttactgctattagttttgcttggtgccaagcactgttgaagggacttagctcatcttatcaggagtcaaattaacgtcattcgggtaaaagtgcattgagtgtaaggagagcacctcaaagatatagttgacctatatcacgtccctcagcgccactaggcttacttgaatccctgttacagtgtcctctccagtgggcaaagctaacttctcagtggcctggtgggagaatttcttcttgagtaaatacgtatttttccaggttttgttgttttggccttccagttgtctgacttcagcctcatgacctcacttcttcatttcaattcaaaaaaatatttgctggaaattgctgtgtagggttaagggttctgcagatacaaaggttgagaggatatagtcttttcgaccaggtgcagtggctcacgcttgtaatcccagcactttgggaggtcgaggcgggtggacacttgaggtcaggagttcgagaccagcctgaccaacatggtgaaaccctgtctctactaaaaatacaaaaattagcctggcatggtggygcgcgcctgtaatcccagctgctcaagaggctgaggcatgagaatcgcttgaacccaggaggcggaggttgcagtgagccgagattgtagcactgcactctagcctgggcgacagagtgagactgtgtctcaaaaagccaacaaaaaaagaggatatagacttttcttttcctcaggcagcttgtggtctagtgtgagagacttatttgtagaagagtaattacattatggtgtgataagtgcaatgatagaaatatgtgtaaggtgtggacataggaaataggcwgtggttacctgttggaaagtcttcctacagaatgtggtccttgaactgcggtttaaaagacgagtaagagtttttccaggtggtgctgagtggacaggaagactaggaaagaggaggctgacatttatagttggtggcatacgtgagcaacaggtttagaatttggtatactcttgccatggcaaatggtagagggcttggctcagactgtgtactgaaggacttgatgcccttcagtgagttttatctaagatactctgacctgaacagaatttgagatgattgtgccgggtccactgggatatcttacgatccttcgtgggtcatatggattctccattagtgcgtcccagctgaaacttacagaaagggcttaagcagagaacatgctttttggagtacaaagtgatatttttatttggtatggcccgttcattgtgcatccatcccataggcaaatggtgatacgaaagcttttccctcttttggtaagaagtaaccaagttctgaaagaagcatatcatgcggctttcccaattgccaagttatgatgacacaaagtccaaaatgcgtgtaaaggtttttgaccaagtasaaaagcagagaaccccaaccagtataatgtgtcagaatgctttttctcttcaattgtaaaagcaccacaacgttcaacatctggaaaccaagaaaataatgaaaagaaccttttttcatgtgtataatattttaaaacttggttacatgttattttttggtatttctaaagtcagagacattttagaagtgaaatccctagtaggctattgttttaccaagcacactgaagttcctcgaataccgttgaagatgagctagacatttgttctgagacgtgtctggacatcatgtggttgtgttagtcatcttgttgatacttgttgttaatttggtaagaatacattgactacatactctcccttactactttttattagcattcatattaatcttatttcaaatcaaggttacagcttcatgtmatttgtagagtcagataatcctagaaaggcttgtaagaaagaagtgccaacatccttcccctaatcatgtttcctcccctgcagagtatctacttcagccttagtagatttccttgatctttgcctccaactctaaagagcatatttgcttgacgtctgtatttgtgtcycctacccctgtttcatgtgatgtctcttcgcttgacactgagaataggtaggaagttcctagctttctttcaccctctgccttctcagtgcaaacggatccatggctgcccaaagtgatatatccttaatttggttagttcagtattgattgtttatattatgactacatattgccatttacagctggacgaagtggtataataggattgttttcacttttctggataactttttgttttcctgggttattacaagtcttatttgtttttgtttgcttgctgcttgctcagttttctatattttgtcactacaattcaaccccaaattctgaagcaattatctaaatctttcaagaaattgtccgttttcttttgaagaaaattagtattcctatcattttatcttgaataaatctctcccagcgcctccaatctgctgcaggcttgtctgtgcctgaaatcttcctgtaactctcctcactccctcttgtgttggagcctcacttttctggaacctatgtcattctcttgatttgactgtctcacttcgatggagcacatccttcactagttgcctgagaagtgcatggcagatgaagttttcagaatttgtatgtacgaaagtgcctcgttctgctcttatcctgagtaggaatttggacatcattttgctccgcggtctctaagtttccagtgttgttgaagtcttaagccgttctgattctcttttattgatacgtaacatttttagagcctttgtgtgtgactatgttttcctccatgaaacctgaaggtttttgtttcttttttttcttctttctttcttttgtttttttttgagacacagcgtcttgctctgttgctcaggctgtagtgcggtggcgctgtcatagctcactgcagctgcaatctcctgggcttgagtgatgctcctgcctcggcctcccaagtacctgggactacaggcatgcaccgccacacctggataattttaaaaactttttgtagacatgagctctctatgttgcccaggctgatcttgaactcctggcctcaagtgattctcctgcctcagactcccgaagtgctgggagtgaaggctttgcatctggcctcagaggcttttctttctgtgaaattcagaactcccagaacagtgatgtcccttggagactgttttcatccatcgtcttgcctactctttggtcctgtttatttgcaactcatgttcttcaacgctgggcatttttttgatttattgctttgatttcttcytatttgctttctctctctctctctagaattctactcttggactttctggattggcactcataattttcttaaggtttctttttcccccctctaaaatttttgtttttgtttttatcttttaaattgtaaattgacaaattatacttgtacatatttagggggtacaaagtgatgttacgatttatggatacaataaataataaaatcaagttaacataattcatcacttcaaatactttaagttttttgtggtgaaagcatatgarattacygtcagcacttttgaaatcgacattattatttactatattcaccgtgctgtacaatatatctcataaaagaaaaccacattcctcctgtctaattgatgttttgtaccctttggtttttcattttctttctggaagttattctcaagtttgtcttccagcccttctaccaaggtttttctcatttctaagagctttttcttgttccctctattcctattttataacctattttttgtttcatgaatgtggtatctcctgttaactgttggaagatattgatgaggttttatttttccctgttttctttttccttaagtcactattgaggctgctctggtttgttgtgggtttttggcttttgtcagccttttctgggctatgcagtgatgttcttgtgcctgctcgtgagtcagagggcctctgagcctgtgtctgtggctgactgtggctttcactgcagaggcacctggctgggccatttccttacagcacccttgtcagcttctttgggtttcttcagattccccagagaaatatcttgtagccctttgcctggctgagtggccaagtgaggagagaggcctgggagcacagcagtaaccataaaagagcttacttccctcttttcagaattgtttccctcctctgtaactggtgtccccagtccaaagattctacttccctttgcagacagaaaagygatacctttttgccaggataggagagggactgtgcaggttggctctgtgtggctgtgcagagttgtggggtgcatcttagggatcttcgtgccttttaaacctatcagccaactctgtttttaattcaggtctcctggcttccagtcatattgccagttggccttccccattgccgatacaggattcagcccttttaggtctgtttccagtttctagcctccagtattttaatgttcttatctctattcttattctttgctttcgtgatttgtatcttaaaaaaagaaaaaatcgtttactatcattttagtggtgcttcacgaagtagtgtaaatgtattgatctgacaacggctcgtgctggagacactgttccaggaagtgggacacagtaaggaaaatgcaagtgtgttctcctgcactttcacggaggtcacgttttggtaagcggtgtcaggcagtcagcagaccagcagatatgcagtatgtccaatgtggacaagaagaaaggaggaaaataaagtatcgaggggagtggagtgggggacacagtggcagtttggcatagtggggaggccttgctgattgagcgacagttgattcaaacttgagatgagcaaacaagccatgggcagcgatctggggaagagcgttataagaggaatggacaggaggtgaaaagcacgggggcaggactgtgttgtgcacgttagaggaatgtggaacaccagttattagaccagtgtggagcaggaccagagggtgtaggagacgggcaggtcagggaagaagccggggctcctagcagtcggatcttgatgcctttggagagctggagcagagtgacccagtactggtggtggatcgtggtgaagtgaccatgggccacaccattcacgacatttcttacttttcctgtcacctgtaggaggcaagtattgttgttatcacaggtcgaggtagaccctgaggcaaaggctagagttagtggtttggctccagtttgtgccttcagctacttcactgcttccctaacctggccttgtcagtcagcctcagtctaccatctacccaggtctgcataccccscaaaacagtatacactttgacgcttttctgcaagcacarttaccttttgggggagcccttctcttaaagcagagtaggttaatgtttgtgaatgaaacggaactttggcaggctgaggtgtctcaggtcatcagcttacgttgtctactgtgtgactaattgaggcaaaagatgtcctttttaatagtattttctcatcacttttgcctgggtgccctttaggaatgttatttttggcatacaacttgagtttcacttaaatttataattctttctgttcattcctactgctctgttgcccagatgtggattttgctttgtctcacaagcgttgctgaaacactggtagaaaggtggacgacggattggttgtgattagtttgatcttcacagtacagaaattcaaaaggtcaataagctcaacaagattgctgtctcactgatgatcagagttgccattaaaatcgtatttcccgcacatcaggctggaaaaaagaataaacatgatcattttagttgtcctcaaaggagaagaggacaggtattctgtaatcaggtgttgtgagtgtaactagttaaactctttgggaggtgggcagttttaccttggcaatatctatcaatgcattgcctgtcatcatataattccatttccaattcaatttatcctgtgggggtagaggcccaagtgagcagaggatgttctttccagcattgtttataatcgcaaaaaaaaaaaaaaattagttcaagggtcctatcagtaggggatttattaaggtatgtttactccactcaacatgtagttgttaacaaatgaggtaaatttgtatttggtactcggaaagatggccatggtgtcttttcaaatgaaaataagtgtagcagatggtgaaagaatgcatgtaagatcctatttttatttaaatcatgtattaaaattataattaaagtataattaaaattacagttttgaagatacagtttagaatatattttttggtaaagcctcatgggggggttgccagtttttacattgttttgttgagttatcttttagaatatttttaaagctaaaaaatcaagttccttggtagaccatcactacagcaagcccactgcagtattaatctattaatactgtcaatgttaattaaaccattattcgtgtagcccctacccatcccattccagtctctcaggaggcttagctgtatcccagagaccccagtgctatgaccgcaggtctctcctggggcaggaagaggtaagaagtggctgatgtcaaagtcaacagtcagcaagtggcgtgagcagtctcgatgaattctttcaaataagcgtttttcagatccactctagggcttgccttttccytctgttgtagtctcagaagttcttgaggtagaccttgtgagacctgcagcagtacttgctgtcttaggtacagaaggcaggatattgattatttctccctgactcaacaaagagttgagatgtttatccaggttaggatgacastgcccccctgtcccccccgccccccaaaaaagaaacaaaaatgaaaggatggtgtctttgactgtactgggagtcaggagacctcacttcaattttgggcttttcctckttttttttttttttttgaataggttcagagctactccctggacctgttcttatcagccttatgacttggggacttgggatacttttttttttttttttaatttattgagacagagtctctccctgtcacccaggctggagtatgacagcatgatctccgctcactgcaacttccgcctcccgggttcaagcaattctcctgcctcagcctacctgagtagctgggactacaggcatgcacaatagtagagatagggttttgccgtgttggccaggctggtctcgaattcctgacctcaaatgatctgccagcctcggcctcccaatgaagtgctgtgataataggcatgagccactgctcccagcctgacttggggtactttttgacctgtaggatttcagctcctttcttttaaaaataagaaagctgaggccaggcgcagtggctcacgcctgtagtcccagcactttgggaggctgaggcgggcagatcacctgaggtcaggagttcgagacyggcctgaccaacatggagaagccccgtctctactaaaaatacaaaactagccgggcgtggtggctcatgcctgtaatcccagctgtgggaggctgaggcaggagaattgcctgaacctgggaggcagaggttgcagtgagccgagatcacgccattgcactccagccagggcaacaagaacaagactccatctcaaaaaaaaaaagctgaatctctgagtgggtttttcatttttcatttttttttttaaacagatgcctcagaacctgggtaactcagtttatcagaaattcagttttcaagtttggaaggataacrcttggagctggtagtcactcataaaacatctgattttgtgatcacgtttaagaatccatgaatgatataaaaatcctcacctattaaaactttttggccgggcgcggtgactcacacctgtcatcccagcactttgggaggctgaggtgggtggatcacgaggtcaggagatcgagaccatcctggctaacacggtgagaccccgtctctactaaaaatacaaaaaattagttgagcatggtggcggatgcctgtagtcccagctactcgggaggctgaggcaggagaatggcgtgaacccgggaggcggaactttgcagtgagccgagatcacgccactgcactccagcctgggcgacagagcgagactccatctcaaaaaaaaaaamaaaaacaaataaacaactttgtattcattgcttcctatatactagtcatcacgctatttatttctagcagtggttatcaccagggtgatttttgttacccagggcacatctggcagtgtccagagacctttgtggttgtcgtgacctacaatcatctggtggttgtggccagagatgcttacatcctgtggtacacagggcagcccccgcaacagaagtattcgactcaaaatgtcagcagcgctgaggttgaggagccctgctgtaaagggtcagtccttgaaagggctctagggtatagccatcacaggccccgtttttttggttggaaagagtagagcctggccaggtccggtggttcacgcctgtaatcccagcactttgggaggctgaggcgggtggatcacctgaggtcaggagttcgagaccagcctgtccaacatggtgaaaccccatctctactaaaaatacagaattagccgggtgtagtgacacatgcctgtagtcgcagctactcagcaggctgagacaggaagataactttaacccaggagttggaggctgcagtgagccaagatcgcgccactgcactctagcctgggagagacagagcgagactccgtctcaaaaatgaaaaagtagagcctggtagagtgaagccacttgcaggagtcgtttagttagggctgtgttgccttacagtgctggtgtcctcacagatgataatagtaataaaaaacaccacaccggtttattgtgtgccagctcgggttaagtgctgtctatgtatatgctcatggtaacacaaaaggcattaatatcaactttttataggagargagacaggcccaggaaatcaagatctgtaattatttcttctttttgttatcttggcccttaacttttagaagttcacacatttaaacattccatcttgacagatttacccagcgtttgagtgtctgtggggcttctctaaagctcagggtcaaaggggatatcctgcccacacagcactttctagttcaggagtgggaccaaccaggcctttgcagcaagataggtattcggtgctgaaatacacgctgtaaagttgtcctgtgtttcttgggattttgaatatctttcattgattcaattggcatttatttttcaccaagtacatattcagtaaatgtgttttggaaaaacagtgaacaaatcaaagtcccagccctaaagccatttaggcactcacggcctatctctgcagtaacctgctgcttgttagcactgggaccaagtccatctgtggctgccttcgggggattggcttctagtctagactcttgctgggttagtgtttccatcattctgtcaaggatccagctctaaggctgatagccacttccctgaattcatgtgatggatgcacaagcctcttggactaactcccctcttcattttactgcttccaccccaagcctgggttacacgtgaagccattggtgtgctattaatgtattggtgatgcttttacttggtttggatccctatggcttagcagagtaacttgatcatggcaggtgccatatacgtattttgagggatgaacagatagcatagtgttgattgctaaaaaggtaatgatctggccgggcatggtggcttatgcctgtaatacatacacatgcactttgtaatcccagcattctgggaagctgaggcagggggatcactggagcctaggagtttgagaccagcctrggcaacaaagtgagacccccatctctacaaaatatagaaaaaagttagctggacctggtggtgtgcctttgtggtcccagctactcaggagactgaggtgggaggcacgtttgagcccaggaggtcgaggctgcagtgagctgtagtcacaccactgcactccattctgggtcacagagtgagactccgtctccaaaaaaagaagtaatattctgaacttgtcctttcttgactttttggtgaattataacgggctgccagaatctagatcagctttttaggctctgagagatatgcttcatgtagaaataatccagtctgaaggccaggtctcaaggtgtcacttttgtattcttggatgactgttgaatgtgtggtctcgacgaatggctttgtggagcagctttctccagagacttgcatgtgcttggattaacaaacttgcgatccagggatgctaagcaggtgccttctgtgaccaagctcagtattgagggcgctgctgtccttgaggcagccaagtgttcttgtatacagctgtgttgtgtagcaggttaagtgctgcctctctcctgttgcttgttttctgtaatatgtcacctttcttggcatgattcctttgtccagtcttccagcgtcctgttgtatrgtgtgggtgggctggggactgcataaatgagttggagcagtgatgttcttggccttgctctgtcctgtgagagaggaccctgcaccatctggggctcctggagtggcaccctgcaccagcaggacgcagctcttcctggcccttctgtcggcctctaaacacagtgcaggctgactttcttatcacagctcgtttggctggctggaccaaatgctrcttgtttctttctggagtggggaaataacttcaaccaggtgcagtcagtgtgtattcttatctcagctgcaaaagctgttctaaatgcccttctagggaacttttgcggtgtgaatttagtggttgtgctgcgtgttagtcctgcccaacactaggcccaggcagctagagttaagtcgttgggcattggtagggcactgtgagcaaagactctcttacctcgggccaggcagagaaggacacagtggctgagctcacctgctccttggtcatccttcaaacctctgagtgtgtgtggttccttggggagagaaagcagttttctcgtgggtgccaagacagcagctacctgcatagcaactgctcctggcctagtaggagatttacatgtggagactctggagagagctgcacttctaaaggggttgccacaacagacagccttaggggaaatggggaaactggagaaaagggctcttatcccaaaaggaccagatccattggaacagatagaggtaaggaggcaaagagaaagcaacagtacaagtgtaaaattgggagaaatagtttttaaagggggtcatttatttggcacttttaccaatttgttttgaaacagagtctcagtctgtcgcccaggctggagtgcagtgctgtgatcacaactcattgcagcttctaactcctgagctcaagtaatcctcctgcttctgccgagtagctaggactatagggtgcctggctaatttttattttttttgtcaaaatggaggtttgctatgttgcccaggctggtcttgtactcctggactcaagtccttctgcttcagcctcccaaagtgcaaagtgctgggattacaggtgtgaaccacctaacctggcctctagtttgtttgtttgacacagggtcttgctcagtcactagttggagtacagtgacactatcatagctcactgcagtctcgaactcctgggctcaaatgatccttttgcctccgcctcctgagtagctgggaagcatactacaggcactgtacctggctaattaaattttttttttttttttgtagagatgggagttgtggggggtctcactctgttttgctatattgcccaagctgatcttgaacttccgacctcaagcagtcctcccacctcggcctcccaaagtgttgggattacaggtgtgagccactgtgcctggccctcggcctcttttaccatttttgaaattgaggttttgaaacaagtgacttgctcagaaacagttttaccccttagggcttccttttcaatattataagatgtatggtttctgatttatttattagaataggaaactttttgccttaaatctttttcttgaaaaattaaaaaaaaaaacaaaacgaaaggaaaggatggccctttgggatcttttctgcctgtctgctgtaaccattcgacagttgagaaccatgttgcttggtgtcttgtagcttgtaaatagaagactgaagtgtgtgtgagtagaaccttaaaattcacttttcctttgctttgtcttctttatgttggagtttgcttactcctgagtgtatattattagatgattacaggtgtgtagtattcaccccagtatttgctggctagtgtgaacaaaatgaaatacactgcatcatccgaatgtgttttattttgtagcaatgtgtatattactcttaattttcactcttcttacgtgatatgctttctaattttattaatacctagctcatttgactgtttcaaatgatattactgatttaattatatttactttttaaacatttgctgataagtagacgattaggtggtcttatagcattggtttaaatcagtatgtgtgyggccgggtgcagtggctcatgcctgtaatcccagcactttgggaggcctaggtgggcagatcacgaggtcaggagatcgagaccatcctggctaacacgatgaagccccgtctctactaaaaataccaaaaaaaaaaaaaaaattagccgggcctggtggcgggcgcctgtagtcccagctgctggggaggctgaggcaggagaatggcatgaacccaggaggcggagcttgcagtgagcagagatggcaccactgcactccagcctgggtgacagagtgagactcgtctcaaaataataataataataataataataataataataataatagtatgtgtgcatgaaatcagttcactttgaagaatacaatttttttcttttgaaacaaggcttctattttgatctaattgctcatgcttggagctgcctggccagcccctgagacccaagttctgtgttccctttgtcgtctgcacaacgagctcagcagactgctggctgcgtgttacagggctctggggtgtccccgggttcagccctactgtctcagagagaggaggacctggcctgtgaaggactgaggtggtgatgtgaaggtcttttctccatcaaatcttgcgccagttaccttgtatagtatttagattgttgttatcagttggtcatatggctttattgaaggctggtttagcatatttagaacttatttggcatgcattaggattcttcttcttagagtattttaattccagtatgtacttatgcttgtcttctctacctgcccccagtcttgaagtggtggaaatgtgtgtgtgtgcatgtgtgtgtactttccttaagcccttgctgattgatgcagtcacttgctttcaccctgcttaaatattcctaattctcgctgggcagtgttcctgttacatgtcgtgggttactccgatttgcctagtgtctgagttttgcctcttgttcgtcttttagggcagtgtacgactggggctcagcagtgctagtggctggcccagatggagcaccggggggcgcccgccttctactaggaagaactgggcggggtggggggagttccccatgtggacctcgaagttgtttgggatgtgctgctgtgcatatctaggttgtgctgtggctttcttgatgctttctggtggtttaaaaatctactttctcatgaaagaacgtgaaccagaaaaaaaaaatcttttatgaagtttgagaaaatgattgggtgacagactttagaatcgtgacaatatgctttgctacataaagtttgggtgcaatgtgcattcattttgtagttgaactcgtgattaaacagatatagtcaaaatttgtttttkgtttgtttgtttgagacggaatctcgctctgtcccccaggctggagtgcagtggtgggatctcggctcactgcaagctctgcctcctgggttcacgctgttctcctgcctcagcctccccagtagctggaactatgggtgcccgccatcatgtgcggctaattttttgtgtttttagtagagatagggtttcaccgtgttagccaggatgatctcgatctcctgacctcgtgatccacctgcctaggcctcccagagtgctgggattacaggcgtgagccaccgcgccccgcccaaaatttgggttttgactttgaactggaatggtcagtgttatctgccatccctctcctatattgatgtttatttccaaattagggtgtttagttttcctttcyttttttttttttttttttttttttgagacggagccaggctggagtwcagtggtgccatcttggctcactgcaacctctgcctmctgggttcaagtagtgattctcctgcctcagcctcccgagtagctggtactacagatgcacgccaccatgcctggctaatttttgtatttttagtagagacggtttcaccatattggtcaggctggtcttgaactcctgaccttgtgatccacctgcctcggcctcccaaagtgctgggattacaggcgtgagccaccgcgcccggccttagggtgtttagtttttctaatcacagtagtagtacatatcctccattaatttttttaaaaaacgatcctgaatttacagaggaggtacgggtaccgtacagctctttatctgaaccacctgagagtaagttgggactacgaacctcaccctgggatattttggtatgtttacttatagacaagacaccttcctccttaaccgcaatacagccatcaaagtcaggaaatcaacatgaatgcgttgccgccttctgatcaggcagcgcattctcattccactgaaaggatctagttcagaaccacagttcattgtcagatctctttagtctctttcaaactggaatggttcctctgcctgagcttgacrcttttaatgattaccagcagttattttgtggggtcccttattgtgggtttgtttggtgtttccttttgattagatctaggttttgcgcctctggctggaacagtacaaggaggaggctgggttcttctctgcatcctaataggtggtgcagaattcagttagtccccttagtggtgatgtgcactttacttgcttgattcaggtgctgccttccagcttctccactgtgaaatctttgtaattgttaagtatatagtagggagatacttttgaaataaaatcaaactttcagttatctcaactatctcaactttaatcagagttcaatttgcttatttatgtcaatattggctcatggtttccccagttaattcggttgattgttacccttttgccatgactttatttgatgttcatcatctcaggttygcccctgagagcccctcaagctcctgtgtcctttatttatttatctatttatttttttyattattattattttttcagactgagtctcactctgtcgcccaggcaggagtgcaatggcgccatctcggctgactgcaaactccacctcccgggttcaagcgattctcctgcctcagtctcctgagtagctgagattacaggcacgcgccaccacgcccagctaattttctgtatttttagtagagacagggtttcaccacgtggcccaggctggtctcaaactcctgagctcaggcagcctcctgcttctgcctcccaaagtgctaggattacaggcatgagccaccatgcctggcccttttttttttttttttttttttttttttttttttgaracagggtctcactctgtccaggcctggagtgcagtagcgagctctcggctcactgcaacctctgcctcctgggttcaagtgattctcccgcctcagcctccccggtagctgggactgcagatgtgtgccaccacscccggctaatttttttatttttagtagagagaaggtttcaccatgttggccggtcttgaactcctgacctcaggtgatccacccgccttggcctcccaaagtgctgggattactgtctgtgtccttctgatatgtcctcattattctctgkctctttctcttctcttctctttctttcttgtaccacaggatattctgggctcttcatgtaccttccctgccccagacctggattctgccttttcttcaagaaggcctgcttcccttttatggcagttggctctcagagaaacagggtctaggcaccagctaggttgctggagtgttactatacccaggccctctcagtcracagagtatgtgtatacatacatatacaaaacatacctacagctacatgcgtgtgtatttttaacacagtctcattttttaatatctccatgtattgaaaagcatgagtttattccagtacccccatttccaatgtagtagcacagggtttattctagtttctcgctttccaagtggataactccgtttcccaacagtgacaatcttagatcccagtgtctctaatatgtttacttccttgattattcaccctgtatggaacgaggctcctcttgttgaccttcctgctyggatgcccgctgcctcctcatytcactcagctgctgtcatcctgcacctccacccaccatgagcatcttcctcactccacttgggctctgataccctagctatgtagatattctcttatgtggaagcccgtatccccagtttaaaaacaaaaaaagtccaagtcctacacgctctctttttgcagcttgatcattttcatttaatgtacagtagtctgtgctttttccagactgatacgtgagccgttgsattcttgttggtaacagcgccttactgtgtggtgtccttgtcccacttagtatgactgccttcgtgctgacgcacactcgtgttcttccagttctttgcctgtggcatgctgttgtgagcctcacctgtcacacctatgcttctgtattcttttgcaggcacttctggagagtagcatttttgaagtgtgattgctgacttagattgtatatttctattttttgttatgtgtttctaaattgccttctaattttatacttcctcaatggttgagtagtcttttttccccctcaccattataaacactgaatgatcacttttgttcatctttgcggatctcataaaggctgcatgaagatgaacatctattcgtgtgtttgtgggcaattttatgttaattttctgtgatttgtgtgttcatatgtcctaacctattcagatgttttccagacattgaaaaactccatttgtatcttgacttctatattagtgttctataaaattcttatgctctgatagggtcaaataaatcaatatcttcctcagtggtttttacagtatatgttgttggagactttttgcagccccaaatcacaggttttcctccttaatcttcagggcttcagggtttgattgtttacatccagatctccaatccagctgaaatttattttagagtatgttgtgaggtagggatcaaactttatatgttttcaaaatggataacaaattggcccaattccttgctgatttgaaatggcacttgtatcaaataataaattcacaggtacacgtgagtctgtttcatgcatcaagtgcctctttcttagccagtaacaccaagtgctaattaccattgctttgtagtatgctttgctaattttagttgaatcccagcttttttttttttttttttgcaaaattttctagcctggttttatgtttaggtgaatttttaggagaatccttgttagagttaaaaaaatatcctactgggatgttgtgttactttcccagggctgccgtaacaaattaccacacatttggtggcttacaacaggaatgtattctctcgcagttttggagactggaaatctgaaatctggcagggccacactccctctgggggataggagagagattgttctttgcttcttcgtcttccagctcctgccccacagtccttggcttgcagctgcatggttcccacccctgcctccctcttcacgtggctttctcgtctgtcacgggtggcatttagaacccacccagataatccaggatcatctcctcatcttagtatctttcacttaatgtcatctgaaaagaccccttttccaagaaaagtaaaacaaatttcagggattgggattccctatctttgggtggccatttttcagcctatcacagatgttatttggagtgtgattgggggtgtagatgaacttggaatagaacagacatcttttgtgatgaatctcctggctaagtcttggcatcatctccatgattcaggcttctcgtgtatatgtgtgtgtgtaaaatttttgttttgccaacttgccaagcttgccttcactgttactagagcttcrttataatagagaggttttctaaacaggtcatctgcagacagtggtatttgtctccttgcttcattctgtctctttagatggcctattggacagtctttgacaatagtaacatcttggtcattctgttgcttattttaatactatactattagctttttagtaaatatgttactttggggaaatattgttcatatagccatttgctgatgttaaactccatagaaagtaaataatacatgctgaatttcatcagttttttgggcatttttgaaatggtcgtcggtcagccacgtatatgtttatttgtcctttttttctttgagacagagttttgctctgtcgcccaggctggagtgcagtggtgcaatctcggctcactgcagcctccgcctcccgggttcaagagattctcctgcctcagcctcccgagtagctgggatcacaggcacccaccaccatgcctggctaatttttagtgtttttagtagagatggggtttcaccatgttgaccaggctggtcttgaactcctgacctcaggtgacccacctgtctcggcctcccaaagtgctgggattacaggtgtgagccactgggtctggcctatttgtcctccttttagccataagtatatattttctaattttaaaactgtatccctagaacagaccattcttagtcatgatgtcttgttctctaaatttagtgatcaattaattaggctcgtgttttgtttaaaattttacatgttttctagcttgggcaatatagcaggacctgtctcttggagaaaaaattagttgggcatggtgtacgcacctgtagtcgcagcgccttaggagtctgaggtggaaaggatggcttgagcccaggagttcaaggctacagtgagctatcttgcatcactgtactgcagcctgggcagcagagcgagactctgtctcaaataaataaataataaaataaaatagaaatttacgtgtctgtagaatagtctataatgattaatctctgcaacatctactcattgttttgggaagacaaaacaatgccgattttcctttggggaacaactctttctaccatgtgtaaaccatgtgttttagatagaatggctcagctgcatgggtggacctggttggctgtggctactagacataacacatgcccttggccccctgattatagttattggtccctaacgagatcagaacccaattaatgccaatgagttacaaaaataattcgtggcacccgtgagacaaagaagctcttatttccttgggagctaccagaagatacaattactgccatttataacacttcttatttcaaaaccaggcaaagataatattgtatcattgtaatctcgggtgtgtgttcttttcttttgtcaggctagagagagttaattgctcttcaattgcttttttcaaagaaactgattttgcttttgattgaccaagtagctatgtttctgtttttgtttttttttttttttgaggcagggtctcgcaccctcacccaggctggattgcagtggtgcaatcacggctcactgcaggctcaacctcctgggctcaggcgatcttcctgccgcagcctcccaagtagctggggactacaggcacgtgccaccatgccaggctaattttttgtatttttggtagagatgaggtttcgctatgttgcccaggctggtcttaaactcctggactcaagcgatctgcctgcctcagcctctcaaagtgctgggattacaggtgtgagtcactgcacttggcctgttttgttttgttttaattttttttgaggcagagtctcgctctgtcacccaggctggagttcagtggtgcaatcatggctcactgcaggctcaacctcctgggctcaggcgatcttcctgccccagccttccaagtagctgggactacaggcacgtgccacccaggctgggagtgcagtagcgtgattataactcactcactgtaaccttgaactcctgggctcaagggatcctcctgcctcagcctctcagtagctgggacyacaggtgtgtgccatcatgcatggcttttcttattttattktattgtattttttatttttttgtggagatggggtcttgctttgttgtccaagctggtctcaaactcctgggcttaagtgatcctaaagtgctgagattacaggtttgagacactgcacctggtcttatatttcatcaattcttttgttccttctactttggttttcactttacatcttgacttgaatgcttagttcattcatcttcattaataaagtttacaagtttgattcaccctgtgagtgtagctttagcagtgctctgtagacgttgataagtggtcctctttgctctttcttcttttctgagacggggtctcgctttgttgcccaggccgagtgcagtggcacagctcactgcagccccagcctccccgcactcaagtgatcctcctgcctcagcctccctagtagctagggccacaggtgtacaccgccacacctggctgattttttgttttctatttttatttttgtacaggcagtctcactatattgcccaggtttcttttccttttttaaaccttgttgggaaaacttcaaaatataccacaaaataaaagagaatagaagagaatcatatgcctgtcacccagctttcacagttgtcagcattttactatagccctgcccactcccaatattttatatttttcatttsagtattttaaagcaaatctcagacttttagtcacctctaaatactttagcatgtattttttaggaaacggctttaaaaaacataaccacaataccttcatcatagctaacaccaccaaccacgctcattaatattatctaatatttattctgtgtttggttttctccagatgtcataaaaagcctttttacactttgtttgcttgaattgaaatccaaagaaggtctccacattgcatttggtttaagcctcttagctctttgaaaatctatagcttgcagcttcttttcccttttttagtttttgtttttaatgccatttatttatgaaggcaatagggttgtttgtgctgtggaacgtcccaggtttgggatttggttgactgtgttgtggcactatctaatgtgtttttctaatcctcatacttcctgtagctaggtcaggatgcttaattggtttcaggctgtttgttgttgggggggtggggggcagtggtttcaaggatattccacagactgtgctctgtgttgcacgttgagcagccaggttacatgatgtcgggtgcggtgtcagtaggttgaattatagagttctttatcaaccagttctctactgggtttaacggccatttgcttgttgcttgtacccgttatttagttggtgtattactttcctattgctgctgtaccaaattacaacactgtggctgaaatcagtctcactggtctagagtctgggtatctgggtgccatcaggcagctctggagagtatctgcttcctggccttttccagctcgtggcagccattttttggctatggccccttcctccatcattagagcacatgatctaaaggacacttgtgattgtggttacgtcccacccatataatccaaaatgatctcccatctcaagattcttaattcatctgtaacatatccaaatccagaaattaggacttgaatatctttggaggccattgttcagcctacagctgacaattataaagtgaagatttttctaattctattcttatttaaagaagatttcctgtatcaattttggaggttctgaaatgtggttcctgctggggagaaagaagaaatgaatgatttctttcctttatcagtgtttaggatgcactggaactaatagcttccaaagttgaagttcatttctgtagcatttccccctagtactataaacctggggatgtgattgtgcttcaacccgtggaagccgtattttggtgcttctgttgttctacccaagttggcttgtgtcatctttgggtgtgactccttggtttgtgactgctccctgcctgcctgtcacaggagggtgttgtacctcgtccgtgttctgcttagacctagagtcagtcatgtttctaaggaaccccagtctcttgccgtgagatggtgtttatatatcagtcagttcaatgtgtatcattttcttaggctaaaatcttggttcttaatgatattaactcgcttacctattctaaattttgtgactctgcttttcactgatttgtagtagccgacgatgcttaagcatcttttattccctttctagatggaggcatctttgaaaagtaaagcgcctcgtgtgatacagagcttcccctcctgcagataastctcacaaacacttagcatgtgtctgtccagagtttcctgttaaaacacactttcagaggcgtgtagtgtatgaataagtgccattttcatggcacatatttttcatacaatatattcttacagtaacgatactgacattattaggatatatcccatttggaatatattgtcaaattattgtgttttaaagttaaataattctctgatgcttaggccgccgctctgacattgttagatacatttgtttccattttctaagtagactttttattgaggtataataaacatgcactttttaatgtatatagctcagtgaattttcactaactgaactcactcatataaccagcattgagataaagaagtggaacgttttatttttagagtttagagtctgatttttttttttttcctttgagacagagttttgttcttgttgcccaggctggagtgcaatggcgcgatctcggctcaccacaacctccgcctcttgggttcaagcatttctcctgcctcagcctcccgagtagctgggattacaggcatgtgccgccacgcccggctaattttgtatttttagtagagacggggttcctccatgttggtcaggctggtctcgaactcccgacctcaggtaatccacccaccttggcctttcaaggtgctgggattacaggcgtaaaccactgtacccggcctcttctgatgtttatggttctaaaacagagctgttactcttgttctgctcagatgagcttgatttccatccctgtcccctgtcccttctttccttaccccaacattttcttcttgtttctttctgaaaatataaacagacatacacatttctatttctgactctttcttacagaaaggtagcataccctgcacctgctggcctccgttgctcttttcattaactgtgtaccccgaagactatgcatagtagtgtatggaggctttccttctaccttttatgctatgtgttgcttcactgcatggacacaamgtggtttcttcagcccatctgcatattgaagttgtgttactttccagattttttttttttagctttttatgtctcgctatctctgctgttgcccttctgaagtccattcatcccacacgtgcagtagctggagtttcctttttatctaatacttgagtttcccactgccatactcaccccacgttgatgcctaatgtcttcttgaggtttcctttagagggcactccttacctttggtgccagccattctgctattctgatcctacytcccctcattactgatcttccttctctgccatcctgaccccttcctgtccttggatgcctttggagttgcagagaagctgtctttatcttcctggtgtgatacttgttttctaatagtaggaaatagtgttttcttgttctgcccagttttctctctttatagatgagacatctaagttcctgctccctggatgtatgtcagtttttctcttacatggtaatgttctgatctgagtccggtatctccattgtctaactttgcatagaggaacatacctgtgctttggtggggacgttgtgcttgtattcgtgcagtttaatgttgaattarctctttgtggagacagttatataagtaagcgtttctagggagtctttatatccaraagtgaggcttaatctctgaagagtagactgataggaagagagtacytggagagatgatgcagtcccaccttctcatgagacaaaggaggaagcaggccaagtgaagagggtgatgtgccaagcagtgtcagcagcagatcgcacattggagtgccacatgctctccacccttgagaggagaaaacctgaagacttgggttttcctgatgtgtgttttcttgtttgtagaaaagtattgtttctatttggataggactgagcccaagattaatctttcagattcttaagtattttccacccatggcgttagctagctttgtatccataacagagttctttataaacatgagctaagctaattctagctcatagaactttcctatgtaaattgtaggaaggaaaaaatcatcaagtgtaaattgttgccctgggtcaaacttcaaattattttgtttcttgtagtttaatgagatttatagtgaggagatggaagggatttttaaattgcaggactaaaggggaatggcccttcctacagccattctgttcccatccccttcccaggaacaccattacagttggggtgggggcctgcgtgggcttcaagccctggtgaggagtatgtgtgtgtgcaggagctgccatgaaacacctttcagcggctcagggtggcagactagtgttaccatggcagttagagacatcagtaaacccatgggtcatacggatgcatttccacctagaagcagtggtttgtttcttcagtgagtcaaagaaacttaagatggaggagaccctaaggagtcatgtaagttaaatgatcacccagtggagagtacacttcacagtgggaataagctctgcccattttttttcctaggtgctaattcaggaaagcatgctcactcttagtgatccttttcttcatgttgagatgaaatgtgtcttcagaattgttcttagttgttcttrgttgtgcaggcaactggacagaactcagtccccctttaaatgctctccacatggtaaagacagctcttatgtatcttgttctcagtttccaaggcttgaataggttcatgtaaagtcatcaccacttcctcaaaaggaaattaacaaaaaaaaattttaattcagacgtcttgcagataacgtggcaattgtratgagaatagcacagcagagaaaataaattttgtgactctgtttttcactgatttgtagtacctggtgatacttaagtgtcctcttttccctctccaggtggaggtatttttgttgaaaagtaaagagcctcatataatacagagctttccccttctgctgataactctcacaaacacttagcatatgtccatccatagtttcctattaaaacacactttgggggtatgtggtgtaggaatatgtgccatttttcatggtcttccctcccgtcttcacattctacagcttcacagcagaattgtcttttcaagtccatcttttacccagctgttcatgttgatgcttgttgaggactgggctctggacttcctgtccttttgctattctcaatgacttgagtttccttctagagaggtcttatgcatgtacaaacatgtatatcttttaacacgactggttacatatcaacgtaacacatagctgcaggccaggcgcagtggctcacacctgtaatcccagcactttgggaggccaaggcaggcagatcactgaggccaggagttcaacrccaacctggccaatgtggtaaaatcctgtctctacaaaaaaatatacaaaaattagccaggcatagtggcgcacacctgtagtccagctacttgggaggctgaggtgggagaatcgcttgaacctgggaggcagaggttgcagtgagctgcgattgtgctgctgcactccagcctgggcaacagagtaagaccctgtctcagaaaaaaaaaaaaaaaagaaagaaagaaataggccgggcgcggtggcttatgcctgtaattccagcactttgggagacaggcgggtggatcacggtgtcagragtttgagaccagcctggccaacaatgtgaaaccctgtgtctactaagaatacaaaaatcagccaggtgtggtggcgcacgcctgtagtcccagctactcgggaggctgaggcaagagaatcgcttgaacccaggaggcggaggtttcggtgagccaagatcacgccwctgcactccagcctgggcagtagagtgagactctgtctcaaaacaacaacaacaaactgcctcttcttgttcactgacactgggtgtatggttaaagcccccttaactgacctgttttgaggcacagaggtttatttaatcaccagtcatttgatacagggtgaagacctatttgaaatgggactggctggattctacatgttttctttttttttttttttggaaacagggtcttgctgtgttgtccaggctggagtgcagtggtgccatcatggctcactgctcaacccctggggctcaggtgatcctcccacctcagcttccacactgagtaactggcactacaggtgcatactaccatgcctggctaatttttatttttatttttattttttattttttggtagagacagggtttcaccattgtaaacccaggaaatctgacaagtctcagttaatttagaaagcttactttgccaagggtgaggacgcgcacccgtgacccagcctcaggaggtcctgatgacgtgtgcccaaggtgggcagagcacagtctggctttatacattgtagggagacatgagwcatcagtcagcatatacaggacgaacattggttcggtctggagaggcaggatggctcgaagcaaaggcaggaagactccaagtggggaggggacttccaagtcacaggcaggtaagagacaaatggttgcattctttggagtttctgatgagcctctccaaaggaggcagtcagatacgcatttatctcagtgaacagaggggagactttgaagagaatgggaagcacgttggccctaagcagttcccagctagacttttccttttaacttagtgatttgggggccccaagatttattttcctttcagactatgttgcctgtgttggttttgaactcctgggctcaagcgatctacccacctcaacctcccaaagtgctgggattacaggcatgagccaccatgcctggccacatactctcttcttatgtaaatgaaattgataatatgtcgtctaggattttcagcattcatttaagtggaacaaaaatttaagaaactcataatcagtgtagattctctgagattttaaaggttttcctccatttgactttttcttttaaacaaacaggtcttgctctttttcccaggctggagtgctgtggcacgattgtaactcactgcagcttcaaattgggttcaaatgatccttctgcctcagtctcctgagtaactaggattacaggcacaggctaattgtttttattttttatttttttaagaaatgagktctcactttgttgcccaggctggtctcaaacttttggcctcaagtgatccttctgccttggcctcccaaagtgctaggattataggcatgagtcaccatgtccagccataatttttttaaggcaacttgtttttcttgaaatttcagtgtggtaaatttaatatccatagataaatttctcttcactcyttcattattttgaattatttctaaatgtagttacattaactagtgaaactggcataaacaggtttgagagcaagtaaaactgagtcttactaagcacacatcatcactggtggggatcggtgttcagggcacactagaaggcactctgctcatgacatcaattaatattttactgtgggggtggagacttggtcattcatcaggtcgtttatggaggtcagtgatagtgctttgtgttctgccaccctttgtttacccagtcccggactgaaccaatgcaaatgtttaatcttctgactctacaaaaatgctacagtgcacatcrggcacactgcagagacactgcaggtttgtgataccaccacaagaaagcctgacatcccaataaagcacatcacatgagttttacgtttcccagtgcatataaaagctgtaacatgtttagaaaaacaatggtatatactttaatttaaaataatggttaaggctgggcgcagtggctcaggcctgtaatccagcacattgggaggccaaggtgggtggatcacctgaggtcaggagttcgagaccagcctggccaacatggtgaaaccccgcctctactaaaagtacgaaaattagctgggtgtggcggagcacacctgtaatcccagctacttgggaggctgaggcgggagagtcacttgaacccgggaggtggaggttgcagtaagccaagatcaagactgtgccactgcactccagtctgggcaactgagtgagactccatctcaaaaaataataataaaatattggttaaaaaatgctcatgatcattgagccttcagcaagtcttaatctttttgctgctggaaggtctcgctttgatgttgatggctgctgactgatcagagcagaggttgctacatgttggggtgactggcaattttgtaaaatcagacaacaatgaagtttactgcattgattgactcttccacaaaagatttctctgtagcacgtgatgttgtttgattgcattttcccacaatagaactactttcagaattggactcaatcctctcaaacactgccattgctttatcagctaagtttatgtaatattctaaatcctctgttgtcatttcaacaatgttcacaacatcttcattcagcatctacttcctgagtagattctatcttaggaaaccactttctctgctcatccataagaagcaactcctcatctgttcacgttttatcatgagattgcagcaattcagtcccatcttcaggctccacttttaattctagttctcttgctgtttctaccacacttgcagttgctttctccactgaagtcttgaacccctcaaagtcatggcatccggaatggtgaatcctttacaggaggttttcaatggactttgcccaaatccatgagaggaataactatctatggcagctgtagccttaaaaataatttcttaagtattaagtcttgaaagtcgaaattacttcttgatccatgggctgcagaatggctgttagcaggcatgaaaacaacattcatctccttgtacatctccatcagagctcttgggtgaccagatgctttgccaatcagcagtaatgttttgaaaggaatcttttttttttttctgggcagtagatcttaacggtgagcttaaaatactcagtaaatcgttttaaacagatgtgctgtcatccaggctttgtttcattcatacagcacaggcagagtatatttagtgtaattcttcagacccctaggattttcagaatggtaaatgagcattggctttaacataaagtcactggctgcactagcccctaacaagagagtcagccttttgaagctttgaaggcttctcttagaagcgatctagctattggctgggcgcagtagctcacgcctgtaatcccagcacttcgggaggctgaggtgggcggatcacgaggtcaggagatcgagaccatcctggctaacacggtgaaaccccatctctactaaaaatacaaaaaattagccgggcgtggtggtgggcgcctgtagtcccagctactcgggaggctgaggcaggagaatggtgtgaacctgggaggcagaggttacactgagcagagatcatgccactgcactccagcctgggccatagagcgagactctgtctcaagaaaaaaaaaaaaaaagaagccatctagctatcaaagtccttagatggcatcttcttgcactatgaggctgtctcatttacactgaaaatctgtttagtgcagctactttcatcagtgaccttagctaaatcttcataactcactgcagcttctacatcagcacttgctgcttcaccgtgcactttcatgttagagagatcttaaacttcaagaaccaacctctgctagcttgagacattttttcctgcagcttcctcacctctctcagccttcatggaattaaagagagttagggccttgctctggattaggctttggtttaagggaattttgagactggtttaatcttctagccagaccactcaaactttctccttatcagcgataaggctgtttcgctctcttaccatttrtgtgttcactggagtagcacttttccttcagccttttttctttgcattcacagcttggctatttggtgcaagaggcctagcttttggcgtgtctyagcttttaacaactcttcttcacgtgccttcttaatcatttctagcttttgatttaatatgagagacgtgcagctcttcctttcacttgaacacttagaagcaattgttgggttattaattggtttcccctcaatattgtgtctagggatcgggcggcatgaggagagggagagagatgggagtggccagttggagcagtcagaacacacacagcattgattgattaagttctctgccttgtatgagcgtggtttgtggcactccaaaacaattacagtagtaacatcaaggattacagatcaccataacagatacaatgacaatgaaaacgtttgaaatattgctagaattaccaaaatgtgctgttggaaaagaggcatggaaagacctgcagagttgccaaaaccttcagcctataataaacacaatgtctaaaaaacccaagtaagagaagcactgtaagctgaagtgtgcctctatctttgggcacatgtgtgagaaattcttagaagtaggaagtgttagatcaaagaatattgatgttttaaatctcagtccacaatcaaatatgtacgctctccaaagagaccacaccaattattcctccagccacacctgttttcccacacttttttttgagtcttcagattttatttttgccaaactgaggtgaaatgtagaatcttattctacttttcacttgcattttaaaatacaaattgaataaatgtttcctgcatttccatgaaaggcctgcttgtatcttttgcccattttttaaaaatgggttattaaagagtcctttaggaaatactgtaaacgtaacgtgctcctcttttccccagaaatgtttgagcctgccacgtgtgccatgtttgtgtttgtggtagaggagatgctttcatgattgagaagaagacgcattttatactctttycccctaatgtaaatttattcattaaacacaaaagatttgtaataaaatattttttccttaagattgttatataaagtttactaatgagaaaaactcccttgtcagtttatagtttagctttggtttgaaaatacagacactgtagcactgctgtccaatatgagccacatatatttaaaattttccaacatctgccttaaaaatataaaaataaacaagtgaagttaattttaataatattgtttcacccaatgtaagatactaccattttacatgtaatccatcctaaaactaataataaaatgttttagatagtatttcttgtactaaatcttcaaaatctgatgtatattttagacttacagcacatatcattttaaactagccacgtgtgaaggctgtagtgacatgtggccagtagatgttggccagcacagctcaaaagagtagtctatttctatgaaaatccatcaatttattcttttggacctaacatttgtcctatcctcttttttatttttttgagacagggtctcacttggtcagccaggctggagtgcagtgtcacgatctcaactcattgcaacccccacctcctaggcccaagcaattctcccacctcagcctcccgagtagctgggattacaggcacgtgccaccatgcctggcttatttatttatttatttttaagacggagtttcactcctgttgcacaggctggagtgcaatggcgcgatctcggctcactgcaacctctgcctcccgggttcaagcgattctcccacctcagcctcccgagtagctgggattacaggcatgcacccccaagcccgagtaattttgtgttttagtagagatggggtttctccctgttggtcaggctgatctcgatctctcgacctcaagtgatccgcccacctcggcctcccaaagtgctgggattacaggcgtgagccaccgcgcccagccccccatcttattaagaaaataaattgtatttatctgacacatgttctttaattaggctctaagtaaatattattctttactcagctgtagaaatatgtgctgattgtttctgtatttgtaaaattaatgtagtggcatactccactaaatgtattaatttagtggaaagtagtgagtttagtggtttagtggaattaaatgttagcattcccaaacagtgagatacctattaaagggcaggttcttttagataccattttccttgatctttttaacaacttgcagaaaaggccccaaaacttagaaatgtgaattattaaagttgagagcttaaacaactagccaaggtgacccaaattatatctgagcaagattctgaaagcaggtatcctggcaacaagtttggtgttctttatacaatttgttctcattataggtgcctataatgactcggataaaacacaagttacgtattttcaccttacctagaaatacgtgaatcaaagaaataagccagagaacagtgtcactggagaatatactaagttaccttttctgttacttcctgaaaagtagtgaaactgacagaattagttagtggagaaagaacaaggcaaatttacaggaaaccctggactgcaaggtctttgtttctgtctcatctgaactttcgtgagactttattttagggctgggagtttaatgtaataatatatactgtaatatatattagcagtaaatacatgtgagccaaagaaaagttgttccttattagaatatgctacaagtcaaattaaactgagtataaataagcttaatyataaaattagtttgtgctaataaaaatgtaatatgagccacatataattttaaattttcagctttcaaatgggatggaaacatttctttgacctgactttgaccaccacactcagtatgggagtgcaaattgtgctaaacttagctcccatcccatggtgccaataacttcctataagactgcactgctgccaaggaagtggtgggcgcctgtcctccacatctctgctcccacagccttggagatgacccctggtccgctgctcctcctaaccccttcagcatggctccactgcagcgggttcctgtcaggtgataasttaaagcaaagagaggagtaggctgcataaattgtatacctctgtttatccatgttatccactgacaattaggttcttaaaaatttgttgactattactagcagtgcagtgagatgagcattcttgtacatatttccttttgcccaggaaagctttttcctgaagtacgtctccagaagtgggatcgttcrctcgtggagtatttgcttcttaagccttaataggccttgcaaatggtgtcaaataaggacctagtttttccctcctactgtagataaccagttttcccagagccattgattgcatcatccatctccctgctgatccacacgaccacatctgaggcaggcaatgtcagtgtctgtggtgtctgcgttgggcccactctgctgctcccttgttctctgtgtctgtccccggcactagcaccacagyctgaattactgacactggagagagcaagccctcctccacgttgttttcttcagagttatattagctgttcttggtccttgatcttttgtataaattttgttgtgtaaatatgattgtatttgtaactattctaaaaatggtgtatataaatawttttttttacaattcagtgtttgcaatgcaacattataaaaattacatatagaaaacttgtataaataaaaaytgtataaaatctggttgtaaaattccatacacacacataccttttgggatttaagttacatttgcattgaatttctagtctaattaggggagaattactatccatgattaagtctttctttagatgaccatggcctgtctccatttattaaggtcatttctgtattttgacaaaggtttttataagttctataaatcacattttttttcttaattagattttaaaaaatttttttagaggggtggagaggggacagagtctcacgctgttgctcacgcggcagtgcagtggcgtgatcttggttcactgcagcatccgcctcctgggttcaagcgattctcgtgtctcagccccccaagtagctgggactacaggcatgcatcaccacacccggcttagatttatttttaatagtttgttgctggtgttttggaaacataattgattgtgtgtattggttttatttccagaaaacttactgaactttttaattagttctaatagtgtgtccatacatcctcctggattttcttccagcacagttatattgtctgtgaatactggcagttttggttcattttcaattctggtaactttcttttcttgccatactgccctggcttatattcctagttgctattaggaatgggttaattagttgagattcttcatttgaatttttttttttttggagatggagtcttgctctgttgcccaggctggagtgcagtggcaccatcttgtttcactgcaacctccacctcccgggttcaagcaatcctcctgcctcagcctcccaagtagctgggagtacaggcatgtgccaccatgcccggctaatgtttgtatgtttagtagagacggagtttcgccatattggccaggctggtctcgaactcttgacctcaggtatctgcctgcctcagcctcccaaagtgctgggattacaggcacgagccaccgtgcccrgcctatttgaatcttttgaaatgatcaaattatctttgcccctcatgctgttaatgtggcgagtaactttactctgtttttctaatattgtayccccccacattactggattaaacttcatcgtgataatatttgtttttctatttctgggtcagtttgcaagattgtttcaggctttggcttttaaatacctaggtgagattcacctactcctttgtctgtgatgagtccaagccccctagctttgtgtgggagataatctctgaaagcttccttacaaaagcatttggagacccgcctttttgttgtattattttgttgttgttgttttttggttttttttgagatggagtttcacttttgtttcccagactggagtgcaatggcgtggtctcggcccacggcaacctccacctcccaggtacaagcgattctcctgcctcggcctcctgagtagctgggattacaggcatgcaccaccacgcccaactaattttgcatttttagtagagatagggtttcatcatgttggtcaggctggtctcgaactcccaacctcaggtgatccgcccgcctcggcctcccaaagtgctgggattataggcgtgagccacctcgcccggccttgttgtaagttttatatttgtttctttgaagattggggaaggttggttattgaaactatatttctaactcagtttgggtaacttatttttctagaatttgcccatttcatctgttttcgagtttttgacactactcttctcaatagaattcttacatgatttttcaaagtctccattttagctgtagtttttgacccccttttaattcttaatattgcctacttatactgtccttttttcaggaatcatttttgccagagattgaacttgtcttttaaaaaatttggatgtaggttttgtttatcctttgtggtatatgtcttttagttcattaatatcttatctttatttccttctacctttcttttgtttattctggtgttttttgttctagtttcagtagtggatgattagcttattttatttttttcctcttcactaataggatggcttaaagttacaaggctttaagcaacaatcttgtttcattccacaaggtgggatatataattgcttaatggcttagttttaaatgttttcagatttcttccttgttccatgagttacttagaagcaagttttaaaacttatatagtctttaaatttttaagttgagttctaattgagtggtggtctgagaatgttactatgatttaattctttactatttgtttaattttttttttttttttagctcctggccaggttttatggttttttaaaaaggtgtcacttttaatcatgtgttcaataaagtagatttattaattgtgtttgcatcctctatacattttccaatcccataacctgtgttaccaagagagttgggtcagtctcaccctttaaccttggatatatcaatttctcctagtaaccttcagtttttactttatatgttttgcagctatgttattagatacatgtaatcagagttactgaatttttaagttcttgaccttctctgttcttaataatgatttttatcctacagtctgtgttatctgaaaataatataaccaactttcatatggttagtatttgctcggagtacttcttccatctctttatttcagcctatatgtctgtatggtttaggactgttgaatggcctatagctgctgttagagttggtcagtttagtctgttaacacgtatttagattactgatgggtttgaattcattcctctcatcagttttgtgttttatttaccttgctttttcattgcttcttttacttttcttgcctcctattcttttttcttgttttctctcttttctttaacaattattaatacagtataatgtaaccagtaataatgtacatcgtaatgaataccgctgaacctaccacctaatccaagatctagaacattgccaataacttccatttgagtaagagtttagtttgaatgttaaaaactctttgtttttcctagattgtctttaaatttttaacattcattctcaacaagggctaaaattagtatctctagcctctccccaaataataagaatcttgaaaccttgcaacttcatatcccccttccaccttatatattattgctgcctaagcattttaattctgtcttttattttattttgtacttgcatattctgcttacgtacctatctataatttaattcccttcaaattttattgttgatattagtatagggtcaccacttgtttcactttatctaggttgctggtttatcagtattccttctttctggtctctctggctttcattttcttgctgaaatatgtcctttagtaggtctgtcagcagggatctattggtagtagttgctttatctttgaatatgtctattctcattcttaaatgaaaaagaattcttaaatccaaattgacagttatttctttcgccataatttatatatagccattatcctctggtatgtattgttttaagtggtctgcctttggtctcatagtattctttatgagtaacctgtcttttctctctagttgcttttaaggtcctgctcttgtctttggtgctctgaggttactctgtagtgtgttttgatttggattagtttaaattatcctgctagacaccttctctgtcttttttgggatgagggaagaatgttgtatcattaaatcttagaattttctcagctattttaaaaaaygtttcttytctgttctttggattttttcttttctctttttgttttggaactccagttatagacatatgttagagtttctcattccatggttcttagctctttcattcgttccatctctcgattttttttctaaaatgtcacctttatgtctcttatgcttttttattgtctcaatcttagttytgtctcccgaagttcttgagtctaatcctacttctaatccatccttccttctttttgagctttgggcttttagcctctctaccatttgtgctgatctgtgggtatcctttttagcctggtatgaggtttattctttcctgaggcggggtgggggggaattgctttctgttttgttaatatctcagtttgggctaggggttcctggacaaatgggcttggttgtagagtactagtccattgtccctacagctcaagagatgcttctgtctgccagctcaggatagtcagagaaggcatcctgtagtcccctctacactagtgggcttttcttcttctttttttgatctacctatcttctggtaagtgtagcccttttggggatcatgactttatggaataggagggtatctcttctcacctcctaccttgagcagwcccaaacttytcccccgtccctttgagggctgaaaactcaaatgtcacagacagacgttcacacttcatttggtctgaatattgctagccatggaatttctaaaatttgcttctacgaactatttattagtttcagtgtgctaagcctgctgggaggaaatgctggttgtgagcatcagcacagaagcattctggacggttattagcacaaagttagcatatgattttgtaatctcttctgctaacagtgttttttaaactaactctttacggtgtcctgtgtactaggtactgtgcctgtgctgacttcctagctttattggaagttccttgacagcggaccgaatccctacccgttactctttctccatctccctctgcagtgctgagccctcaaaaacaaaacagcaacaaaaaacacacttgcactagttgctgattggttaatccccacggaaaggttaccaacaaaccacagcagtgacacagaagggaatgcctatttccacatctagggaggcccacctgcccagttccgtgctgctgacttagagcacggctttgctgatgatatccttggctccttctctgcgtcaagccgcaggtgttctctgccttctgtgattctgctcccctccctaggtggtgtcatgaagtgcatggtatttctgctggctcctaggcttttcccctgaccttgcacatacagttgcctgctccacttccccacctgcccagtcagggcatcacacccccttatccatccagtcttccttgaattttacccacctcagtgagggcagctcttcccagtcactcaggccaagaacctgtgtctttcttaacttcttttacacccctcttctggtcaataaggaacttcttggtgcttctttctgaatatataccaaatctggccatttatttcctccattatgcccaccataatgcaagccattgtcatctttagactgaactatagtaggcctcccctgccctcccctcccctgccacttagtgtcagtgttccacgaaaaaaaaaaaaacacgtctgatcctgccttctgctgcttgcagcccccacccagctcccaccatcctcaacagcacccgtggccyggctgcaggctgtgcggacctgaccccattccctgggtaaggctgggtgtgcccctacctcttcccctgtgtgggacggtcttgtccccagatacctgtagttgatcctgtgccctatgcaggattctgttgacctgcgactttgccagaggttcagactgacatctctacagattgctcgactccctttatacccttaaaagaaacagtggcagttatcacttagtaaacacaatggatgcagaagtgacaagtccttcccggagggtggagacccygagagtagggattccgttccgcccagtcctgcgtatccaccgtgggctcagaggccacacaccggttcttttgcgtgtatacatctatgtagagatggagccataagtaatacacgctttaaaggaaggggattttacattttgggggggagattaagttgattgccaaggaatcgggtggggatagtttataaaagtgagggacataaggaataggcacgcaggaatgagggaatgaaagcccyggagccgcctgggagcctcactgcgctgtaggacctcgtgccagtgtggccatccgtttacgatgtggtgggcatcctttgaggtttttcttctgattttggggaggtgggcggtactggtgacatctgcttccagagcagccgtccttcctgctccctttctggtcttcggttgtttccactcgggttcttgcggggcgcgctccctctgctttctggaggtgattaatttcccaactcctcggcaccgccttccccacccgaaaaaaggatgcagaaccacgcctgcagttgggtgggcctcccgggtgctgggcggcccggggcggcggggaccccagcggcggggcgggcgggcgctgacgtgtccaggcgggattgggccgccgccctatatagcagccggggcccgggcgccgcgcctcggagcgtcccggcttctcccgcgcggggggcgagtaagccagcggcaggaccagcgggcgggggcccacragtgagcgcgcaacacggggctgggaggcctgggcgggcgggcggacggggcgggcgggctgccgggcgggggggtggggggtggctgctgacgtggaggccgcggagggggaggggcccgggtgccgcggcccccacccgggccccaggctgcggcccccgcccgcgggtgtcctgcttaccgcgcgtggcggttccgggccagacctggggccggctccgagtctcttctgcgcgtggccgtggcgcggaggggcgcgcacaaactttctcaagtccggtggcgccgctgggccgctcttggctgcaagctgggctcccccgcctcctcccggggcttcggtggggcacccctggtgccgtggccgcacggcgcggaggggcggccgacctgagcccaggtcgctgacgttggcggggccggccctcccctcccccgctccggcgggggcgccgtgtgcggccagggtgggggtccctgggaggccagcggggtccttccccccaggtgkcggcggggcgggggtctgggcgcagaccgggcggcggggcccccgcagcacctccacctgccgcgcggggcccgcgtcastctacgtgttcgggggtggggaaagctgctcttcttgggcctggagtgcaacttggacgtgccccagggtcgtggatgaaaaatacattacggaaaagtaccgaatttggatgaaaggcggggaggccgaggggttgctgtccctttaagcctgtccccgcccgcgggccctcgtggcctgtgggagggccgtgctgaggtggcatctgcgaaagttcctccatgcaggatgggtgccgacttccagaacttggtgagaagtgcggagcggagcctgccttctgctcgccagtcgcctgtggtctctcctagatttcgatcttgtgatctctgagtggatcaggattttattttcccattctgaactttggtttgtggtcttgagtaattttagttttggaagaggagaagtctgggtttcagccggaggcttttttggtgccctccatacccggtcctgtctggtgctttaaagcacttgcgggtctcattaactgaggctgaaatgaaattcttcctggagtattactgataattctcttcgaagactgttgccccttgaatatgtagttggcaaaacttatcacaagggaatcaacttaattacttcctcgtttaaaagcaaaaaagtagaacccctcatgtgaagccttttttgttgctgtcagaaacctgttagacttgtgctaaacttgtaagcaccaggtttcccacgcaacacacagctctgtcaggactccacgttttgctctacacgtattagggcggaaaggggtcttggttcctgccctccttcctttagttctagttctgtttgctgaaagttaaattctgagatgtgaccttttttgctttggatgtttgcactctgggaaacaaaattaaaagtccaggttcagtatagtttgaggtttacattaggtggacctggacactgattgatccgagcttcctatgggaaaagtagttgggagagccagaatcacgaagggactggggccatatgggagggactgaaggagacaggagatagggctcacctaccagaaggagccttggaggagagcggacttgttctccatggccagaaaggggaaagaagttgtagattttgtcataacttgaggtggagcgtttacagccatgcaggggtggacccgggccctgagaaggccaygaatttcctgtccctggtggtattaagaaatgggattagattaatatctgaggttcctttcaatcctgatttggacagtactgttagatccagtgagaatctgagatacccgatgttagcctctgttcttgggtatctaggcctgcccaaggtatcctgggaacttcagatagcaagtggagttgcctggcgctgtcctggggttgctgaaagatccacatggaacaggattaaaccctcgtgggtgttgtctgtgaaggcagagccaggagcagggcgtagcagtgcggggtggacatggggctgtagggtcagcttcttaggtgctgctttgttgaaccagaggcaggtggacccctgggctgtgcctcactggattgggagcacagaaggagaatgagactgacttttaagaaaatctcacccagaatttcaggtggggacagggtctgcatttacatgtgggtcatcaaatgcttgcttaaaacgcagtcttcgaaaacaggtttttgagttgtttagaagaaaaacaaaatgttgtttgatgataccagaaccctagatgttaaatgtgtctctagttgtgaaccattcgttacacgctctgacaaactgccacttggaatctggaggctagggacccagtatagcctgtcaaaccagtctggagttttctggaggtctgccttctgccttacctggctgcctgagggtctgtgcacgcctgaggaacatgagaggctctgctccagggtctccctcagacacaggagtaggttcccttatgttgagactcctttcagtatagggtccggctggacttggcttctgaagggtgtgtgagtggtctcagaagagactgacactgggtgcacagtggggattggctcatcacagctccgtgctggagagtcggtgcgggctgacatggacggaactgcattttgcagacttctagtgtggctgtcactgggcactagagacttgcccagaacctagcttgataagggggtgggtgtctgggtttaagaagtgacattggagcccgggacaaccttgagtgagagaccatgccaggtgagagtcagcaagcaagcgtgggagggcggagggtggatgcgggagaccagaggcaagtgtcactggacacctgttggggcaccttagcctggagtgccctgccctgttttgctcccagactggacagacacttggaatctcaaggagctcttgccgagttgtgaatgtgctaatctgacactttggagaaattttcttactttaatctttaaaacttgcaaactagaattttggtgatgcttttaaatggaatactcttgatcagtttgtcccagctttccccttcagtcttggggtacatctgtgtgtctggtgcatctggggccccatagtgtctctggtttgtggcaggttccctgtgtgactcaagccctgtatttagagtttttaaaaaactcatgaccaagattagaatccagaaataccaccagtccacatcctctgctggaaaggcgagaccctttaatccagtctactggatgctcccccattgccatgaaccgccttctcagctccggacccatgtgtcgtaaggrcaagattattgtcacggtacgagtagtcttctccagttgagtggggtgttcctgttactgtcattgcttttcccattttagacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtaggtcagagcccagcacaacaacccttcttctggttcagccgcccagcggttatgtggggtacgggaaagatgatccagccatgcaggagagcaccagtggttctgtgaggattttacttcaaaatagttaagtttagaagtttggcacttaaaagatcactccctcaggtccctggaatagttgtcctctgcaagttggagctggttcatgttttgttttaatatgttttgtttcaagctaacgttttttttttcttccaagaaacttgcctgagtattggtgttagtaaccaaagcataaatatcttgaccttttctgattttgaggtaaaaagatctgagttgtaaaatgtagataagtaacttttctctggtttcctctctctcctctcccacttcccatcccataccagcaaaagctggcaggctgacagaggcggcctcaggacggaccttctggctactgaccgttttgctggtaagtttgaccctgtctgaagacttcctgtccctgggctgtgtgtggacctgggggcgcagggatgcgtattttcttagtcctgtgtgtaccttctttctttatatcacaccttcaagtttctcgtggttcgtcagagatgtctccatagcttcacctcccagcaggaaccatctatagacgtgtgtcccttagatgtgtcatctggcttccgtctgtttttaatcttttatttcttaaatgtgaattatgtttattcagtattatctgaattggggtcttgcttctctttaggattgcaggccttaacttttcttcaacttggggagaggtcttaattatgttataaaaattatgcaaaattcactccttattacttggccttgttgtgcgagtaattgatgcgtaattgtgtaaagaaaatgggttcttcctcactgtagtagtttggagctcacctggaactggggagagggaaggagagggaaggagaggaagctaacattcctacctcagaatgctgaatgtaccccatttttcacataagggagctgtggctttcggagcccatatcccgctgagcactgtggctgtgctaatgagaaactcagcgcccttgggccaggtttcccctgctgtgcgagttctgtcccacacctggagggatgggagaataaccagtcagtgtggatcaagggcatttagcgcaatttgtgggtctgttactgttgctacaaagcactgaggctgctttttcctgtcacgcagctaccacttataaccacctggttaagtcgagatttggaggtggtttagtttggggcctggatgcaccttgcagagagagaccgctggctttttgtagcaactgtcatgatgcattttgtaagcattaagaggtgtgtggtgagcaaattgacagaataaccaaggtcrctgttaggagaacgatcctggtgttgatctatgcctggagcctgggtcaggcaggtggcaggttccatggtccccccacccctgcggttaggggtggtgttgactgtgtctctgtggcccctggggtggagaaatggatgcagactgccccaagtggaggatgagctcctccattacaggcaacttttgaggggacagttaaccagctgttctaggacaaacttgtctaacccgaggcccaggacagctttgaacatggcccaacacaaatttcttaaactttcttaaaacatgaggtttttttttgtttgttttgttttgtttttgtttgtttattagctatcattagtttattttatgtgtgtcccaagatcattcttcttgcattgtggcccagggaagacaaaagattggccacccctgttctaggacctcctttacttgcattttcccccctttttatcacttggtgagagtttgggtatcagcttacatcagaggttgtgaggaaaataaaaaggtatagtttgctggtaaaaaagagagtaaaactttgctaaaactcttaggttaacaatctcatagataattgagggttgtactttgacttctgatttattcttctttgctttagtggttttcccggattgtgtgtaggtgtgagatcaaccatgagttccgttgcagttttgacccaagagagttttgctgaacaccgaagtgggctggttccgcaacaaatcaaaggtgacagcccttttatgtgctcttcctggtaatgtctaaggcattgctccctctaaagcctttaccaaatcccatgccctttctagaagtaccttttggccctgtggttgtggggcagggagggtccaacatcttgtgcactgttttcgcattgctgtgcgtgcaggggcgactggccaggcatgaggaaatgaatcaagtacagtgagatttaacatgtgggcagctttctggaargccagcgaatttgaccattggtaattaatgcagtccttttcaaaactgctttttcctaattgtggtaaactaaaatctgggctctgaagcatcccagagcattgcttaagcctgccttgaggatgaaggctggaccctggcttcggagttctcgaacgccactggctgggattaagagcagtgctgtacagtagaatagactacaagccacgtgtacaatttttaggattctctggtacttattaaaagggaacaggtgaaattaattttgatattttaccccaatatgtctaatacactgtcatttcaacatctctaatgtaaaaaaaagggggggaaccattgatatttgagattatttctcttcgaagtctgatgtgtatttacarcggtgggacatttccttccatttgaatgccagattttcatccaaaatccttgatctgtgtttagatgttataaaatcttcatttgaaagagcagattgttctactccaggttgttcraaacacacttaaaagttttccaataactaaattgagtattagttcttaaaattaattaaaatataaaattaacttttccttagtcacactagccacatttcagaagctcatttctggtggctgctgtgtcaggtgttggaacccgagaagctgctttgttctgggggcctgggatcctcctcctggagccagcttccctgtgaagtctgtgtttccctttctagagagggaagacggcactgaaagaatgcttccacctgtcctgtcagcgctgtcgggtagatgggcatgcagctgggaagcgatgggcctggacttgggcatgagcctgtctgattccagagatcatccccctgttctctgtcacatccattcatggtgtttttcactgggccttgctattgccaagacrccatgctcagtcctggggatttgggttatccaaaacagtcacacccttgatttcatggagattgtggctaatggcacaaacacatgaacaaatagggcactatggaagatggaagtgatgataatcagggaacctgatttccacaagccttgctgtcctctgccttgggcagggcagggggagatcagcggtgacaattgccactgcagtctttttttttgagacggagttttgctcttgttgcccaggctggagtgcaatggcgcagtcttggctcactgcaacctctgcctcccgggttcaagcgattgttctgcctcagcctcccgagtagctgggattacaggcatgcaccacccacacctggctaatttgtattattagtagagacagggtttctccatgttggtcaggctggtctcgaactcccgacctcaggtgatctgcctgcctcggcctcccaaagtgctgggattacaggtgtgagccaccacgcccggcctccacggcaatcatttttaaccttgtatgttacagtggaaaatcagagtttgcttcaaaggcarttctcacaggtggtgctgggtaggaccattgttttgcaaatgcaggggtctgctctgtgcctggcattgccatagttgtgatttttttaagtgtgttattagactctagaggacttaaaaattgacgtagcaaggcttgctttcaagggactcaccccgttaggggagtggggctcacaatgtctgagctgatgtttaccarggaggccatgtggatgggggtaggttcgctgtcagagactgggagtctctggcctcctctagctctcacactcagggtgctgggcctggtgacctcctggggccttttccyatcactatgaattagaagagaggggtggggggagttgtccttggagcatttgatggttcttgtttgtctgtttttaagcactaaaacccttaaaagtgtttttcatgtaatgctaaaagtagtgcttccttttaatctgtgttggctggtccagttgccactctaaattcagaagaggagagcgaccctccaacctacaaggatgccttccctccacttcctgagaaagctgcttgcctggaaagtgcccaggaaccckctggagcctgggggaacaagatccgacccatcaaggcttctgtcatcactcaggtagaaacaccattctttcttttaaaaattttatcatgtaacatgtctatgtaaatttttaaattttttttcttttttttttttttgagacagagtcccgctctgtcgcccaggctggagtgcagtggtgcgatctcggctcactgcacgctccgcctccygggttcacgccattctcctgcctcagcctcccgagtagctgggactacaggtgcccgccaccacgcccggctaatttttgtatttttagtagagacggggtttcaccatcttaacaaggatggtctccatctcctgacctcgtgatccgccttcctcggcctcccaaagtgctgggattataggcatgagccaccgcgcccggccagttttttaaatttttaaaaattaattgctgttctttcttaacctatccttccaagcgtagaatctgatggaagagtttctgaatgtgcaagattgagaatgctttgagtagctaaagggagaaggccttcaatttaaatcatcccccaccccagagatgtttctgtcgaccacttctctcatgtccaccctgtatgctagcactcagtaggacaggcacgtggtcgttttgcaggcagtgtttgtcagatgaatgggtcctgttttctgttctctrttcattatcctgctttctcgaagaggttaaccagtttcctggttttctttggcttcagtagcccttctctctgctacctgaatttgagatgttagtgagtttcaaaacttttatataaattcatatcatctggtcatggtggaaaattactatctcgctgccagtgtcttccctgaattttaggctcataaacagttgcatcccaatccttccattttcacctgtctgctmtcttgttaatggttttgttaaatgtaccactgtctacttggtgactgtggtctcacaccagggtagttgatccctcttgcttccaccttgtccctcctcagttcttctccataaagcaacgggagggaccctgcaccatcaagcagaatgcctcctgctgaaaagcctgtgttgacttttactacrgggtgggatgggtgatcctcttcactgtccccctctggtgtgtgcaccaggctccgcccccatccacctcctccgctttcctgcctgtacacccttagttccctcacctcttaacatggatagctgcctcgtgcttcaggacggtgtttcctggccgtccccagggtccacctcccactttctctcaaactctcttgcccctgttgatttcatcacagcacttgctagctgcctcattcatttgtgcagctgatgtggttctctccttaggatgtcagcctcttgaccttggccctttctccttgtctttcggctgctttatcccagggcttcgagcagtgcctgtgggcagggtggggctgctttgtgagtggatggtgatgaacacatgttctttactccctatctgttggccttcttttaatctcttaacctttccttttttgatcttttttgagcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggtgggtagcctgaggcctacttctccccagtgactgtgtacccgttccattacccggctcctgatgcaggctagaacgtcactggacccttcctaccagtgggacagttccgtcttttggaggtaggacagcaacattcagagtcctctggcatttttagtggaaaaactcactaaactaataatagaactgggacacttaccatttttgctctttgagtgaatgaacttgaaagtaataataattttttttttaagagacagagtctcaccttgttgtctaggctcttgtgcagtggctattcacaagtgtggttatagtacactgtggcctcaaactcctgggctcaggcaatccacctagcctcccagttagctgggattacaggcacaccaccacatctggccaaactgaaaattagaagcttgtcccagagtttgagacacttaaaagaagctgggcttgctgaatggtaaagatgggtggttcccattgctttgctagtatgttcactaactacacatttccaggccccaaattgaggagattacaagttcaaattctgttttaagccagtttcctcgtctttggcagtctgatgccagtacttggactttatttaagaacatttgtaataagcaaatctctgatgcatttctccctaagtggtagcacttaaagaccaagaaaaatgtaaagaatcttactaaagtgttgcgtgactgctgttgtactagataggcttatttaggaatgggggttcttcccatctgctactgagtctccttgatcttgtgggagctggatctggagcaccctggagcrtggtgattggacgatggggatttgatgggagagggcctgaggggtaggagtgcagggtgtagccaggaggcgaggcagaggagtgccacctaatgcaggtccagctgtgccacttaaccacatgggggcatcgggacagtccccaaccccagctggcttcatggagttaaaccattaagtgttaggaaggtgaaagtgttgcttataattgtccagcatggtggccagtgcataataggctctgaaagttttccaggtgtctgctagtcagtggatatttgagcttctgttttgtaatcaacactgtaggggaaagggccacttcactgaatatatggatcagaatgaagacattgacccctgacactctcctactcctcarttatcttcagacaaatcccagatacattattgtgccttagttcagatcttcccgttttcatgtatacatatatatagtcattgtgctcctaactcatgtaatcatattgatagtggtttcttaatattatacctttttaacccagtctctgtttggactttcctcatcatctccaagatgtttctttcagttggtcttttcaagtcagtgtccaaacaaggtcacawtgttgcatttgattatagagtcctgtctctcattctttaacagtgcttactccctcctacccccttttttttttttttttttgagacaggatctcactttgttgcccaggctggagtgcagtggtgcagacacagctcatggcagccttgacctcctgggctcaagtgatcctcctgactcagcccttcaagtagttgagactgcaggcatgcaccatcaggcccggctttttttttgtttgttttttggcagatgcgggttttcaccatgttgcccactctggtytcaaacccctaggctcaaatgatccactcatttcagcctaccaaagtgttggaattacaggygtgagccaccacgcccagccaatcctccccttttttaatgccattgattagtggggaccgtaggtttttggttctgctattgactgattatttttggtgaactggtgttagatctctaggggcttggttacttccacagtcagcttgttgggcaagaagaccctgtaggtggtgctgagtctgtgctgtgatagctggttgttctgctttgaactgattttgagattgatcattaggctcaggtctgggtcttcccttgtaaagttccctatcagtgctttgtgtaatcattttactatcaattggtgattgcccaaattcgttaagggttgcaaattatgcttttctaattctctccctgctcatacattagttgataattcttgtaaagaagaatttttcttcatcagcagttgggtgggaagtaccagataaataatcgattctttggcgctccggcgacttcagtgttgatcagtgactctctttagtgtcattatgaactcaggcattgtccatcattcttcatgctggagctgcttcatctttggccagtgggtcccctcctttcagttttgttccctgcagctttctgtcatgacctattaatatcaataccttctggccaggtgcagtggctcacgcctataatcctagcactttgggaggctgaggcgggcagatcacctcaggtcaggagtttgagaccagcctggccagtatggygaaaccccatctctactaaaaatacaaaaaaattagccaggygtggcggtgggtgcttgcaatctcagctacttgggaggctgagrcaggagaatcacttgaacccgggaggcagaggttgcagtgagccaagatcatgccattgcactccagcctgtgcaacaggagcaaaactctgtctcaaaataataaataaataaataaataacttcttaatttctaacacagaaagatgcctcaggctaatcttacatatttccttccacagaccttgagtcagctgtttctctctgaactctgaaccttttgagtaggaaattgcagttggagactccagtctccataggtgcacgtcgcaactaggttgtcagagcttctaggctttttcagaagacagagctaggataattgtacttttaagaaaggaaaagcaggcggtgactctcacgcctgtaatcctagcactttgggaggccgaggtgagcagattgcatgagcacaggaatttgagaccagcctgggcaacatggtcagaccccatctctacaaaaaatagtggtggcgtgctcacctgtaatcccagctacttakaagtctgaggagaaaggattgtttgagcctgggatgtggaggcttctgtgagcagtgtttgcaccaccacagcccagcctgggtgacagagtcccagaaaaggaaaatcatgagttcaaaatcacttgaagtaattccttttttctgagtttttctgtcatcttgatatagttaggtacatttgtttccatttactgtcaatttttaaagtatttcaacatttacatgcttgcaaagtcaacgttatataataaagtactttcagagaaatctcccctgcctgttaccttcaccctgctccctcctcacctttgcaggcggccattcctggtcctggtttatcctttgttgtttgttgtttgagagcagaagcaaaatacagcttgccatacaccctgttctatgccttgctttttttcttttattattttttggaggtgtctgcatatcagtaagtagtgatttttctcatttctttgttcagcagtgtaatattctgtgggcgtactgtaatttacccaggctttcctactgatgggcatttgggtagtttccagactttagctgttacaaattatgttacagtagcaatcgtgtgcatatgctatttcctgttttacccagtgtatcttgggatagattcctagaagtgagatggctgggtcagagggtggctgcatgtggaatcgggccatcggatgctaaatttccttccttaggaattagtgttttgccgtctcatcagcagtatgcaagagccaggctcttcacattcttgggttttagccgatgtgagaggcaaccaaatatactttaaatttgcatttttctgatgagcaagattgagcaccttttcaatatataagggccacttgcattttttattatcttgagtcattgttaggaaagttttttcactatcaggtcataagaaagtttatcttttcttctgctgcttgtaaatgtgttcttacatttcagtttctgatctatttggaatttattgcaaatagggttgaggcactgattgagtttcacttttttccatacggctttcgagttgtcagcactatttttttgtttgttgtaacacagggtctcagcctgccacataagctgaagtgccatggcatgatcacggctcaccggagcctcaacctcctaggctcaggcagttctcctgcctcagccaccccagtagctgggaccacaggcacacgtcaccatggccagctaatttttttttttttttttttttttttttgagacggagtcttgctctgtcgcccaggctggagtgcagtggcgcgatctcggctcactgcaagctccgcctcccgggttcacgccattcgcctgcctcagcctcccgagtagctgggattacaggcgcctgccaccatgctaatttttgtatttttggtgacctcgtgatccacccacctcggcctcccaaagtgctgggattacaggcgtgagccactgcgcctggccttggccagccttatttttaaaatttttgtagaagtcaggtctcaccatgttgcccaggctgatcttggactcctgggctcaaacaatcctctcatctcggcttcccggagtgctgggattacaggcgtgccatcactgtcttgaaaagacgttttgctctagtgaacttgagtggctgcttttatcatgtcctaaatgtttatattaacttagctctgtttctgggttttcagttcagaccagcaggtctttccgtatactggtatttcctrtgttaatgawaatggtttcatgtttaatgtctaggaccactgttaacacctccaccctgcactattctttttcagggttttcttgttyatttttgttkgttctgtgttacaacctttataatcaactgtttgaaattgtattaatattttaaagttaattgggatratcgccatctacttaaaccttctgttagctattttaaggagtgttttctaatttygaatgcacatactccaccttgtgttgggcttrtgtcttgctattttcttgtccttttttcttttttccttttttctattagaaacacatcttttggccaggcgcagtggctcacacctgcaatcccagcactttgggaggctgaggtgggcggatcacaaggtcaggaattcgagaccatcggggccaacatggtgaaaccctgcctctactaaaaatataaaaattagctgggcatggtggcgcacgcctgtagtcccagctaatcgagaggctgaggcaggagaatcccttgaacccaggaggcagaggttacagtgagccaagatggcaccactgcactccagcctgacgtcagagcgagactccgtctcaaaaaaaaagaaacgcatctctttcattacatcttctaagtagttgttgtttgtggaagttaatgttgttaacttcttgatttcagtcttttctctttgctataaatagaatttcacccagtagttttttcagggtttctggatatgcagtcatgcttcttcctgtccagcttttgtggatgttaactcttgtctccctttgtgggtgtatattccagtggatgttaagtagtggtgcagatacactcgaacttaccctaacctgggagtcagggcaaccttccccaagcatgtgatgtttaagctcatgctgttttaatggatgagttggtgytgctgggcrrgaataagcaaagatggtgtttctgccagaatgtcttggaaaaatatgctccttcagaacctacaaatattcttgttttcttttattctcttcttgctataggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggtgaggcctgtgtgagtgcctcgtgcccctgcctacctgcttgtgcagacctcactccctcatgggttgccgtgtccagtgtggacttcaaggcataatgtggtgggggtggaggkcttgactccaactctaaaaagccctgtctgtccccagtttgttttcaaaggcctgttctcatcagatcatcccttcctttccaggacaaacgtgctgtggagaggctagaartagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggtacacgatttagaggaggcaaatccccatgggcaggaatagaaatgaggatttgggtctggagattcagttaaggcctggttctgccccttatctttttgtccttgatgaagatgcttattgtctctacacttgagtgacccgggtgagatcggtgcccgcccccccttgctgttgagcatctgcctggcagttgtccttgccgtcctgggcctctgactgtgctgacaggctgccagctgggctgccccgggtcagatgcacatcccggacttgttcacgtcttagattaagctgttagctcagcttagtgaactttgaggtctgaaacgtgttccttaattgagggaaaggattgggtgttttgcagtgttcaaggacgaagttatcagccggcgggtgactagactgaggggaaaaatccagtccttgaacagtgaagtttctggggattggctagtcctgatcacttgttgttcacttcttgggatcagcatctatagtctgggccgctttggcttgctttctgcagcagtggccatgcccacctgcccgcttcccacacctttccctttgactgccccttatggtgctcttatttagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggtaactgcctccgagcatgaagtgtgtctcctttgagtggagtccgcggggccttcatggatgagctctcgatttgtaaatcctggggcctggacacagtgcaggtgcccaggtttggggagagcgtgcctctgagccccaggtgagcagcctggctttcactgtgacacgaccttgagctctgcaaacccatggctgttctcccrttttcttaggccaatagcttcaccgtctcctctgtcgccgccccttcctggcttcaccgtttcatcattggcaagaaagggcagaacctggccaaaatcactcagcagatgccaaaggtaaggacacgtttttcacctgttgtattgaatttgtcttgttttctgtctttctgtttctgatattgctttgttgacctttgtactgtggatgcccttgaaaactggtgtatttttctgaattaactggcckgtttgacatggtcaacttccgtgttagcttaaagaacagcagaataaatgtctgtagatgtctgtaccatccttctggcctttaaccagagaggattgtatgttcttaggtttcataagtatcttaagaaacatgtcatttagtaattatggtgaaataacttcatgatactttggcgggccrggtgcggtggctcatgaggtcaggagatcgagaccatcctggctaacatggtgaaaccccgactctactaaaaatacaaaaaattagccgggcttggtggcgggcacctgtggtcccagctgcttgggaggctgaggcaggagaatggcgtgaacccgggaggtggagcttgcagtgagccgagatggcaccactgcattccagccttggcgacagagcgagactctgtctcaaaaaaaaaaaaaaaatactttgaagagcagaacttgtatacaaattgtattaagtgtgartttaaagcgttctcagtttaccaaaggagattgtagcccccaggaaacatgaacaaaaaagaaataccagagaatccaaccatcatatttaattcctgttttatttaaactttgtttccaattaatgttacagtcctttttaaaaattaawttttttttattttattccttttttttagtgacaaagcctcactctgtcacccaggctggggtgcagtagcgcagtcatagctcactgcagccttgaactcatgggtcaagtgatccgctcgtctcagcttcccaagtagctggcactacaggcgccccaggctagttttygtggaggcagagtcttactagttgcccaggttgatctcgaactcgtgggatcaagtagtcctcctacctcagcctcccaaaatattgaggttatgggtgtgagtcactgtgcccagccccttttactttgtatagcttcatataaggaccagtctgccttccttaactccttacctggaggataataaaccaggaactctggcagccttgtctatgtcaagcaarttactttaccaccttggtacagctatacgagttttaaaattccatccgtgctctgtctcattctttatgcaactcaagaggaccaggccttgtaaaagttcagatggtggaggagcatgtcgcatgtcgcatgctttatgttagtggcttctgtggggcaaacggtgtccttagtgagaggcaggattattcggccacagtatttagtttcctgactatggctccctaaccctccctttcaactttgtttgatggctgtggatatgtccctccctccctcacatctatgtgaagcagtttgggatcagaagccgctccgaagagagctcccactgggagctcaggggctgcagctgtgccattctgttttagctatctctttggttttggtgtggtaggttcacatcgagttcacagagggcgaagacaagatcaccctggagggccctacagaggatgtcartgtggcccaggaacagatagaaggcatggtcaaagatttggtaaggtaccccttggaatgttgtgtgtgctggtgacaagggaggctctgagttgggcatgggcggtcatctctcgatgacatcccacatgtccgggcacagacacccagggcatcctagctgggtgagtaataggttctgaaacaaccagargctggtcgaagtcctggaataatcgtgggtggaggaaacttcatcttgaagaaggcatctttcaggggagatgcaggggcagtctccaacaattcctgacagctgagtggtcagaaaaggcaaccgtggagactgctgggttttggttcagctcattggccaagtaaccaggcgcatccatggacctctgtgctcctcctgcagattaaccggatggactatgtggagatcaacatcgaccacaagttccacaggcacctcattgggaagagcggtgccaacagtgagtgaggctgtctgttgcggtggggccagtgtgccctgagacccttgtggggggtgtcagctgtgagaactgtgacgtccgtgcagacagtccaggcccattgctgcctgtaatgggagttacagactttacatcctcctgcctgctggaagaggccacttttccttttccctttggtgcagtggttggattagagctgcttggccagtgggtgaattgtcacttttgraaatccatctaagccctccccaaataacccacagaggccatgttgaaggcatgcccaagggcagcattctctatatttccgtcagacctgctaggttagccaatcagtgttggtagtactcatgccttctgaacgtggaaactgctgatctggaactcaytgaagagtaaaaacattctagatttgtgcccaagtaaaacaacatggggagggatacttttttgagacagggtctcactctgtcacccaggctggagtgcagtggcgtgatctcagctcactacaacctctgcctaccgggctcaagcaattctccagcttcagcctcctgagtagctgggactacaggtgcatgccaccacagccaattaatttttgtatttttagaagagacggggtttcaccatgttggccaggcttgtctcaaattcctgggctcaggtgatctgcycaccttggcctcccaaggtgctgggattaaaagtgtgagccaccacacccagcagggggattctgttgaagaggcagtgatatgtcagccaaggtcgctatatgcctcacctgtgccaggttgtaggtgtagcacagttacaggacactgttggaagtatgtcatgtgggccaaggtcgctgtgtgcctcacctgtgccaggttgcaggtgtagcacagttacaggatgctgttagaagtgtgtcgtgggcattctgctgcaggtccaaggatgttttstgttgtttgtttgttttttgggacggagtctcgctctgtcaccaggctggagtgcagtggcgtgatctcagttcactgcaacgtccacctcccaggttcaagcgattctcctgcctcagcctcccaagtagctgggattacaggcgtgcaccaccacacccagctaatttttttgtatttttagtagagatggaatttcaccatgttgtctaggctggtgtcaaactgctgaccttagttgatctgcccacctcggcctcccaaagtgctgggattacaggcatgagccactgtgcccaaccaagaatgtttttttacacctctttgtttaactgtatggctatackcacacactcgcgtgttctgaaaacaagtgcacacgtcgcgtgtgttacctttgkgtggaaggtgagaaggcaagcacgtcctccattcctggatagttcagtggatgaaggagcctttcccaggtagtgggacaccgacctgcataacatgactgacgtccgtgtatccgtttttgttatgagtaaacatagccttggcagctgtgctgtggcctgtgcaatggtgagctctctggtgtcagtcttatgttttgtgggcattttacgtgacagcgacgagagtctgtaggcacaaagtgacctttttgcgcactacttgaaccacacatacaccataaacttgcttttacggttttgttttggttttggttaactgtagcgtttgtttaggcctgacacggtggctcttgcctgtaatcccagcattttgggagaccaaggcaggaggatcacttgagcccaggagttcgagatgagcctgggcaacatagtgagacccctgtctctacaaaaaagaaaaatttagccaggcctgtggtccccgctgctctggaggctgaggcaggaatatcacttgagcccaggaagtcaaggctgcagtgagctgtgattgtatcgtgccactgcattttagcctgggtgacagagcaagaccctrtctcaaaacacatatatatggaagtacagtagtgtaaatctaacattaatttctggtttctgcccccgagaaattgcagaatgtagcttagtcagtcatgtctgttctgttttcttctcatgcagttcctaactcttgtcttctttcgtaatctaaaaaaacctgctgcccagctcccatgtcctctgcttctcttgtcttgtgttgctycacctggcacagctgcatgtccatgttcccccctcagtgcatcgcctcgttgctgcctctgcgtgtgcatgtgtttgggatggacscacaaaaagccctcctcrtggtccttccagcaagctgggcttccctttactgcacagtgggcaagattcctgccttgtttcctgatgatacggcttctccagagtttggggggcctggaactcttaacttgggggtactgggttctatccagagaggttgacagcaggagggtttgcaacagcacttgtcttgcagacacagtgaartgctcagtgtgaatctgagccaacagtagatggggtctctgggcagcagcatgggccccacaaggctcttaggcgtcagtgagtgcttttgtgtggagttaatgtgtgtggtttttttaacttgagaatagtagttcccaaacttactgcacattagaaacacctggaatccttcaactattctgaagccctggccaataccccagacgagctaaatcccagactgagtggccccaaccgtcagttatttgaaggtctcggggcatttccagcttctggtccaggctgagagcctgtcctccagaacccttgtgatccaggtgaagatcataactggcccccattctagacaatggagatttttgtttgggaagctaagcatcgtttttggtgatgggaatcacagataaggttatttagcgctttagcgctgtcctgcccagttatgtcattggcagaatgttgttggtctgtgtcctaaatgtgtttccttttgtgttcctaagtaaacagaatcaaagaycagtacaaggtgtccgtgcgcatccctcctgacagtgagaagagcaatttgatccgcatcgagggggacccacagggcgtgcagcaggccaagcgagagctgctggagcttgcatctcgcatggtaagtgccatggctgggccctctrgaaaggcactggccttgcgtctcttggccccctctaaggagtagcgtgttgtggtgtgcggccttagagaatggaagtcgacaaatcccacgttgcactggaaccggattggactccctggggccacatttcctttatcctccccaggtcacctgcacgtcttgttctccatggctgtgtgctgtgctagaagggcacagagactgtgtggcagcgtcttggccttggccacaccctgggtgcccagatgcctgggtaccatctccagagattgtgacagacatttctggattctcaaaggcatcccaggtggttctcatgtaaggccagactcgaggatcactgcaaacctgaagtgggggctgttgctctctaccacctggcagaagcactgcactgctctgggctccccgacgtttcatacatgcttatgccaagctgtgagcacccttgcttctgtgagtcagatacccacacttgaaagtctctgggtgcctttaagtatccagagaagtcaaatactgcgtgagtgcctgcagcagcactttggcctgactgtgtgaggaacaagccccagggttccctgtcattcgcttaggggattctttgttcacctcaccccagtacccacacgaggaatctcaaattggcagacctcttttatagccctgagctgcattccagggcgtgatgcagcctcccactgcttgtggccttcccggagctcattccccagtctcatattccaggttctcctcttagcctggcctccagcccaggtcccttgtcctggctgctttatgcccttcctgattgctgagcccttacttctctgtcagccaatagccgtttgatccagaatctctcagaattcttggaaatgtttggttggctgttggtgttcttccctgaattccagctctgcttattctgtatttcttctgacattttaatggggcctgtggaggagttgagagccatgtgggttcagtgccctgtgttgaacgttcttagccatgcggggaaagtggtccgagccaccctctgttcagaagggatcactcactgctatgcagaatgccaggcctccaagtagaagagctgggcctcccctgtagtacctgttaaaacagaagtgctcactgaattgctttggtgattactgctatcatgatagcacttttggttgaagggtcctacagcgagttccttaattggactttgttcaggraagtgacgtgcagcccatgttgcggagtgtagcgatgcttggtgagagcactcattatgcgctgtgcacactcttaacagctggttgctcccggggtgctacgaggtgccacctggagaccacctcacctgctccatgaaggactgtgcccagggctccctggtgtccccttgtgtcagtggggagttgctcgccgtgcttgtgataaatgacatctactttaattgtatttttaggaaaatgagcgtaccaaggatctaatcattgagcaaagatttcatcgcacaatcattgggcagaagggtgaacggatccgtgaaattcgtgacaaattcccagaggtaaagtttcccagagacattctgtaactctayaggagtgatccaagtcacacttcaggaatatttgatatttgggatatatgtccttcctcatacttgaacttagtctccccatgatttgttctaggtcatcattaactttccagacccagcacaaaaaagtgacattgtccagctcagaggacctaagaatgaggtggaaaaatgcacaaaatacatgcagaagatggtggcagatctggtaggggtgtttcacatcctttcttgtatgacagcacctggggtgggtggggcatgcgtcctgtcagaagtcctgacccccacaggacccctgctctggggaaagcacataggccctgggctggccttccatctcagggacttgggacaaagtggtgacggcttctcacttaatacctggatgtttagattggcagtcattgttaagactgcagtgtttgtggaattcaggtggggagatttgccttttctcatgcccagttaccttgtttccttgaggagtcttcagatacttagagaaattgtcccatccagtaagataagaggtataacaggtgacatgaggagtcatatactgatttattatttttctcaaaaactgacgtgggaacaggtttagaaagtgtagtgagtagtggatgagaaggccacaggcagccatgtatttccgtgggcttcaccttagctgatggctgccctgggagaggcgatggtgaaggactccagcactgtgagctgctgtcacatcactgccgtgagtgcagaattgcccagagcgtaggggtccgtgctgtctccatrtgtgttctgagccccttccttaaccagctctgatcctggcatgggacatgaactctctcttagccaaaaagtagacttgcatcgattgmctgtaatttgcaacgtaagttagttgttggacaaatgatctatctcacttaccctcatgacaaacctctgaaggtttgtttgcaaataccagtgctctgtcgtgttcatgctacccttaggggtagaagggatactgtattttactctctagcacaggtggtgaatcgggctgtgttttttgtctttaaggtggaaaatagctattcaatttctgttccgatcttcaaacagtttcacaagaatatcattgggaaaggaggcgcaaacattaaaaaggtgataacttgtccgctgcatcttgcttcttcttgccttgtcctctgtagccctgcaccattttggttttagactaggarggactcttccttacttctagccctgtgctcaactgtgtctcaactctgggagagctctagtcagcttctcatggtgatctctctccctgtagattcgtgaagaaagcaacaccaaaatcgaccttccagcagagaatagcaattcagagaccattatcatcacaggcaagcgagccaactgcgaagctgcccggagcaggattctgtctattcagaaagacctggtaatgggagatgttttctaatggagatcctccagtaaaatctctaacagcctctaagattgagcctggggttgagtcacgcagggtcattgggccagcgcaggctgatgtggaagattgcacctttcaatccaggctactgatgagttggtcagcagttttctgcctttgtctctcacgatacttacttacctggaccctgcagcagtaacatttgacgtgggcacttgtcttattagacattttcttcttgttacctgaaaatcttatctgaaggtatttacggtattttctttcctttaaaaaaaattgacatgcagtaaattgtacatatttacagtgtacaatgtaatagttttgacgtgtgtatacatccatggaatcattcccaccatcaccccaaaaatgtcccatgccattttgtattacagtctccctccatcccacttggcagctcctgaaaaccacactccccccacccccacttctatccccaggcaacccccagtctgctttcggccacagtagatgcttttggattgtctacgcttttgtgtgaatggaatcataacatctactctttattgggcccatctgctttcactttgcaggatattttgacatttgtgtgtgttgtcacctgtattgttggtttgttcttttttatttcaggataatattgcactgtagggatagatcatctgtttctttgtgtgtacttggtaattagtgtctttcaaggggttttctattttctccaaggtgtcaaatgtattaacatgaagttttttagaatagtcctgcattatccttttgctgtcaatactgacgtcacctctctttcacagtatatgtaatctgtgccattataaaatgatgccttttccctggtagtatgcttggctccaaagtctatgttatttttttcccccttatatttaaaatttttttggagatgaggtcttgctgtcgtccaggctggagtgcagtggtgcagtcatggctcactacagccttggctttccagactcaagcagtcctcccaccttagccttccaagtagctgggaccacaggygcatgctaccgcaccaggctaatttttttcttcttttagttagtagagatgaggtcttgttatgttgtccaggctggtctcaaactcctcaagtgatcctctcgccttggccttccaaactgctgggattacaggtgtgagccactgcacccagcctcctttatatgatactaaagtgagtttctttttggcagcttgctttttaaattaaatctatctactaatcccagcactttgggaggctcaggtgggcggatcacttgagctcacaagttcaagaccagcctgggcaaaaccccgtcactactaaaactacaaaaagaattagccagtaatggtgctgcatgcttgtagtctcagccactcaggaggttgaggtgagaggatggcttgagcctgggaggtggaggttgcagtgagctgagattgcgctgctgcactccagcctgggccatagagccagaccttgtctcaaaaaaaaaaaaaagaaaaaagattatgatgtttgcatttaattacagttgtgattrtatatgttatatatcacatatttatatttattacatatgtttaacaaacrcggttaaataacttactgtaatttttttcctcaattgtggtaaaatatacatagcagaatgtatcattttaatcgttttttaatggttaattcaactgagtacattcacaaggttgtgcaaccatcaccctgtccattttcagagcatttccatcatcttacacagaaactacacccattaaacagcaactaccaccatccccacgtgctcagccaccatgatgtcatgattttatatgattggctttcagtccaccatttacattattaacctttaaaaaaaattccattattttttaaagagatttaaataatatgaaaaaatgtatgtatttatccacacagttgccatttctagagctcttcatttcttggcgtgatccttgtcttcattttccttctgtctgaaggaaaccactcaacatctctcgtagtgtgtatccggtaatgacttctttcacattctgtatgtctgcaagtatttttttccttcaytttcgaaaagctgtttctgctgcataaaggtttctaggttggcagtttttttcctttccagacttggcttcattgccgtctcctgttgtttctgatgagaaagctgatggtgcccctggctttgttcctctgtccatgacaaaccttctccctctggctgctgttagggttttaccaccgtctctgagcaagttaggatgtgtctctgtgtagttttcttcatgtctcttagcttggtgtttattgagcttcttgaatatatgtgttcagaatttcatcaaatgtggacaatttttggtcactatgagcattttgttgtgttagccccttgctgtctccccgtcagggactctggtgaccagggtatttagttgtcttctacttgtgctctgtttatttgagttgaggggaggagcgatattggttttctccatgagtttctttaaattcattaattctttgcagtgttctaatctgcctcatttcatctaatatcattttcattttagatgttgttttcttccctagaagttcactctgaattagtatcttctgtattttcagttcttaacatgttcagtctttctgcttttggccatagacaatacagttaaatacctgtttttctgtccttggctggctgattctaacactgtcatttctgggtggttttctrttttcttttcctcgttatgggttttccccctattctttgcatttctggtgtttcttaatgagggtgtttttgtattcctctgaatattattttgtgtttgtgaagtcactctgaaacattttgctccttttaggacttgcttttaacgtttattagggaggatcagagcagtatttagttcaggcccaaatatttccactgctgagataagatccttctgagtactccacgtcccagaaagttgaaactgctgaggacggttctggaccaggctccgactgagctgcaggcactgtttcctggtgtctgagctgtaggtactataccaggccccgactgagctgcaggcactgtttcctggtgactgagctgcaggtactgtaccaggccccgactgagctgcaggcactgtttcctggtgtctgagctgcaggtactgtaccaggctccaactgagctaaaagcactgtttcctggtgtctgagctgtaggccactatacccggccctgactgacctaaaggcactgtatgaggcccagctgagctgcaggcactgtttcctgtgatccttctggggattctttcccaggcccagggtgatttcttcacgcgtatcagtatatgagtggctggtctccggatctcagaggttctcgatgccagtctctttgggctctgatctccggatggttctgtttcctcaccttcccgtactgtggcagcaacttggggcagctgtagggctcaccttgtttcctgtctccagggtcttgaaagtcaccattaggcggtaagttcagtccagtccctggtactgcatcttggctgaaagcagaatctttggttttaataggaaaagtttatgtatccataggcatatggagccacctctggcagagccggagcgttgactgaagaaatagagcattatgtgtggtctgaaattaccacgctcccacctcccaatccagcatagattcacgaggactctgggtcctgttgagttaaacacctcccagcgcgcctgctctgctgggcgcaccccactctccccaggacgtgcactctcctcccccgtgcaggtcaaaaatggcttggagaagtttggtcagtgcttgtaagtggcatctccagggctctaggcctgcgtgttcatcaccaccaaagatgatagtttatcttttcctctgccctttttgccacaaaaatgtgacttcctcctcctgccctgtgtttggtttcaggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaaggtgagcatggggagggagcgtgactcttggcaggaagcctggtcctcagtacagtgttctcgcttctcactgtggaaacccctgaatgcccttcctttgtggcgggtcagaaaacagctctataatgtactgtttatgcgtctttgtttttgctgttactggagggcctttccaggtccaaacgctcacatatgcaatatataaaagttggtctttggcttattagttttggggtgcttttgttttttaaatatgatttacagtaaaattggccattcttcaggtatagttgagttttaagtaacatgcagtcatgtgaccacaatcatcaaaattcattttccatcacccctaaagattgcccatggaattgctgttgtccttgtgtcaaaacccatctgtgggtatgtttccgggctcttctggtgacaccaggtttatgggaagtctggaaatcagtagtgtgagccctcttaactttggctgttctacaccccttgctgatcagcctgtcaatttgtaggaaaaaagcactttcacgttttgattgggattgtgtgaaatttgaagatgagactggcgaggattgacagctcagcagttttgacttttgcaggcatttctccattttttttaggtctgtgattctttattggtgttttataatttttagcacatttttatgttcgacttaacagatctaactactgttactcttttagtgctattgtaaatggcactttttttccatttccagttgttagcacatggaagtgcctgtggyttttgtatgttgaccttcacgaggctgctaaataaagctcatgtatattagcgccagtcactgttttgtggattttttttttttttttttttttttttttttttttgagacggagtcttgctctgtcgcccaggctggagtgtagtggcgcaatctcgcctcactgcaagctccgcctcctgggttcacgccattctcctgcctcagcctcccgagtagctgggaccacaggcgcccgacacctcacccagctaattttttgtatttttagtagagatggggtttcacagtgttagctaggatggtctcgatctcctgacctcgtgatccgcccgcctcggcctcccaaagtgctgggattacaggcgtgagccactgcgcccggcccactgttttgtggatccttattttatatgtcacaatcacgtggtctgtggacagttacatttctctctaatctggagccttgtatttcttgtcttttttgttgttgttattagattgatgtttttgtctttgtgtttaaccagccttgcgtttctggggtaatccctgcttggtttggtargttgtctttggccatattgctagattgcatttgcctaattgattgcctaatgtttgactaatgctgctatttgtggatgtctttgaaaagtagcagagtctctaggtggtatttggtgaaacctgcacttaaaaggtagcaaagttgttatttaatatttttgtgctagcatgtttttctttggtatttttgcttgcgggccagatcttgggtccggagaaaggcaagagctccccgtgtggacctgagtcccgtggagcagcgcccttctcggggcccctgcgtgggtctgccagaagcactggtgtccacaagcagtgtccggggcctttccaggaccctcgttttcttactgccacacaagggcgtcgcactacacgaggcctctgaggaccggtctctaactgtagccttggttggcttgtgtccctctgagcttgagcttgagcctggggagtggctggttttgtggaggctgatctgtagcactcgtgggaagaaagggagcctggcccagatttgtgtgtgcttggtctggaagcaggtagaagagtgggagcatggtgcacacctcttgggcagcttgcttcctgctctgctgggcacaccccacgctccccaggacgtgcactccgccaacatatcgtccggcgcgttgctcccacctccccctgtgcagatcaaaaatggcttggagaagtttggtcagtgcttgtaagtggcaggaccagggttctaagcctgtgtgttcatcccaccagcatctggttgttgtggaagagaagtaggtgtgcagtctgggtattcatctgtttattcagtgaggtgtgctagccccattttgggggtattggtgcaacatcaggacactggtgacaatgtaaggggagcccgagcttgctgtcctacagaccctcttgtcttcctcactgtggtccaggcacgtggtgtcaggctaacacagtgggattggtttctgcagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggtagggagcgggcctcggcggccgactctgctggggccgtgatggggtggcttatcttccatctcttcttaacactgcaggataatgtggtggaagactccatgctggtggaccccaagcaccaccgccacttcgtcatccgcagaggccaggtcttgcgggagattgctgaagagtatggyggggtgatggtcagcttcccacgctctggcacacagagcgacaaagtcaccctcaagggcgccaaggactgtgtggaggcrgccaagaaacgcattcaggagatcattgaggacctggtaggcacttgggtgctcrgggaggggttctcaccccccagtggccactcaccgaagccgtgtatgagtgttcgctccaccctgtagggaggtgactccctcatacagccctggaaggcttcagaaggggctttctggtgctcgctcttctttcctcagcctgtctggcctccttcctgatagttggtgagaattctgcctgcgagaagcacttaaaaaaaaaaagagagagagaaggagaagaggagaggggagagagagagaggaaagaaagcaagagaaagaaagaaaatgcattctgtataagggatcaggaaaaatgaaaatgcagtctaaggggtcagctctcttctcccctctgtgaaggaaagaaaatcgatttgagggcatccacgtgaatccatgggaagtcatgagaagacgtggtctttagaagcagtctttagagagtgtcccctccaggccactcccctgccagggccttggattccctttccctaataatcaagtctgatgcctcctcatggagtcagaggctaccccaggaggtcccactcctttggctgaattggccaccctccagggatggcacctggccttctgggacacatttcagaggaggcccacccccttagacctgtcctgctacctccctcctccctgcgcctggagccctggactcgggagaaggggagcatctgtgccaagtggctgtagaggacagggaggaaggtggtgtgaagagtgctgtaaaacttgccctaaggaatttaatctttgctcttttcttttttctttgtgtacctccctccaggaagctcaggtgacattagaatgtgctataccccagaaattccatcgatctgtcatgggccccaaaggttccagaatccagcagattactcgggatttcagtgttcaaattaaattcccagacagagaggagaacgcaggtgggtcccccattagccctgctctgcttgttaatagtggcgcctcccatgtgagaggcggggctgtcgcacatactggtgaggctctttcctgtctctgctggaaaaccatctatgtattctgggggcttccagaggttcagggtcactccctggcctttaaaagatggaccacgtcagttactgacagagtgaccaggtgaccttcataggtcctagagacacacaaggtagccagtcccaaggcgatgaggagcgtgcagcctcatcctcgggtgtcccgagttcagtcccagtgattctcatgacatcgtttggatcgcatgagccccgtcgtagagcttcctcctccacatctcccatcactgtggggtgtcccctgtgaggsaggcagctgcagcctctggctggccagagggcaccatccaagtggccggcagttctaggagrgcattcagttccccgtaccatgcttgcccccagctctgctcatgcacckggtggtggggaggcgacctgtgggatgcgggtcggttgcctctctctcacttgctctgcatttgtgaaacaaaaggtatgccctccactctgtgttatcagatgcccgccctccactctgtgttatcagtcttggttgagctgtttgggcggcaggtggccctgcagcctgctgagtgcacatagtgtcatctctctgggcatccaggaagcatgtcacacacagccattcaagcccctttgttttcctgagaatacagggtgttttgagtaggaaactaataaactcatactgcactcygtctatgttttacacttcagtggttatttaaaactttgattttgatagaatttcacagartagtataaagacacatcctgtggcaccagtttcttttctcaacttctccccttttacacaygttttttttctgaatgtcatttttagacatgtccctttattcatggtgggtattttcttagaacaaggacattctcttacataattctagcacatttatyggaatcggatttaacattatataacagtagtatctaatatgttgtcggtattcaaatttgccagtttttctccttcagaaacacctacttccccatcctaggatcacccttgatttcaggcaggcgtctgtctggtctcctgctcatttatttacatcacacacctcctgggttctgtcttagtgataattattgttgtgtctgttttgtgacacttattgttgtgstgtctattttggtacacacgcggtgtcccagtgtggcctgtaggagcccctccagctgtcttctgtgtcctgttcacacgcctcttcacttctggggctctcgctttctgrcataaggagctggcacaggtttaccttggccttgccctttctgtctcccctagacctctcaccccccttcccactgcctctcctgggtggggctgcgtgctggccgccttccctgatgrgccctgcctcacagtcaagcctcacttgtgcagtgggyctgccctgtgttcctcccatgaactaactcatctgatctcactgaagcctctgctgtagttagttgctgttagcttcatcttcaaggtgaagaagggagacacagagctcacggcctcccggcaaagccttcattgccgccccccccccccccaaggtctgggagccctctttgaggctgctgtggggacgtcctatctgctctccctgaccagaccaagacctcctgaaggacaggagtggttttccctcccttttaccacccagcacccagcaggtgcctcacagacatatgcattctgaacaaggtgtggggtctcttccagcagctgtcagctgtcccttttcccctttctctstagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggtatgtgtccrtgtgcccccctccaccccccgccaaggcccagtcagcaggcacctggggagacgcgtggcctggatkggatggacggttgcccaagcggcagtggcagtggaggtagccctcttgctcctaccgtgtgcgcacgggctgtgcttctcggctggacacagagtttggggaggccacttcccttcaccaaggctcggggttctatagcccctttctgggacagctgcatgggatccggcctctcaggcccacggtgggtgcgggggctgtggaarggtctcagctgcagggggatgaatgtgacctccagttgcaacgtctccccccgcgtgagtggggttatcaggcctagctcaccttgtgtgcagtcagtgtcgagtgccacctgcgtactggatgctgctctcagtgctgcggtgccacagcacacaaaaatagttctcacgttgccgtggagagacaagcagtcaacgcagatatatcctgtggcaagtgatggtaaatgctgtggcaagaaagcaggttctggaggtgaagggcggtgggggagacagggcagggaaggtgagcagcggtctgagagtcccttgtggcacctcgtgggcattagccaaagccgtcctgatcccaagggacagggcagggaaggtgagtagtggtccgagagtcccttgtggcacctcatgggcrtcggtcaaagccgtcatgaccccraggatgtgccaggagtcagggcctctcctcctacgtgggcctgaaggggctgctgtaattcaggagggtaggcttgggatgaagggtctggaatttctgtctgccagcattagcctaatgcaaatcttttcctattcttttctattgagttaaaggtcctggtggcattgtcgggtggggcacattgctgttgtcatagggctgtttgccttgtgtttcgtggagccccattgctgagcttacaacgtcactctgctctcagctcccacggcctaaccatgaccatcctccctgcaggcattggttcctgtcaccattgaagtagaggtgccctttgaccttcaccgttacrttattgggcagaaaggaagtgggatccgcaagatgatggatgagtttgaggtagacccctttcccgggaggccatgtcacaggagtggcctgtyrcatcctctcccgagtgccagtgtcctttctcaacttcctgttgactctgcctcctcctgctcggactgggcactgacttcccttcacggcgggtggccttccctctcaccacttctgggtcccagggccaatggactctttcctgttctctggggtcctgaacgtcaagtcagccccctcttcacgtaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggtgagcaggaggtggccggggcactgcccagagccatggtgctcagctttgggcacatgtcagaatctagggaagttcttcaggatcccagcatcccagcgacatctggctggaggtgagatgcaggcagtgccaggacgcagtcagcatccaggggtcttgmtgtggaactagccaagagcatggcacctttctctttttcataaaaaagtgacaaagttggacttccgtgtaaatttgcagtttctctcaaaaccaaatcagagtggtacctcagacctacaagaaaggtcaaggttgcgagaggcccccaagcatgtgctatgcagtgaggacgagcatcggggacccccactaacctctagcacagggtggtcaaagggcgaatgacttcctggtaagcagggatgaaacccccccaacctctggcaaggctgacgtttgaaggattgtatgagcggagcgctgcagacgcccagcctctggcagggctgacatttggaggattgtgtgagcagagtgctgcagacaggagcaggggttctggaacttggagcagactgtgctggggtgctggtttgctaagggggttggctttccactcctcccgtgagcacgtygagtctggtgaatggggtggagctcgtgaacctyacatggtgtcagtgtacccctgcgtggactctgggttgtctcctgcagccaggtcatacctgtagcctttggccatgggtgttcaggggctgtggctgccccctcttcttggtctgcatctgccccagtcctaaaaagatccagagcatttctgtgcgtatccatcagatccctgtttgacaaatgaggagagcggggccccaagctcgtgactcactgcctagctctgtcagttcctgagcacgatcctygcaagtggtcccaagccctcttttgaaggatttatagacctccttgtggagcagccaagttccctggttctcattattagcagataatggaaggtggcagaggtcggaccagagagatggcggaccattccggaccacgggttacagaacactgcagcatctccagtgtcctatgaccagggtggaaggggaatggagtcacagggtggatcagctcaatctttgcctcattcttgctcctttcatttgtaggctttaaggagttttaagctgagtgtcactgtagaccccaaataccatcccaagattatcgggagaaagggggcagtaattacccaaatccggttggagcatgacgtgaacatccagtttcctgataaggaygatgggaaccaggtgagagcctcggttggagcgtgtcgggggcagaggtgcttgttgacctttcctgtgacttgggagcagtaaccagatgtgcctagatgggggttcgagggccaagttgagagtggcaagtctctcaggacctaattctggcttgaggtttgggctgtgtctcggtacttgccagatgggtgaggtctctggcactatgtatcatctggggcctggagcattttctcctgcgtctccttccagaaaatgagcaggagctccagctgggtccttgatcagtggcgcctccaggtgtagctcattcacctgtcacccgggcctctctgaggctcccaagggctctcattcacctgtcacctgggcctcttggggtcaggtggacatttctctgcagccccagctgcaaacaccgttgtgcttgccagatggtccttagtaaactcttgttgttacttcctccaaattgcagtgccacccccctgccactggccctcatggcctcctgcttcactcagaacaaaatgaaaggcagccccatcccctctctgggccctgccacctggcatgcagggcagcctcacccaacaccccctcttgcacacacttcccaggcttggtctttcctggctctggcatcctgctggggtgtctgcttcctaggcgtgtccagcacagctttgcccacagtgggagactagcaagccttggtggccacagttgtgctggtttccagaaacagcaraccccctggcagcagagcccctccacgcccctcgctcccactgtggatgtgccgcccagggttttccgctgcttccccttccccttccccttcttcctccccagcttcttgttcccttttggatctttgagtcacacacacaccagccaggccaggagggccctcctgcaccctgcctcctccagctcccacgtcctcttccctccccacatacattttttaatttttagtcttgatcttgagagtttagttcttttttttgagagagatagtctttgtcttgttgccccaggtggagtgcagtggcgcgatctcggctcactgtaacctctgcctcccgggttgaagtgattctcgtgcctcaacctcccaagtagctgggactacagctgtgagccaccgctcccagcccaagagtttagctcttttaagcccctcacccttattgccttttatttccctctactattctatataattatcaatcttaaaagtcattataggtgagtcaccagtggctcacgcctgtaatcccaacacttttggaggccgaggcgggtggatcccctgaggtcaggagttcaaggccaacctgaccaacatggcgaaagcctgtctctactaaaaatatgaaaattagccaggcgtggtcgcgtgcacctgtaatcccagctactcgggagactgagacgtgagaatcgcttgaacgcaggaggcggaggctgcagtgagctgagatcatgccattgcactccagcctgggcgacagagtgagactctgtctttaaaaaaaaaaaaaaaaagtcattgtttagcaattagactattccatctaatacaccatgagccaagtggggtggagcagtcatttcttcacaggcagctttttcctgtgagctgtgcttccgatcttgaggttctgtacctggcagcacgcgggtggtgcctgaggctgtcagctctgctgggccacggtgggtggggctgctgcctcccactctggcattttgcttcaatctggacagaagcttcttgggctgctgctctgttgtctctaggttaggtctttctgctcatttcctttccaggcatttgtccctgtcctctagtcctgttgcgtgatgatggttccgtgttgtgatttgtccctgtcctctagtcctgttgcgtgatggttgtgatttgtcccygtcctctagtcctgttgcatggtggtttttgtgttgtggacatgttgttttcgccgattgtgggctacaggtgttttgttaccacgtttccttctctatgccctgaactgtctgcttggtctgcttgtctgctatcccaagtctggtatggtgtctcctgtccatttgtgtggcccaaggaaggcctgagcaggtgggatctctgagtgagggaggggctcgctgaggaatgccagccagcctccagcctccagcacaaagatgcctccagactgtggcccacgtgggcaaagaagcaggaagctgaggggcttggggctttgtctttgccccgctgtccttgagtccagaattcttgcctgttagtgtctctcctttgtctttgaggacaaatgtcctttttcgttctgtaattcactgtcttttgggtagagtttgggaagagatggaagctgagtggacataggttttttgtggggtgttttttttttgtttttttttttttgagatggagttttgctctgttgcccaggctggagtgcagtggcgcaatctcggctcacagcaacctccgcctccygggttcaagcaattctcgtgcctcagccccgggagtagctgggattacaggcgtgcaccaccacgcccggctaatattgtatttttagtagaggcggggtttctccatgttggtcaggctggtcacgaattccggacctcaggtgatccgcctgcctcggcctcccaaagtgctgggattacaggcgtgagccaccgtgcccggccctgagtggacattgttaacctcttgttttaaatcagccgtgacgttgctttccatcttctctcctgagctgttttcctcagcagtgggggccggctcttgcccctgacgggaatcccagtaaggcatccccttttctgactacattctccttttttagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtgagccggctggaagcacagtgggtgagaatcctctctcaccgggggcacctggctggccagaagaaagagcagggcatggccttcccctcaagatgatgaggccacaaccccagggctggcagtggaactgtcctcatggacaccacgggtcagtgcaggcgacggcctgtgtgaggctgcactgccacggtggccattaggagggcatctccttgacagctgcctggcgagctcgtcctctgtgggtgggaatttcatgcaagagcgcacagtacgtgctgcggccctctgtctgctgggaacaaggtgctcctgagatacacctaacttggtgtggtgatgaggctgactgacttcagaacaactctgaaaccagattttaaaacgtttgctaactcagaaaatgcttcactagaaattgacacataattttaacccttttcctcgcttggagtcccctcatctgacgttgtacaccccttccaggtggacattcgcttcccacagagcggasccccagaccccaactgcgtcactgtgacggggctcccagagaatgtggaggaagccatcgaccacatcctcaatctggaggaggaatacgtgagtctctgtgggccttggagccctgaggcgccctggcacgtccaccggcctgaggcccagccaggagcttcaggggacaaggtggcacttgtgtttccagaggcaggcgaggtgcaggggtgagcaggcgggcgggatgctgggggtgctgggcagactgaccctgtcttcctgtcttctgcctgcagctagctgacgtggtggacagtgaggcgctgcaggtatacatgaaacccccagcacacgaagaggccaaggcaccttccagaggctttgtggtgcgggacgcaccctggaccgccagcagcagtgagaaggtcagatgcgggcttctgccctcctgggtcccagggagggtgggcgggcaggcgggcttggtgtcctgagggtggcaactgcgtcggaagctgcttgcgagttggggagcatcccctcctgaagccgtgtcctctctctgcacaggctcctgacatgagcagctctgaggaatttcccagctttggggctcaggtggctcccaagaccctcccttkgggccccaaacgataatgatcaaaaagaacagaaccctctccagcctgctgrcccraacccaacyacacaatggtttgtctcaatctgacccagyggctggaccctcygtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcartggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcayggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagygagttgtcctgtcccaggtacttgagttttggaaaagctgactcacgcccatccatctcacagcccttccctggggacagtcgcttccgccttgacacctcactctcagttgaataactcaagcttggtcatcttcagackcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctrgggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccscaatctccatcgcagcrggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgtcacgctgccgcctgtgtgttctctttctcgtcaccctggagtggtgactggcatctgtgggtagttcgtctttggtgtgattttctcagcagttctcaacactgtgttcaacrgcccctcgggagccacaytgagggagacccaggtgtggtcatggcaagagggtggctgcctgtccctgtcctctggctgccagacagtcagcagttgccctgcagccctcattgagggtggacaaccgtccttgtggagcagcacctgccactcccttttaggactctgccagcctcagtggcattcctggcaccctggacccggcctgtgagttatgacgagctgagttgggtggtggggggtgcgggcggaggcctcggctggaggaggaggagggaggggcgttgagtgggaggagccaccccagtcacctgagtggcaggagataacgggaagagtcaagagggaataggtgttcctgctgctgactgggctggtccccacctgggaagacgggtatggcagttcctcttaaagccaaacatgttggccgggtacggtggctcacgcctgtaatcccagcactttgggaagccgaggtgggcggatcacgaggtcaggagatcaagaccatcctggctaacacggtgaaaccccgtctctattaaaaatgcaaaaaattagctgggtgtggtggcgggcgcctgtagtcccagctactcgggaggctgaggcaggagaatggcgtgaacccgggaggcagagcttgcagtgagccgagatcgtaccactgcactccagcctgggtgacagagcgagactccatctcaaaaaaaaaaaaatgccgaacatgtttatccctgacccagcagttctgttgggccctaaatatgcaacccacagyaaagcacacaactgcaaaatgaccctaagccaaacacgaagcagcccagcagccaggaggggctgagatggatgctcggcayggatggagctcgcgcaatgtcccacggcagacgccaaatgcaaagtccccagttccatctctgcttggtggctaaggtggtggctactctggatgggaaagggtcacaggcagggtagggcgcatgtgggcatcagggccctggatgggagagggtcacagggtagggcgcacgtgggcatcggggagcttccacgtcgggtgatgtggaacttgccttttacccacgtgctggttacaacagtttgttcacctggaagcctgtatgaactgagcattttcgtacgtttcaataaattcaccttaaaactttggagtttaagacagcaacaataaaaagcaaccagctggaaggaagtacacgtgggtttgtagtaagcattgtgctgagcgaaagcacacgtggaatggctgagctccccatctgtgtaaagtttccaaggttcccgccccgggccgtgtgtgctgtccgccatgctccggccggtgstgtccagccccagggcgctgtgagcctgcatccctgccggaagagcccttccatggaggcagggcacagtgctcctaagaggcaggtgaacaagtagcaaatcctcaagaaatgctacaagcaagcacgcygccctcaggccaggcatcacggtgggtgaaatrgaacgcaggcgaggatgttcagaaagaggccttttctgtggagtaagtttggcagtactcatcaaagcacattaaaaccacatattctttttgtgtgtgtgtgttcccgagacggagtcttgctctgtcgcccaggctgtagtgcagtgttgagatctcagctcactacaacctccgcctcccgggttcaaacgattctcctgcctcagcctcccaaatagctgggattacagatgcccgccaccacacccagaataatttttgcatttttagtaaagacagggtttcaccatgttggacaggctagtcccgaactcctgaccttgtaatcctcctgcctcagcctcccaaagtcctgggattacaggtgtgagccaccacgctcagctaaaaaccacatattctttttgacacttaagttccacttgtagaactccaaggacatcaatacagatgagcacagatccattttttagcaagcagacggccamactgggattgctgcggggtagcaagttagccaggggaagcttcatgtggctccccagcacagggcagaactgcacgtcacattatgatccagcgtggaaaacaattatgtatgaacacaaacttctgggggaagagccaccagatgttacaggtatacacgtttcctcctctcatcccaaaacctcccccatttgggtgcttgctgggtactaggccccaaggaacagaggtaaaaacagcaagaggggccctgggccaggggccaggagctgggagagggagggaagttgggcaaggatcaaaaggacayatgtaattgctgcagaatgcaagtaaagcggcactgtcagaggctgcctgtastggctagggggaaagcagascctgattcaagaaacagaagaatccagaggacccagataactgggaatggagggaggggttcaacagacctttgctgtggcctgggacacagagctgcagggtccragagctggggcatgtgggtgatgtccctgcgcaaacagggcaggaaggggcgggtgggtccagaggacacgagggaraacrgccctgcgctctgaaacattcgaaggtcaccaggtgtaagaggagagggygatgtggccaggggcrgcgaggaccacaaagcccacctgcctgaggagaactgtcgtgtccaggggcctggggaggccaccgagggacagggtcccttgggtgcagggrccccttgggcttatgtctgggagcaggaaacaaagagggccttgtgagctgacggtccctccctgccggggatggagtgacaggcgctctgargagagaagccggcgctggggggaagcaggcaatgtgcccagagatgaggcacaacagcagccagcggttcacacagccgctgcctgagggaagaggaaaaggacgctgctcgcagggctcaggaggggccactcccctaaggaccaccagatgtccttccaggcgtcactgctgcagctggctggccttgggaacygtgaagggtgtccagtgggagctgagctggggagagggttgggggcagggacaagtcagactagggccaggagcaggccatggccacgaggcacagtgggcggctgggcagggccctgtgacctcagggagtgcacggggcaggggcctggctgctcccagacttgcctctgagccctygggctgctcatcctttgttccgttcgttccaaaaagaacctgtccccaaaaaagggcagcaagaggaagagggatgtgactcagtgtccggaggtagagcagccactgacaaggatagggagagggctgsggggagggccgagactgggctgtacagttcacctcattctcagccagtgcctgcttagccaggtagtactcccgcttcactttgatctccacagactctgggatgtcaggcaccaggaggtccaggaggcggccaacggagaaaaccacatgctgggagcagaggaaggcactcacgcccacccaaacgcccagagtggccttcacagggccaggcaggccggggctccggcacctgctcccagctgtgggtggagtcagaaagcagctgtgcaggaaaaggaaccccagaaggggcagaggccaccccagctttcgtggccctggggctcctgtggagacacccacaatgtccacaccacaacccagggatgaggccaggcagggaaaacgcaggtgcagagaagagctctgayttgaccaagatgacacagcaggaagtgacggcaccgacccctcaccacgtgctcgaattaggcaaagcacagggtcggggcstcatgccatggatgggagaaccagcaggtgcctcggctacctcaaacacaatgacgaaggccaggcggatggcaagaagattccagtaggtctgggaataatgtccatcgtcatcccggaaagcccgatacctgcagcagacacaggactcagtgcgcgcagccagggctgagtgttggctgggcaggtgcctctggaattagcctatctcccctttttccaccatttygctctctcatcccatgttcctggcctggctcttcatcgagggtgcctgaaatgggaattcttcccaaacaggatactctgacaatacctttaactggtgggttccaaaggtggatgtgctgggttgtcccccattgggctaaactggaccctccccaccccccaggtggcagatgctttattttctagtagatgtgacagtccagtacgtctgtgcttctacrgatgacwtcagtctacttacacggtgaaaatccgccgattgctgacctctgtgagatcagcagttcacctgctcagagactgtccctgyccagcagagccctccctccctatcataagctacattcagcttcacttgctatttcagactttgacatcttcctgtgtctctgtcccatggtaaagatgtgacattccattttctaatataaagttacatgttgcactccatgaaaactattaccagggtcaactttgtaggaaaataaaaaaaammaaaaaccaaatattgcaagttaaaaatatagccattggaaaaaaaatccctcaaatgaatggaataaacttttaagtggccagacacagcagaagagagactggggactgggagacagtgacgacgagaccaccctgcggcaacacagagagcacacttggggggaagcaggccacagcccagtgggagttccagacgacaatggacaagcagagaagcactgctggaaggagtaagatggagacatttccagaactaaacaaagacgtaactctttcagccgggcgcggtggctcatgcctgtaatcccagcactttatttatttatttatttatttatttatttatttatgagacagagtctcgctctgttgcccaggctggagtgcagtggcgtgatcttcgcttactgcaacctccgcctcctgggttcaagcgattctcctgcctcagccttcctgagtagctgggactacaggcccgtgccacaatgcccagctaattttttgtatttttagtcaagacggggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctcattctgttgcccaggctcccccccagtggcgccatctcggctcactgcaacctccgcctcccgagttgaaatgatcctcctgccccagcctccagagcagctgagattacaggcgtgaactgccacagccaggttttgtttgttgttcttgtttttctgagacggagccttgctctgttgcccaggctggagtgcagtggcacaatctcggctcactgaaagctctgcctcctggattcacgccattctcccgcctcagcctcccgagta

SEQ ID NO: 13331 - DNA, 98716 bp, Homo sapiens
aggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggmagattgttcttgcataaccagacccacaataaatatctacaacttttcttacatgtttataaaataaatcttagaagaaaaatattgtagcttttttttttttttttttttcaatgaagctctatgaacatttcacagaactttgttcctgggagtagttagggaaatgctgcttcaaaaagccaattttaagtagttgtgaggcatccgagtggaatttggctgcactatccataaaactwgagagtataggcggtatttcacctaccaaggtcagtaccctgcctcaggattcttactgttcatttgagcaattccggggccctctctggatgaccaggttcgtaaatagttgagactttgtgttatctcaaattgtcaccatcacctctgggccaatataggttagtgaggtcgagaggcccacaccattgacagaagagaattctcaggccgggcttggtggctcacgcctgtaatcccagcactttgggaggccgaggcgggtggatcacctgaggtcaggagttcaagagcagcctggccaacatgttggaaccccgtctctactagaaatacaaaaattagctgggcgtggtggtgggtacctgtagtcccagctacttgggaggctgagacaggagaattacttgaacccgggaggcagaggttgcagtgaggtgagatcgcgccactgcgctccagcctgggcgacagagcgagactccgtctcaaaaaaaaaagaaaggattctcaccttcctgtcccttcctaggagttttgtggtagtgttcgatcctgtgatgtggccatcttctcctcagggcctgtgagaggcaggcagcatctttagctgaggtagaatgcctgttggggaaagtcaaataggatggtggctggggccrgggctctggggactccttctgccccacatactcaattggaaagactgagcaagtcccctcacctccctgggcctcagcttccctgtctgtcaaatggagggctcaactggggtgagctccagtttccttctagtgctaacgcgtgttcaaggatccttgctctcctttccggggagcatcaggggtgtgggctagatagcaggaaagaagtaggggtttgtaaacaagagatccaagcccctggacccttrgtcccagcacccagtgcagccctcgccctcccagccccttccttagaaaggacaagaaaatccactccttgttctctccctgtcccatcacccccgcagtcccccacagatctgaggccggaggatgccaacatggtgagcaccctcttgctgtcttattcacgtaggcttttcttggtgcctgcacatggctcttgtaaggccaccaatcttgctggattatgacctcatctaaccttaattacttcctaaaagccatatgtccaagaagagccacattgggggttagggcttcaacatatgaatttggaggacatttacagttcagtccacagcacctggtcatgtggagatcccagtctgcatttgtgggatgaaatctctgcttttttaaagtttacacaccacctagctgggcacgtggctcacacctgtagtctcagcactttgggaggccgaggcggggatcacctgatgtcaggagttcgagaccagcctggccaacatggtgaaaccccgtctctactaaaaatacaaaaattagccgggtgtggtggcgggcacctgtagtcccagctactcgggaggctgaggcaggagaatcgcttgaacccaggaggcagaggttgcagtaagctgagattgtgccactgcactccagtctggatgaaagagcaagactccatctcaaaaacaaaaataaaaaaagtctacacaccaaaagagctgaaggcaggagagtttgtggtggttcagagtcctgattctggaggaaacaggcctgtttggagtcccagctctgctccttactagctatgtggcctctcagaggcagcatcyttatctgagaaatcgggttgaccttgtaggtggctgagaggctcagatgagggctcgcatgtgaggccttggcactgagcagggcactcctactgagtgttcaaaggtcgtgagtaccactgctctgcagccctgggctctggtctcagcaatgccgtcactctttctggcttcctaagagtcagaaggcaagtgggagaatagaaccatttcctgtgtctgaaggctgtgcctcagtgcttttgactcactctgaagacagcaggcagccctttctgttttttttggagatgaagtcttgctcttgtcgcccaggctggagtgcaatggcgcagtctcggctcactgcaccctccgcctcccaggttcaagcarttctcccaccatagcctcccgaagctgggrctacaggcacacgctgccacrcctggctaattttttgtgtttttagtaaagacagggtttcaccatgttgcccaggctggtctcaaactcctgaactcaggcgatccgcctacctcggcttcccaaagtgctgggattacaggtgtcagctaccacgcccgacccacaggcagccctttcacctcacgccgagcacgtctcctccatccatgaacattttgcaacttttttttaaagagacaggttcatactatgttgtctagattggactcaaactcctgggctcaagctttcccaagtagcttgaacctcttaagtaactgtgactacaagtgcacctggccactttttctgagacggagtctcgctctgtcacccaagtggagtgcagtggcatgatctccgcccactgcgagctccgcctcctgggttcacgccattctcctgcctcaccctcctgagtagctgggactacaggcacccgccaccacgcctggctaattttttttgtatttttagtagagaccgggtttcaccgtgttagccaggatggtctcgatctcctgactttgtgatccgcccgcctcggcctcccaaagtgctgggattacaggcgtgagccaccgcgcctggcccacctgcccattttttaaaaactttattcttcctggtatcaaggggagaaagaaaaaaattttttaaaatatttaaaactttattttgaaataatttcaaaatcacagcagtttgaagggtacaacaaagaacattttgccacattttctctttcattcgttccctcctcttctccctcacccctgtttcttcctatcctctctgaaccatgaaccatttgaggattatttgtatacatcatgctcgtttatccgtaagatgttttagtgaacatttcccaagaacagggrcagcctctcacatgcccatggtacagttctcaaattcaggaaatgtgtaatattctctgatcagcccaggagttgctaatttgtagttcctgtttcaaatttgccaactgtcccaataatgattttgaaagccgttgtttttctggtccaggatccaatccaggatcaagcgctgcctttagttgtcctctctgcagcctcctttcgtttggagcaggtcctcagcctttctgtctttcatgacattgatgtttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcastgacgcttggataaatacatactggatggatgcaggatgagtccgcattctagaagtgtgcagaggtacagaagtggccctgctccctgtccagcacccagtcrtcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccrcaggccccgatcctgcctgggacgaggttcaacagaagtaggatggtttcatcatgacctggcaggaaaaccaccagacctggaattttgcttttacaactgtttaacttctgtttcatacaggatgraaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcrtgttagagagccttggaatgtcctgcctttttacgtttaattaaaattaaataaaatatacaaaattcagttcatcagttgttctagtggcattttaagggtttagtaccatatgtggctcatgagtaccatcctggacagcgtcgacctagagcagttccatccccgcgcagagttctgtttgacggcgccactctgcacttccagcagcctggggagcaggggtgcaggagagttccttctgtgtcacagacttggtcacacagtacagatctcagatcagcacttaaacacgactgccagctgtcaacggcgtgttctgtggaatgctgggatgcatcacaggtatgctggaagatgtatagaattttacttctgttattctggtaactcagagtcctgttcagtcagtttccacgtcaggwtgctgtcctggttttaaagagaatgaacgcagccgaagttgaatcgaggcagtgatttcactcagtgcgttgggtctttccactcacctggccctccagaaccccagggccwtgagtgcatggrctggtacaagagcccagtttttggctggggaggcacttcctatgggagggggacgcctgtctcagtgctgaggcaaccaccacygaggaccctgggctggaagctgggctgagatgtctggtggtaggttctgaggcaggacaggggacygactcaaatggatgatacgaacggcaggctggattcacgttgctcctgcacctccagcatctgctgaggacacctagaactgtggccctrgccaaacctcagctccctattccatgaaagtgtgggtcaaagtgtgggtggtagagtggggctgacagtggcccctaagctcctagggtccagcccacaactgaggaagccacayggctggttgtgtacgagccggagtgtctctgtttggttgaaagtgccggtctgtgggtccttgctggtgtgtgtgcttctgtccccgcctcctggcctcctggctgaggggaagctgagtgggccacggcccatgtgtygcactcgcctcggctcccacacagccgcctctgctccagcaaggatgtggctcttccacactctgctctgcatagccagtaagtcctctcacccgctgcttcgaggggctsctgtgccctcagctccagccaggtgtctgcagactacagccttgactgtctgtctctgatggggctcagttagagccagaggttagagagtggcagctcctccaggaaaggagtcttgctcggtgggtcagrgccccaggcwtgttgggaagggcggctgaggcttcrtgttgccagttctgtcagccagggcctttggactccagggctctgccattctgttcctcctccagccagcctccccccgccaccgaggccctctccccatggcacccacttggggcaggtccttgactctgtagtttgttctctgagtgtggaggctccgcctggcagagctcccttctgttacagagcaggggttgggctgatgagggtgaggaccctgtgagagagtgttgaccagagactgggggcaagtgtctgtatggtagagggtgtgagtgttggcagggagcctgcttcctgtgttgtcaggcccagggtaaaaactggaatgtggggtggggggaggcacttctgctgcctggggggtcccattttagcctttaactgtcccatggaagcctctgggcaagccaagccatgartcctttcgggggccccctgtgatgagacagcacggtcaggtgagcccctggaggctgctaagattaagccggaggccagggtggtcctgcctagtgatctgagcagacttcccatgggtctcctgcccctgctcaggaggttggccggagaattggatgggcatcaagcttatgtggatgaaaggctcctggtagctgagttctccctgaaagatgggctgaggctgtgctgggaggggacttgggattagcatcccacctggggccagatcacccaggaagcaggccacaatgtgtagggtaccagcaaggaacacgtttttggacagattttaatattttatatttcattttattttattttattttttgagacagagtcttgctctgytgcccaggctggagcccaggctggatcttggctcaccataacttctgcctcccaggttcaagcagttctcctgcctcagcctcccgagtagctgggattacaggcgcctgccaccacgcctggctratttttgtatttttagtagagacagggtctcaccatattggtcaggctggtctcctgccctcaggtgatcgacctgcctcggcctcccaaagtgttgggactacaggcatgagccaccttgcccggcctaatattttatatttcaaaaacatcagaatagtcaccatggaaaggtcaacagtttgttgaacttccttttattttacaatttagacttctctgtttttagttacatgtggggtgtggagagagtctcactctttttatggcttgtggctttgatctcccattaccaagaatatctggagcagatgcttagactagactcttgtctaccctctcccagtacagaggaggtgactggggcacagagcgggcagtgactacccaggcttgcaagcaactgataatagacacgaggctcaagcccaggcctctgtcctgcctcccagctccagaatactcctgtggctcatctgtctcctttagcctctgagaccaccacccatcacctcagtgccttttccagcaggtggcatcgatcaaacctcttttgaggcctaggcccttcccaagctgatgggcagcagagagcgatgatggagcagacttgccatgagaccacttagcccacagctcagctcagccacgggaaggggaccagagcagggcccccgcagctccggtgtgggtggcggaaacgaggctgctgcagttctgctccatgctgtgaggtcctgagactaggatgggccagtccaggagagtttcctggaggaggtgaggtggcgttgagtcttgggggctgaggagagtctgagaaagaaaatgtccaggagatgctgggaggaagaactccctcagactgtggctccaggcccagcaccctgtaccctgtgccgggttgggcctccttaggctggagagaatccaggactggcctggcctggccstgaccttccactctctccaggccagccactctggtgatgcctacttcttatttgtggcagcagacggaataatagcagttgtctaagggagattttagaagcattgggtgcagacagacactgaaaccctggaactgtccacaccctgaccaccagccccatcatgccctcttaccctgtggcctgctgtccccaagtcagtcttcacccctgactcattctgcagtcacatcaactcacttctccatcctgggtctcagaggttgagtttccacccttgcgtgaagaagcctgtcctgtcagcctacaacaccttacaggggtgaagaagaaggaaccagaagtccagggcccgctctgctggtggcacgcactcgggctgaggccaggggctgtgccggggcatcaccccgggcctgtgcgtgatagaaaacctcagtccttggggagtgggagactgtagcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgccccaaatcgggacatgctgggccctggaggtgcgggcagaggcgaggccacccctatcccrgcccctgtgtgaagagaaggcaggttgtgcacacagtagcctccccggccccggcagggtgtcacagcacgggggtagggaaggggcactccaggcagaggggcagcccaagcaaaggtgaaatgcccccggaatgcagtgtgtgggggagagctggctgggggagtgtgggccgtgtgggagccccacatccctgcccttctctgggaggcctgcattcgtgtggcaggtgtggtataagtggaggaatgcgggcatccagtcccgagaggcccacggtggaggtggtgaggaacgtggggacctgagtgccggcctgggggagcttggagttcctgctgagggcagtggggagccacagaaggtcttgaccaggatggcgacagaattgtatgttgtgtgttagttggaatctgggggagaggggaggcagagaggcccgtgaggaggctgctgccttggccccatctgcggctgttgcggaaggcagacgtggggaggaggacacactcatgagaaacgtttagtttcctggccaggcacggtggctcacgcctgaaatcccagcactatgggaggccaaggcgggcagagcacttgtgatcaggagttcaagaccatcctggccaacacggtgaaaccccgtctctactaaaaatacaaaaatgagccaggcatggtggtgcgcacctgtaattccagctacttgggaggctgaggcaggagaattgcttgaacccaggaggcrgaggttgcagtgagctgagatcacaccactgcactccagcctggaagacagagagagacaccgtctcaaaaaaaaaaaaaaggccaggcgcagtggctcamgcctgtaatcccagcactttaggaggccaaggtgggcagatcatgaggtcaggagatcgagaccatcctggctaacacagtgaaactccgtctctactaaaaacacaaaaaattagctgggcatggtggcgggygcctgtagtcccagctactcgggaggctgaggcaggagaatggcgtgaacccgggaggcggagcttgcagtgagccgagattgcgccactgcactccagcctgggcgacagagcgagactccgtctcaaaaaaaaaaaaaaaawatawawatatatatatatatatttagtttccagcacacagtagtgctcaaggcctgttggcctttcttgttattagggagatgaagggtgagggagagagatgggctcagctgactgtgaggtttggggtggagttgatgaggctccgtgtagaagatcgaggtggggggactgcggctggctgcagatggctctgaggcacagtsctcccacgaggccccgctgggtgttctgggcggggtgtcgggacccctgcatctagccccacttcttcagctcctggtatcagtgtgggcaaakcatgccccatgggcctcggtttcctaaattgggaatcrtggtacttattgtactgtgagaatgtgagttgaaattgcccggwgtgctgggggagacagagggttgaggggagacagtggtggctgacaggatggagggggatctcggtctgactcagcaggcctccgtggctggggacagctcagagaggtggtcctgtgggtagtgtggtgacagacactggtgtagctatgtctgtaagtcagacaacacgggaggggggattgggagggagggccagccctcgcctgtggttataactctctccaacctcagcctccacgtgctgagcctcctgcgtcagacctggggccgcgtatcgccccatttgatctgcacagccccatgtcccagaggggagacggaagcgaggtgccaagcccagggtccttcagtgactccaaggcagtgaggatttgaactcaagaccatctaccaagacaatgctgttttctgagtcctggtgggaaatgcaacaggaggtggtttcctgatggaggcgcagctcaaaggcaaactgttgggcctggggcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagggatgcacacacacggatgcatacacagggatgcacaaacacggatgcacacacagatgcacacacggatgcacacgcacacacgcgcacatggatgcacacacggatgcacacacacagatgcacacacggatgcacacacgcacacacagggatgcacacacggatgcacacacacggatgcacacacacggatgcgcatacacagatgcacacacacggatgcacacgcacacggatgcacatggatgcacacacacggatgcacacatgcacacacagggatgcacacggatgcacacaagcacacacggatgcacacacatgcacacacacacgtacacagtctcatgccaccgtgcctctgcggcaggctcttgctgacctagttaccagccctgtaagcagagccctgctccagctcagtgagccgccgcacggcaggagcagtgcccagcttcttgaggccatttgtgaccctggcctctctctgtttaccaacccctcggtgcctccagctattactaaaggctttgaaatcgggcataaacacagaatctgagccccagacacaaatattcaatcttccgacgggccatgcacaaaccacacccctctctgagcctcagcacctagcgtggtgcctggaaggcaacaggtgctctgggggagcggaaccctcagttgaacaagatctctgttgaacaaagtgaacacaggggtggggtggcgtgaggaaagggaatatctggcccactctgacctttttagagcaccttttttgggtgggcctggccctgcgctgagctgggctctgtggctgggggtgttgtgtgtgactcagatcacatcacagttcagggcagacaaactgaatcacagatcaccctgatccagacagaatttggtcacagccagacagaccacaggatgctgagggggctcagggtttggtcagagccagacagaccacagggtgctgagggggctcagggacccgggagttactctgactgagtctggattggctcctggctcctggctggctgagcagggccacaaaagacgggctttgcagacagaggtggagagtgctgagcaggcctgctgggtggagggagccgctgtgtcgaggcctggaggcaggagtgtgcagagggtgcgccgggcagagcgggggggtgccacggacgcccaggagaggagactggactttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagagtgactgaccaggaggcacagggctcaacrtgacgtgggccccggggccggagcccagactccctrctgggcrtcctttatctcagttctggattcgtgggggagcagcgggaacagtacggccttcttccctgcctaggggtcttgatctggaacctttgagagtctatgtaggctgtaagtggccactctcccagcacctaccgagggtgggccaccatgccaggccctgagataatgtggcgatcgaggcagatgcagtgtgtgcccccttggactcactggtggcagggggcagtyactggcaatagggaaacaaggaaggccaagcacagtggctcactcctgtaatcccagcacttagggaggccaagactggaggatcacttgagcccaggaatttgagtccagcctggacaacatagcaagacccccatctctacaaaaaatttaaaaaaaaattagaggccaggcacggtggctcacgcctgtaattccagcactttaggaggccgaggcgggcggatcacaaggtcaggagttcaagaycagcctgaccaacatggcaaaaccccgtctctactaaaaatacaaaaattagtccggtgtggtggcaggtgcctgtaatcccagctacttgggaggcttaggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcactcaggggatcaggaagggctccaatgcttccatcagattctcaaagggggccaggtgcagtggctcacacctgtaatcccagcactttgggaggccaaggtggtggatcacgaggccaggagttcgagaccatcccggctaacacggtgaaaccacatctctactaaaaatacaaaaattagccaggagtgctggcatgtgcctgtagtcccagctactccagagacccagtattttgagtcctggcctacactcggtaggtgctgggagagtggccacttacagcctacatagactctcaaaggttccagatcaagacccctaggcagggaagaaggctgtactgttcctgctgctcccccacgaatccagagctgagataagggatgcccagtagggagtctgggctccggcccyagggcccacgtgagacaggagaatcacttgaactgaggaggtgggggttgcggtgagccaagatcacaccattgcagtccagcctgggtgacagagtgagactccaactcaaaatgaagaaaaaaaggccgggcatgatggctcacacctgtaatcccagcactttggaggctgaggcaggtggatcaggacgtcaggagatggagaccagcctggccaatatggcgaaaccccatctctactaaaaatacaaaaaattagctgggcatggtgatgggcacctgttttcccagctactcaggaggctgaggcaggagaatcgcttgaacccgggaggcggaggttgcagtgagacgaaagttgtgccactgcattccagcctgggcgacagagtgagactctgtctaaaaaaaaaagaaaaaagaaaaagattctcaaagggatccattacccccaaacaagaacgtctggtctggttatgtttcctgtgttttctactttggggcattggcagggaggacacaaatcacaggtctgcaaaagctggggtgcagggtttcttcattgtgttctcacaaaggacccttagggacagttttttctctgatttgaataaccagactggttgtgctttgcctggaagtgttttgttttttgaattttgtggacaccgcatggcattaactgatctttttcatgttgatatcaccttcaagaaagcttcattcattcatgtatgcgttgaatcaacaaatgattttattaagccaaaggattttaggaacacttctgtgagccagcgctgtgttcagagccaacagtggggcacgtgatagaaagtgctggcactgcgtgatctacatgttagctgttggcctccttcctggcttgttgtatccccctctttttttaaaccatcattttccttctgttcttttttgcctgccccattattttaagcgagttttatcttacctgtattatgtatttttatgaatcaccacaaatcattccaggcgaggcagagatgtgaagaaaaaggaataaaatatagatatcaggccgggcgcggtggctcacgcgtgtaatcccagcactttgggaggccaaggcgggcggatcacctgaggagttcaataccagcctgggcaatayggtgaaaccccacctctactaaaaatacaaaaattatccaggtgtggtggtgcgtgcctataatcccagctactcaggaggccgaggcaggagaatcgcttgaacccgggaggcagaggctgcagtgagccgagatcgcgccactgccctccagcctgggcaacagggccagactccatctcaaaaaataaatacataaataaaataaaattaaatatagatatctactttgtgccagactcagggaaatggccttaaatgcagggatgagagatccagagcctggcctcagagccatctccccaggttcctcctcctcctcaagtctggaaggttgatttttggataataaaattttaagcatgtacacaggtaaacgagataactataacaaagccaatatgtccatcaagcggatgacacaatgatcaagatcctgccacacaagctgaatgtattttgtgttccccttttcatttttgttgtcaaggtatttaaagcctggctgctcaaaatgtgacctgaggaccagcagtgagagcatcgtctgggagcttgttggaacagactcccagccccattctgattcattatctgctgagtcagaatctgcattttaacaagatctccgatgactcatttgcacgctaatgtttcagaaacagtattttaaaccccaaacatcgtgtcatttcactcccaaaaaacatggacattttcatttctaaagaacatgaagggccgggcgtggtggctcacacctgtaatcccagcactttgggaggcygaggctggtggatcacctgaggtcaggagtttgaaatcagcctggccaacatggcgaaaccccatctctactaaaagtacaaaaattagccaggcatgttggcacacccctgtaatcccagctactcaggaggctgaggcaggagaatcacttgaatccgggagacagaggttgtagtgagctgagatcgcaccactgcactccagcctgggcaacagagtamgactcagtctcaataataaagaacgtggacattttcttaaatagccacaatrttcttaccacctaactaaattaattctttggtatcatctaataccaaatacttagtccatatacaaatctctctgtctcaaaatgtctttttttttttttttttgagacagagtctcgctctgtcgcccaggctggagtgcagtggcgcgatctctgctcactgcaagctctgcctcctgggttcacgccattctcctgcctcagcctcccaagtagctgggactagaggcgcccaccaccacgcctggctaatttttttgtagttttagtagagaaggggtttcaccgtgttagccaggacggtctcgatctcctgacctcgtgatctgcctgcctyggcctcccaaagtgctgggattacaggcgtgagccaccatgcccggcctccaaatgtctttttaacagttggtttgttcaaagcaagatccaaacaaggtccgcacatgacatgcggttgctgtggctctccgtctggagtgcacccccatccccattttctgctttcatgcctttgatttatggcagagtttggtcacgtgtgttgcagaatatctatgttcaggatttgtgtgtttgcttcctcttggtgtgatttgtctttttattccccaaactgcctgaaaactggaagtttaacgtcaggtttcagttctgtggcgagcacactctaagcagttgtgaggattttgccccacttcctgcagttatttcacctctttttcttttktktgtgtgtgtgtgtgtgtttgtttgagacggagtcttgctctatcaccaggctggagtgcagtggtgcgatctcggctcactgcaacctccgcctcccaggttcaagcgagtctcctgcctcagcctcccaagcagctaggactacaggcatgcgccacyacgcccagctaatttttgtatttttagtagagatagggtttcactgtgttggctgggctggtcttgaactcctgacctcaggtgatccacccatgtcggcctcccaaaatgctgggattacaggcctgagccactgtgcctggcccttctttttcttttctttgctgaagtgttttaaagccttggtactcagaatgtggtctgaagacctgcagtgtgggtgtcccttagaatcttgttggaaatgtagtcttgggcccttasatccttcctagagtgtcacaccaagaaggacatgcctgagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttatccataaaaaagacgtttttcatgccatttttataagggccagatgaacaaatgaaaaataaatttaaggctgggtgaggtggctcacgcctgaaatcccagcatttgagaggccaagtgggggcagattacttgagatcaggagttcaagaccagcctggccaacagagtgaaactccatctctacmaaaaatacaaaattgatctgggtgtggtggcacatgcctgcaatcccagctacaggggaggttgaggcaggagaatcgcttgaacctgggaggcagaggttgcagtgagccgagattgcaccactgcactccagcctgggtgacagagcgagactccatctcaaaaaacaaaaaacaaaaaaaaagaaggaaagagagagagggaagggagggagggagggaggggggaggaaggaaggaaggaaggaaaacttaaaagacaagaagtactttttctcattaaccaggatgatttgatggccctgaaatgcacttcatgtaggaaaggcaagaaaaatgcttaatacttttcctaacagtcagttttcagagtaaagagatggtgccctttttacttccattggtagcaaattttctttttcgtttcttttttttggagacagtcttgctttgtcactcaggctggagtgctgtggtgtgatcaaggctcactgcagcctcaacttcctgggctcaagtgattctcccacctcagcctcccaagtagctaggaccacaggcaggctcccactgtgtgcagctaattttttaatttttttgtagaaacggagtctcactgtattgcccaggttggtcttgagctcccgagtgtaagtgatcctcccacctcagcctcccaaagtgctgggattacaggcgtgagtcaccttgatttcttttgtttttatttttctctctcttgtaaatatcatgaacttatgaaagttttatatattcagtgtgtttcacatacttgtaattcttattctaaaaaatattttaattataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattatttttaatgtagactttttaaaagtacaacatacagaaaaatggacaaatttagatcagtaaatgttcatattaagtcacacccgtatcaagaaacagaacaggctgggcacagtggctcacacctgtaatctcagcactttgggagcccaaggtgggaggatcacctgaacctaggagttcaagaccagcttgaacaacacagtgaaacctcgcctctaccaaaaaaaaaaaaaaaaaaaaaaaaattagtcaggtctggtggcacaggcctatagtcccagctactcgaaaggctgaggcaggaaaaccacttgagcccaggaagttgaggctgcagtgaactgtgatcacaccactgcactccaggctgggcaaaagagtgacagccagtctcaaaaagcaaaaaagaaagaaaacatactgtgtacaaccttgggggctaaaaaaattttttttgaacttcattaaacttaagaacatctgtttatcaaaaaaaaaaaaaagtaagtgagtgaaaaggcaaaccacagaataagaaaataattgcaacacaaattgataaaagattaacttcagaatatgtaaagaatttctacaaatcaataagaaaaaggcatgtccacaaacagaaaaaggacatttcacaaaagagattatcaaaatagtcaggaatcttgtaaggagacttcagacgtcagagaaaggcaaattaaaaccaggtgtggtggctcacacctgtaatcccagcactttgggaggccaagacgggtggatcacctgaggtcaggagttcgagagcagcctggccaacatggcgaaaagcccatctctactaaaaatacaaaaattacccgggcgtggtggcgggcatctgtaattccaggtactcaggaggctgaggcaggagaatcacttgaactcgagaggtggagattgcagtgagctgagattgtgccatggcactccagcctgggcgacggagcaaaactccctctcaaaaaaaaaaaaaaagagaaaaccatttgtcagtatccactaaagctgaacatatgcttaacaggatccagaagttccacggttagacatatgcccaacaggaatgtgttcatatggtcatgaagacgtctgcaagacactcatagcaggccagacacagtggctcacacctggaaacccagggctttggtatgccagggcgggaggattgcttaaggccggtgtatgaaatcagcctgggcaacatagctagaccccaccgctttaattcttcatcagattaaagaaattcacagccgggcatggtggctcatgcctgtaatcccagcactttgggaggctgaggtgggcggatcacctgaggtcaggagttcaagaccagcctggccaacatggggaaaccctgtctctaataaaaatacaaaacttagscgggtgtggtggcacatgcctgtaatcccagctacttgggaggctgaggcaggagaatcgcttgaaccagggaggcggaggttgtagtgagccgagatcacaccactgcactccagcctgggcgacagagtgagactccatctcaaaaaaaaaaggaaaaaaaaaattccctctgattcctggtttgctaggactttttatcagaaattagtcttggattttatcagatgccattttctgcatctatcataatcatatgatttttaatcctttatttcctgttgtaaggagtaaactgattattttaaatgtcaaaccactcttccatttccgaaatgaactctgcttgttttgatgtatcatgctttttttttttttttttttttgagaggagtctcgctctgtcaccaggctggagtgcagtggcgcaatcttggctgactgcaacctccgcctcccgggttcaagtgatcctcctgcctcagcctcccgagtagctgggactacaggtgtgcgccaccacgcccagctaatttttgcatttttagtagagatggagtttcaccatgttggccaggatagtctcaatctcttgacctcgtgatccgctggccttggcctcccaaagtgctgggattacaggcatgagccactgcacccggccgtattatgctttttataattccctggatttgatttactggaattttgtgcagcatttttgtatttatgttcgagagaracggttgtttcaattttcctttcatttattgtgcttgctggattttaatatcaatgttatactggcttcataaaatgactgaaaaatgttttctcattttctattctctaaaacagtttatataaacttggcattatttctctttaaatgtttggaaaaattcgtcagtgaagctatctgggcgtagagatctccctaagatttttagtcatgagtaaaatatcttactcaggtgatacatttctttttttgttagttttggtgcatttctatttcaaggaatttgttcatttcacccagattgtcaagtttactggcataaggttggatataacatcctcttacttttttttttttttttttttgagatggagtctctctctgtcacccaggctggagtgcagtggcgcgatctcggctcactgcaagctccgcctcccgggttcacgccattctcctgcctcagcctcccgagtagctgggactacaggcgcccgccaccacgccyrgmtaattttttgtattttcagtagagacggggtttcaccgtgttagccaggacggtctcgatctcctggcctcgtgatccgcccgcctcggcctcccaaagttctgggattacaggagtcagccacctcgcctggcccctytattttttaaatgtcttaggatctattatgatgtcccccctttytattttttattcatgttggtaatttgtgtgttctctttttttttttcttgttcagtattgctagtgatttatcattttaaaaatctttaaaaaaaacttcagcatcattagttttctctactgtaagttggtttgctgtttcattgatrcrtgttcatatctttattccttcccgtacttcctttaggtctgatttgctattccactgtaattttatctttcaccctgggttatttagaaatgcattgcttaattttcacgaggttcagatttttctagttttccttccktccttccttccttccttccttccttccttccttccttccttccttccttccttcctccttccttccttccttcctttctttcttctttcccaagtctcactctgtgcctaggctggagtgcaatggcacgatctcggctcactgcaacctccacctccctggttcaagtgattctcctgtctcagcctcccaagtggttgggattacaggtggctgtcagcaygcctgcctgatttttgtgtttttagtagagatggggcttcaccatgttggccagggtggttttgaactcctgacctcaagtgatccgcctgcctcggcctcccaaagtgctggggttgcaggcatgagccaccatgtccggccatcttttcttccctttctttcttttttcttttttttacatggggtcttgttctgtcacccaggctggagtgcagtgatacaatcttggctcactgcaacctccacctcctgggctcaagcagtcctcccacctcagcctcctgagtagctgggaccataggtgcatgccaccattcctggctaattttttgtatttttggtagagatggagtttggtatttttgttagataccagccatgttgcccaggctggtcttgaactcctgagcttaagcaatctgcctgcctcagtcttccacagggctaggatgacaggcacgagccactgtgctggacctctagttttctttttgttattggtttagattctagtatagtcagagaacatattctgagttatttcaattcattgatatttattgaggctttagctttgtgatctagcatatggtcaattttggtaaatgtttcacgtgtacttgaaaataatgtttctgagggtgcggtggctcacgcctgtaatcccagcactttaggaggctgaggtgggtggatcacgaggtcaagagattgagaccatcctggccaacatggtgaaaccccgtctctactaaaaatacaaaaattaggcgggcatggtggcgcgtgcctgtagttccagctactcgggaggctgaggcagaagaatcgcttgaacctgggaagcggaggttgcagtcagccaagattgcaccactgcactccagcctggtgacagagccagactccgtctcaaaaaaaaaagaaaaatgtttctttttccattgttgggtacagagttttgtctgtcaggtcaactttgctaattatgttgttcatatcttctatatccttgctcaatttttggtctgcttttatttttatttttttattttattttttttttttgagatggagtcttgctctgttgcccaggcgggagtgcagtggcgcaatctcggctcactgcaagctccgcctcccgggttcacgccattctcctgcctcaacctcccgagtagctgggactacaggcgcccgccaccacgcccggctaattttttgtatttttagtagagacggggtttcaccgtgttagccaggatggtcttgatctcctgacctcgtgatccgcccgcctcggcctcccaaagtgctgggattacaggcgtgagccgccgcgccccgctggtctgcttttatagttgacgtaaaaggcttaattaaagtgttaaagtctcccactttcattgtagtgttttgtatttttccttttaattcagtcaatttttgcttttatattttgaaatgatgttattggataaatacagatttaaaattgtcacrtcttcytagtgaatcaaaaacaacatatttgtgtgcatatatctccttcccttccttatacagaagctagtgtcgtttatacacttgtccttcatgtagtgattttaatttcttcctgaaatctactgctgagtaaacagccattaattggaaaaaatatttgcatcaatttcattaaaaaaattgtgatgcattccagccaaccaaagatactcaaatgacttttactgttaggaaaatgtattaattgaccaataaaacaagtttagataaataaaaacaatactttgaatataaaaatacagtttccgtataaaatgtattgtcatgaaggtttattggcctcattaaaaggagaagacaagatttgacagtgggggctaggcgcgrtggctcacgcctgtaatcccagcactttgggaggctgaggcgggcggatctcttgaggtcaggacgagtatgagaccagcctggccaacatggtgaaacctcgtctctactaataatacaaaacttagctgggcrtggtggcgggygcctgtaatcccagctactccggagactgaggcaggagaattgcttgaacccaagagccagaggttgmggtgagccaagatcgcgccaccgcactccagcttgggcgacagagtgagactccatctcaaaaaaataaaaataaaaaataaagtcatagcaaaagttacagagaaacaccttgagggcaaaataaatactgaacccaaaagcacttccaaacacatggaaataggctgtgcgctcatcgacttcagaatcatagaatcttcagccatctcaatcgacatacatcagcaaaagcaggcatatgggatttatccaaacatgacatgcaacgcagatttgttccatatgatattgttggactagaaactgttacatagtaagtaaatgggtgagtgtgtcttcccgtgagagtgcgatgtcaaatgtcattccttatatcgtgtttactcagtgtatttagagaygaaaaagtcactaaaccaaaaaaaggagtgttgccaagaagttgtatagcttttcaagagtgtttatggcaaaagtcgttaattgaacagtaattgaacaggtaartctgtaaactggamttcaccttgcttttttcccatgyaaatgtagattagagatgggagcagtggctcacacctgtaatcccagcacgttgaacggctgaatcacctgagrtcaggagttygagaccagcctggccaacacggtgaaaacctatctctactaaaaatacaaaaattagctgggggtggtggtgtgtacctgtaatcccggctacttgggaggctgaggcaggagaatcgcttgatcctgggaggcgaaggtgtcagtgagctgagattgcaccattgtactctagctcgggcgacaagagcgaaactccatctcaaaaaaaaaaaagtacacacacacacacacagagatttaagcaatggagtggcatggtcagaccatgctttgttttttttttttttttttttttttgaggccgagtctcactctctcacccgggctggagtgcaatggcgcgatgtcagttcaccgcaacctgtgcctcccaggttcaagcgattctcccttgtcagcctcccgagtagctgggattataggcacccgccaccatgcccggctaatttttgtatttttagtagagacagkgtttcaccacattggtcaggctggtctcaaactcctgacctcaggtgatccaccgcctcagcctcccaaaatgttgggattataggcatgagccaccgcacccggcccagaccatgcttttaaaaaatctttctagcatctgatgtggagaggatgtatccagaagtacaagtcttgaaagaggccaggagactaacgtgtccaagcaaaagacgatgaggtcagtggggcagagctgagtcctgacagaggcccaaatgtgcatgtgaattctgaggatgataaaggtagcatttccaaactatgggttaagaggagctactcaacaaataatgatgagacatttcaactgtgggaaaaaagtaaagttgtatccctatttcactccaaatgtaaaaataaaatccagatggacaaaaggttcgaacataagaaattaaagaagagaccggrccttggctcacgcctgtaatcccagcactttgggaggctgaggcgggcggatcacctgaggtcaggagttcaagaccatcctggccaacgtggtgaaaccccgtctctactaaaatacaatattagccgggcatgatggcgggtgcctgtaatcccagctatttgggaggcttaagaggctcagatgggagaatcccttgaacccggsagatggtggttgcagtgagccgagatagcgccactgcactccagcctgggcggctcagcgagactttatctcaaaaaaaaaagaaagaaagaaaaaagaaatgaaagaagaaaaaaaatatagaaggaaacatgagtggatgaaaagaaatagcctgagtggaggagcatgacccgaagctgaagtcataaaggaaaaacaatatgacaacatcaaaaaacgtagttgtgggggaaaacagcatatgcaagacaaacagctgcgtgagaagcggcatctataacacattgcctgtttctcttggatagagaaaagctcttacaaataaataagaaagtaatatcgtttcatgaaaatgaataatgtacatgagtaggcagtaaacaaacttacaaaaagagacttgacctcactcataatttaaaaatagttttggggctgagcttgttggctgacgcctataatcccagcacttggggaggctgagatggcaggattacttgagcccaggagttggagaccagcctgggcaacatagtgagacaccatctytacaaaaaattttttaaaaattagccaggcctgctggtgcgcatctgtggtcccagctacttgagaggctgaggcgggaggatggattgagccctggaggtaaagactgtagggaaccatgatcatgccactgcactccagccagggcaacagagtgagatcttgtctcaataaaataaaaagtaaaaaatatttgggaggctgaggcgggcggatcatctgaagtcgggagttcgagaccagcttaaccaaaatggagaaactccgtctctactgaaaatacaaaaattggccgggtgcagtggctcacgcctgtaatcccagcactttgggaggccgaggtgggcggatcagctgaggtcaggagttcgaaactagcctgaccaacatggagaaaccccatctctactaaaaatacaaaattaggccaggcgcggtggctcacgcctgtaatcccagcactttgggaggccgaggtgggcggatcacgaggtcaggagatcgagaccaacctggcttaacacggtgaaaccccctctctactaaaaatacaaaaaattagccgggcaggcgcctgtagtcacagctactcaggaggctgaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctactcgggaggctgaggcaggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcccatgctgtcgttggagtatgaattggcaaaacctctttgggaggtaatctatcgatatctatttttccccaaaaaattttaaatgaaaaatttcaaatatatagaaaagttgaaaaattatatggtggacaaccacatcactacacttaaatttgacaattgtcaacacttttgagtgtttcttttatcacgtatatctatctacccatccagcaagccatcttatattttgatgcattttaaagtaaattgcacgctggatgtggtggctcacacctgtaatcccagcactttgggaggccaaggcaggtggatcacttgaggtcaggagttcgaaaccagctcggtcaacattgtgaaaccctgtctctactaaaaatacaaaaaattagccgggcatggtggcaggcgcctgtaatcccagctatgtgggaggctgagacaggagaatcgcttgaacccgggacacagaagttgtagtgagccaagattgcaccactgcactccagcctgggcgacagagcaagaccccatctcaaaaaaaaaaaagaaattaataaaaataaattgctgacttaagtataattcaactctaaacatttcagcatacatatcaacaaaatgtgtttgtgcttcttctttaaggtaatatttacatacagtgacatgcacaaattctaagtggaccattcattgcgtgtgttctgacacatgcacaccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctgtgctctgtttgaattccctttccctacatcagggtcataaaattcctccagaaagaaagctgagggtaacgacagggctcgtgttatttgtccatgttttctagagatcactgtcctgctctgcccattgtcaaatgtctgaaaacattttataggttttgtccagtattctagttgtttatggtgaaagaattagtccagtaccaatgatttcttcatggaaaggccaaataagggacactttgagaaccaatatagtgataacagattataaccattgaataaaatagaattcatgagcctattctgctgtaaataaaaaaaatcacacataaatgagaagaaagaaggaagacctaaggcttctgtcactcagcataatgatatttgttgttgttgttttgagacggagtcttgctctgttgctcaggctggagtgcagcggtgcaatctcggctcactgcaacctctgcctcccaggtttaagcaattctcctgcctcagccttctgagtagctgggattacaggaacgtgccaccgcgcccagctaatttttgcgtttttcgtagagacagggtttcatcatgttggccaggctggtctcgaactcctgacctcaagtgatccagccgcctcggcctcccaaagtgctgggattacaggcatgagccactggcgcgcggccagcataatgatttttgggattcatcacgctgctgtatctgttgttgactcctctttactcctgagtaggattctactgtaggaatataccacagtgggcttttccagtctcctgttgatggacatttgggttgtttgcagtttggggctcttccgaataaagctggtataaaacattcttgtgcaggcagttttggggatacgttttctcgtgggtcgcttgaagggggtacatagaacatacacaggccctcttcctggggctcacagtctactgtaacttcagtacaagacgcagtgacgtgagtacacgctgtgtgtcaggtgcagaaatgacagtaagaggcgtgaggaggtgggaagtgcttctttggggagagctaggggcggcttcttggaggaggggggctcgggtactggtacagcttggtttagtaggaggatcagaggctstgggtcagatacacctgcgtctagtctttctctctcacacacacataaagatccctgggcagtctcacttttctcagctgtaaaacggggttcatgacaccacaggatttgctggaataacgggagtaaaaggcctctttcattaaacgctcctcttttccctacaggcctggccctgctggccgctttcaatgtggatgtggcccggccctggctcacgcccaagggaggtgcccctttcgtgctcagctcccttctgcaccaagaccccagcaccaaccagacctggtgagtagggccggtgggcaagaggccttcagactgaggggcttccaggcaatctgagatgggccccagagacggccatggcagcccaccccaccccaccgtcaggagaggaactcctttctctttcagaagggcatgcaggagaaagagagaaggtgtgagagaggctgtgggcatcgggctggtctgtggggtccacggaaccccagcctcacgcctcactgggcctctccctgctccattgcccagggggagggtggacttaaagacaattttagtggcygggcacggtggctcacgcctgtaatcccagcactttgggaggccgaggcgggcggatcacgaggtcaggagattgagaccatcctggctaacacggtgaaaccctgtctctactaaaaaatagaaaaaattagccaggcgaggaggcgggcgcctgtagtcccagctactcaggaggctgaggcaggagaatggcgtgaacccgggaggcggagcttgcagtgaaccgagatggcgccactgcactccagcctgggcgacagagcgagactccrtctcaaaaaaaaaaaaaaaagacaattttaaaataaagcatattaaggctcttttgttccttatggaagtaacacatgttcaatatagaacatttggaaacaaaaaataacaaagaaaaaactgggcctggcaccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggcccggaggccgaggctgtagggagccgtgattgcaccactgcactccggcctgtctccagaacaaaaaccctgaaactatgaggaacaagcgtgtactggtaagaggcaggctgtggctctggcagccagggttcagtggcagcttcaccgtggatttgccgcatagcctgagcaaggtgctcgggcctgagcttcagtttcccttctctgcagtcagcgtggggawctacctacttcacaggattgtcgcaaagactatttgagataatgcaygtaaagggcttagcacaggttctgccgggcgcggtggctcacgcctgtaatcccagcactttgggaggccgaggcgggcggatcatttgaggtcaggagttggagaccagcctggccaacatggtgaaaccccgtctctactaaaaatacaaaaattatctgggcgtggtggtacacgcgcgtagtcccagctactcgggaggctgaggcaggagaattgcttgaacctgggaggtggaggttgcagtgagccaagatcgtgccattgcactacagcctgggcgacagagcaagactccgtctcaaaaaaaaaaaaaaaaaaaaagggcttagcacaatttctggccacattaatgctcaataaacattactttacattttttaaatatcatctatacccacctattagataagcaaaatgtaaaatctgccaacattgctggtaaggttgcggtgaaacagggacgtgtgggagtgtgaattgcgatcaccaccttggagagcaattttgccgtatctggtaaagctgaggatgcacgtggcctctgacacttccactccccgatcccagctctagagaaattctcagacacatataaaaatgtttgtgtgccgggcgcagtggctcacacctgtaatcccagcactttgggaggccgaggccggtggatcacctgaggtcaggaattcgagacctaggctggccaacctggcgaaaccccgtctccactaaagatacaaaaaaaaaaaaaattagctgggtgtggtggcgggcgcctgtaatcccaggttcttgggaggctgaggcaggagaattgcttgaacccaggaggtggaggctgcagtgagccgagatcgtgccattgcactccagcctgggtgacggagcgagactctgtctcagaaaaagaaaagcaagcaaaaaatgtttgtggtagcattgtttggaatcatgaaagactggcaatattcctcttaggaaaatgggaaaaatactgatatgactcatgcaatgcaatactaaaagcagatcccctgaatgaagccagtgcaatggttgtttacctggatccatctggaaacataccgtgagttgaaaaaggcaagttgtagaatttaatatacaaaggttggcaggtgcagtggctcacctgtaatcctagcactttgggaggtcaaggcgggtggatcacatgagcccaggagttcgagaccagcctgggtaacacrgtgagaccctgtctacaaaaaatataaaaaaatcagccggatatggtggtttaagcctgtagtccgtcccagctattgggaggctgaagtgagagacctgcctgagcccgggggcgggtgrgtcgaggctgcagtgagccgcgattgtgccactgcacttcagcctgggtgacagaacgagaccctgtctcaaaaaaaaaagaagcaagtaagtaaaatatgcattccctcagatggcgatggtggccgcgtgctgatgtaggagtgtgtctgcagttaggagaagctctggtggaaagggtcatgagatccgaggctcatttgaatttcccatgtgtcaccaaaatgacttttatttatttctttacctattatttatttattggagacagagtcttgctctgtcacccaggctggagtgcagtggtgtaatctcagctcactgcaacctccgcctccygggttcaagtgattctcctgcctcagcctcctgagtagctgggattacaggcgcccgccaccacgcccagctaattttttgtatttttagtagaaacagggtttcgccacgttggccaggatggtcttgaactcctgacctcaaatgayctgcccacttcggcctcccaaagtgctgggattacaggcatgagccaccgcacctggccccaaaatgacttctagtgctgtgttgttttaaagccagatctggtcaaggtttatgtattacgtattgctgttatgtctctgtcattgatttcaatccaaagcagtgatttctcccccatttttttctgggtggtcatagggcttttcttgtgcatactctcccactgagcgggcccagcctaggatggttacctcctcatcccaccccagcccaccagattgctttgctcctggtcagtggtcaagggtttccttcacacccagcacacaggagcaagtgagcccagggttcaaacaggcactggggcagagccaggtgaggagccagggttcctggstgggcagggcgggagctttgcttgaataggatgggtgggcagtggtggctcccgaagcagcctcataggccctgggacttgggccttgaccctgacagccaggcagacttggatcctgtgatactgtgaaatgtatatttgacattccaagactgaatatatattttacaatataacaaataaaaatatatttggtctcaaaataaacatttggtcccattatctggcatacaygcctaaaatctctggaatctccaaagtaataaatgtctttttctttgttaatgagttgacgggggaccggcagcccccagatagcttcaaaatgggggctggtcactggagagaaccaggcacgatcagagggttgggactttcagccccacacccctcttctgggagagaagggctgaaggtttagttgatcaccagcggccartgattcaatsagtcatgcctatgtaatgaggcctccataaaactcaaaaggacagggtttggggagcttctgggtagcagaacatgtggaagtttctggagggtggccccygagagggcatggaagctttgcccctcacccccactttgcccctcacccccactttgccttatgcatctcctcatctgtatcctttgtaatatcttttttttttctttttgaggcagagtcttgctctgccacccaggctggagtgtggtggcatgctctcggctcactgcaaccactgggttcaagcgattctcctgcctcagcctccctagtagctgagattacaggcgccygccaccacgcccatctgagttttgtatttttagtagagacggggtttcaccaatgttggccargctggtctcgaactcctgacctcgtgatccgcccgcctcggcctctcaaagtgctgggattacaggcgtgagccaaggcacctggcctgtaatatcctttataataaaccagtaaatgtcggtaagtgcttctctgagttctctgagccactctagcaaattaagcccaaggaaagggtcccagaaaccctgatatgkttgtttggtcgaaagcacaggtgaaataaccggcggctggtgatgggcctcggaagttaggagcagtcttgtgggactgagacctcgacctgtgagggctgatgctacctccaggtggagcatgtcggaattgagttgaacgtgaggaccttcagctggagctggttgccgaaggactgcttgccccgtgtggagggaaaaccccacccacctggggtcactggactgttctgtgttgtgagagctgcaggggagacagagctcgacgtttcctacatcattagagagtcctttctggatcctggtttcatcggtgcagtcaaaagtctggtcactgccaggcgcggtggctcacgcctgtaatcccagcactttgggaggctgaggcgggcagatcatttgaggtcaggagtttgagatcagcctggccaatatgctgaagccttgtccctactaaaaatacaaaaattatctgggcgtggtggcgcgcacctgtagtcccagctgcttgggaggctgaggcaggagaatggcatgaacgcgggaggcggagcttgcagtgagccgagatcgygccactgcactccagcctgggcgacagtgagactccgtctcaaaaaaaaaaaaaaaagtctgctcaccattagatttaagtggtaaggatggggccaattcattcattcattcattcattcattcagcaagtatggatggagcacttactcagtgccaggcaatatttggggaataagagggagacatggtcactgccttcatggagctcccgggctcatgagggaaacacaagctagacgatgacaagagtgacaatgaccccaccgaataacagctctgttgggggacgtccgaggtacgggggggcgcatcgaggcaggtgtgttcatcagcgtctactaggatttgcagggtgactgggaattagcatgagaaggaacggkaargggatggcaggcacagagaacagcttgatcagaagcctggaggccggctgwgtaaggtcaggaaactgagaaaatcacgtgtggctaaagctgasagtgatgaaaagtaagctgggagagtgtggtggtgcctcgtcacccaggcactgagggtttggaggaactagagggtctgaagccgggaggggtggtgaggttttcagggagttttgtgttgcacgaagatgaattaaaggtcaagattgtgtttggtttgggtaaaattttatcaacatgtgccatacagaagaatgcacacccggctgggcgcgggggctcacgcctgtcatcccagcactttgggaggccaaggcgggcgggtcacctgaggtcaggagttccagaccagcctggccaacatggtgaaaccccgtctccactaaaaatataaaaattagccgggtgtggtggtgggcgcttgtaatcccagctacttaggagaggcaggagaatygcttgaacccgggaggyggaggttacagtgagccaagaccgcagcattgcactccagcctgggcaayaagaatgaaactctgtctctccaaaaaaaaaaaaaaaaagaagagaaaaatgcacacctcataagcatgcagcgcagtraacatccgcagagtgaagcactgtgtaagcagcatgcagatcaagggcacgtgagctgcggcgcctaggccccctctaagccccgcactcccttccagacacatctgctgccaagagtaacccccagctgactttcatctccgtggattagcctcgcctggttttgcatttagtatcaacgaggcatacggtgtgtgccccgctacgtcgggctcctctctctccacataaggcctgtgaatttcatccatcstgttgccccaggcggtacttcttctggttgccagggttacattgtgtcgacagtactgatgattggcatttgggctgttttcttgggctgtgatgaatagcactgatgtgcacctccttttgatggatgaatgttcttttttttttttaatccctcagagttgatcccaaagaatgtactcatttttggggagggcatatgtgctcaggagtgggattgctgggtcagaagttatgcaattggttctgcattcagttttccatactgtttgtagggtgtgagcaggtttcagtcagcgttttctgtaactgtctcctgcctagttccctcccaccaatacccagcgaccccacgcctcagctccaggtcccaccgacattcacagyccctctctcagaagcctaaaggccagggtgcaggagagagtttggagcccgtgtcgcagagggctctgagtccaccaggggctgggggagggcccagcggggctccctgaacacctgctgaagcagagaggggctcccaggcttgaacacgctggggaggaggatgtggtgggaggcacttctgggttcctgctgcagagagtggggcctgagaccacgggcctgctgcatggggcaggaagtgcgctggctggccaactcgggcctagaaaaaggcaggggctgtgctcctgcttgagaatgacgtgtgcctctcactcacattgtctctcttaaaatgtaagagaccagggctggcagcatcatgggttttggttgccacagaaggtatgggtgggacagacagcagacatggaaatagaccctgagggctgggcatgggggctcacacccgtaatcccagcactttgggaggctgaggccggcagatcacttgaggtcaggagttcgagaccagcctggccaacatggtgaaaacccatctctactaaagataccaaaaaaaaaaaaatttagctgggcatggtggcaggtgcctgtaattccagctactcaggaggctgaggcaggagaatcacttgaacccaggaggcagaggttgcagtgagccaagatcatgccattgcactccagcctgggcgacagagtgagactccatctcaaaaaaaagaaaaaaaaaaaaaagaaagaaagaaakaaaccctgagaacaggacaggttagagctgggtgaaggcaagatgtgagcttcaagtcagtgaccagttaaaaagattgttaaacatttaaatacaaaatactaaataaggtcaggcatggtggctcgtgcctgtagtctcagcactttggaaggccaaggcaggcagatcacctgagctcaggagttcaagagcagcctggccaacatggtgaaaccccatctctaataaaaatacaaaaattaaccgggtgtggtggtggcacatgcctgtaatcccagctactcaggaggcagaggctaaggcaggagaatcacttgaaccagggaggcggaggttgcagtgagccgagatcacgccactgcactccagcctgggagacagagtgagactccatctcaaaaagcaaacaaacaacgaaaaacatactaaagcaataaataaaggcaggagayggacaagggttgctgggctgtacccagctcagggtgtaacagggcccctgtggctgcgagctgatggccagtcctctgtcagagctggtgggtcaatggtttgtcagccacgtggtcaacaaacctgcaaactcccggcagtgggggataaaaggtgtgggaagcagaggcagctcagagggccccaggccatgtcattgcatgatggcggcatgaatggcagtcttgggatctgcagtgcgcaccctgcacagctgttcatgatggcctcctgggaacgcgcagtccaggtgggaagaaagggtgggggtggggtgctatagtcagggctgctgcagggcctggaggggatcaggctgcacttcctttgggaaggcttcctgaggagctggggtttgggatgattgctctgcagcaggagggatckcaggcagaggaaacagtccgggcagaggactgaggaggagagagactggaggcgggtccaggcctgcacctaccccaccaaaacggggtctgcggtggagcccagttttgaccccacccttcctgggggagcagggaaggagatgctgggtctagggctgaggtcggggctggggagagaggcagggttgctaaggaagcaacctaatttgggggctcagctgcagagccggaacagaggagcagctctctgctgcacccagccctccgcccctcagccctgccccagatgagccccctcagctgttgcctgggctgttgttcaatagtcactcaacacttactgagcccttgttctgtgccaggcattgctccagaccctgggaataacacagtgaagaagatagacaagatccttcgggagcctactgtctcgtggggagacagataataggcactatcagatgatggcaggttctgagaaggaaatcaaacagggtgatgtgaagcagagtaactgggttgtgaggcacggctgggtagagaaagcatttatgaggaggtgacaggcgaggctggggaaggagaataagccaaccttggggagagtggaaggtgagggctctgggaataggaaacagcgcggtggagggaacagtgccgtggagggaacagcgccgtggagggcctgaggcaggaaatgctggcgctggtcacccaggaactggggctgccactgacagaagggacattggtgtaaactacatgagtgggccaggtgctgtggctcatgcctgaaactcactgtaactcactaggctcactcccagcagtttgggaggccaaggcaggaagattacctgagcccaggagttcgagactagcctgggcaacatggcaaaaccccatctctacaaaacataagaaaatttgccaggtgtgatggcacgcatctgtggtcccagttacttgggagactgaggtgggaggatcgcttgagcctgggaggtcaaggctgcagtgaaccgtgatcatgccactgtacttcaacttaggtgacagaaggagactctgtcttaaaaaaaaaattacatgagtaaattaaaaaccaaataagtgggccaggcacagtggctcacttctattaatatagaagttttcttgtagttttggaggccagaagtctgaaaaggtgtcagcagggctgggtcccttctagaagctctgggggagaatctgttttcttgccttatttggcttctagaagctgcctgcattccttggctcacggcctcctcctcctcaagcctgcagcatagtaagctttgcatctttctctgacactttggaagaccaaggygggagtgcttgagcccaggatcagcttgggcaacacagtgagacttcatctctatagacaaattaacaaaattagctgggcaaggtaactcgctcctgtaggcccagcaacttgtgaggctgaggtaggaggattgctgagccsgggaggtcaaggctgcagtgagctgtgatcacactactgcactccagcctggacaacagagcaagacactacctaaaaaacaaacaaaccccacaaaataacaggaggctattaccatcaacaaggcmggacgatgatggaaggagcatctggagaagagttgctttctagaaataatttggagagtcrggcacggtggctcatgcttgtaattccagcactttgggaggctgaggtgggtggatcacctgaggtcaggatatcaagaccagcctggccaacatggtgaaaccctgtctctactaaaaatacaaaaattggccgggtgtggtggctcacacctgtaatcccagcaatttgggaggccgaagtgagtggatcacctgaggtcaggagttcaagaccagcctggccaacatggtgaaaaccccatctgtactaaaaatacgaaaattagctggtcatggtggcgggcgcctgtaatcgcagcactttgggaggccaaggcaggagaatcgcctgaacccaggaggtggaggttrcagtgagccgagatcgtgccattgcactccagcctgggcgacaagagtgaaactccatctcaaaaaaagaaaaaaaaaaaaaagaatttggagagagaaccaacagggttggcaggtggattggatgtagggcatgagtgaaaacacgacgaagtgaggatgcctcctgggttttgccttgagaacttagtggttgctggtgccatttgctgtggcggggaagatgagaagaagcaggcttgacaggaaagaccacaggttctgtttgtttcctatcgacgctgtaacaagttaccacaaatgtagtggcttacaacaacacaggtttattattattattattattattattattattattttgcactctttcacccaggctggagtgcagtggtgagatctcagctcactgcaacttccacctcccaggttcaagtgattctcctgcctcagcctcccgagtagctgggattacaggctttcaccactatgcccagctaatgtttgtatttttagtagagacggggtttcaccctgttggccaggctggtcttgaactcytgacctcaggtgatccgcctgcctcggcctcccaaagtgctgggatgacaggtgtgagacactgagcccagctgcaagtttattatcttgtagttttggaggtcagaagtctgaaaagctatcagcagggctgggtcccttctagaagctctgggggagaatctgttttcttgcctttttaggcttctagaagctgcttgcattccttggctgacgggctcctcctcctccttaggcctgcagcatagcaagcttcacawctttctccgactctgattctcctgcctccctcctagaaggacttttgtgattacactggggctttacagcccagccaggacagccctgggggcttctgggatgggagaggcctccttgggaggctcccagcattccctgcagtctcgccacttctcccctctgcctgcctcaacgtccccctgagtccctgcggctcgcccatgccaccgttttcggggcctccctcatagaaggacccttgtgatttcactgagcccacctagataatccaggataacccccccatctcatgatccttaatttattaactcacatctacgaagtcccttttgccataaaaggcaacatattcacaggttctggggattaggacgtggccttctttggggggccattattctgcctacgatagcagatggagaggtrggaatttcagccgttataggtgtattgaagccatgggcttggaagggatcactagggagagtgtgccggcaaggaagacagtgacccagcccccagatcctggtggcagatagaggtcagaccgcgaaggcaccagcgaagccttgaggaatgaggagagagtaggcagaaatctagaaaaaagtgttcgaaggagatggttactcatgtttggggcttctgagaggttgaggaagatgaggacagagagcggtccgttggatgtggcattgtgggggcccctggtgaccttcacaggaactgactcagagggtgggaagtcagcttggggtgggttcagttgtgggtgggcggatggacgcacaggtgcagactttcttattattctgtaagccatgccgatacgtgaatatatttcataatgtattaaaatgtagagtgataggagttgaggaagtggagacggtatctcatttctgccccaccttcctgtgctctttagtctgtcccaacccactgtagccacatcatgacctttttttttttttttttttttttgagacagagtctcgctctgtcacccaggctggagttcagtggcgtgatctcggctcactgcaacctctgcctcctgggttcacaccattctcctgcctcaggctcccgagtagctgggactacaggcaccygccaccacgcccggctaattttttgtatttttagtagagacgggstttcaccatgttagccaggatggtctcgatctcctgacctcgtgatctgcctgcctcggcctcccaaagtgctgggattacaggcgtgagccaccgcgcccggcctcatcatgagcttttgaaagcacagctaatcatgtgcttcccctttataaagtcctccatgacttctactgccctctgcagaaagaccttggacttggttcactgttaaccaccaagcccctcgtcccctccccaccatcccctatgacaaccccyggagctcactgtctgtctcaggacagcccagttctcctgggtaacgtggatggtgagaatgttgaggctgtccctggaatctgccgtctccctggactgggcctgggtgggggcaagaagtttgcagtcaggaggcgcagctcttgaggctgccttaatcaggctgaggcagccacccccaaacctccagttcttttatttatttatttatttatgagacgaagtcacactctgtcccccaggctggagtgcagtggcgtgatctccgctcactgcaacctctgcctcccaggttcaagcaattctcctgcctcagcctcctgagtagctgggactacaggcacacgccaccatgcccggctaatttttgtatttttagtagacacggggtttcaccatattgatcaggctggtctcaaagtcctgaccccagatgatccacctgcctcagcctcccaaagtgctgggattacaggcgtgagccgccgcgcccggcctccaaacctccagttctgactgacccacaggataggggcaccagcgtactcttctcaggaactaaggccaggcagggcaggccccctgggtggcccacgaggaagccagcactgcccccaacagaaccaaccccaacgctggtggttttctggcctccccatccctgtccccataagagagcagagtttttattaaccatcagtatcaccccttctttgtcagggtgggcagcaggcagagaggggttgcatttaaccatttcctgcctggtgctgtgtagaagcagaggttgggcaaatgtcttccccataatccagagtctgggctaggaatctgccggccagacagggagcttgtgagtgcaggcaactggaatgggaagggtgctgggcaggcagggagaagacgaggaacatcagccagctcagctttgcaacctcccctcccactcaggctcctggtcaccagccccagaaccaagaggacaccagggcccctccatcgatgttcccttgtccaggatgaaatcctttgccatcctgtaggtaagtcagccccamctccagggaatgctccccaggaccccctttctagcaaaatccccctcatctaaactcaaaccattccaaccccagccctgcctcatccagcccgttcacccctagactccagcataacccacagcaagattccatcccaatgcccagtcccaccccaacccaatcctaatccccagccacctttcctgacacagtcctagcaacagaaatgatacctacagcgtattgcgtgcccaccctgtgcccggcagtcctctgagtcattctgttttcatcctcaaaaccrcgccatttataagagaggaagctacagttcagagaatgtaggtcttttggttgccagtatgacaaagttcacacttttagtgttggtggctgattcgaaactctagcccttcctgatgcaagtcatcacacctcagtgcaattcaccccctacatattcagtctaactgtggccaccctagtaactagcatggggcctgacatatattaggtactcaataaatgccatttgaatgaatgaatgaatgaatgaatgaatgaacctgattcactcattaaactctatccatcctacccagtcaaactcaggtcacagatttactgacaacctcttggctatatatatataaataaatagaatccttgtcttgtctgaggctgggcgccgtggctcacgcctgtaatcttagcacactgggaggccaaggcgggtagatcatttgaggtccagagttcgagaccagcctggccaatatgatgaaaccccatctctaccaaaaatacaaaaatcagccaggcgtggtggtgcatgcctacaatcccagctatttgggaggctgaggcagaagaatcgcttgaacccaggaggtggaggttacagtgagctgacattgcaccactggactccagcctgggcaacagagcaagactgtttaaaaaaaaaaaatcctgccaggcacggtggctcatgcctgtaatcccaacactttgggaggctgaggtgggccgatcatgggtcaggagatcgagaccatcctagctaacacggtgaaatcccgtctctactaaaaatacaaaaagaaattagccaggtgtggtgacgggcacacgtagtcccagctactcaggaggctgaggcaggagaatggcgtgaacctgggaggcggagcttgcagtgagccgagattgcgccactgcactccagcctgggcgacagagcaagactctgtctcaaaaaaaaaaaaaaaaaaaaaaaaaatccttgtctgagaggcactgagttgaacagactcaatctcagtccagcagggttgactgagtgattccatgactgaaaaataagacagtatcctgaggctgacagtggggaggacgaggaaggagctaccatttctgcccctgaggctgggggcagtaagattccccaggatgggtctgtgaggctggsgggttccttggtccacacagccagtcccacggtatcttgcacattccttggcacttacatacccaccaggcagtgcttctccacccacctgcccraccaaacccactgaggaaaagcagcaggcatccgctgttgctggacgcccatcaccacgctcacaaggctgggcacagagcagacgtcaatgggcacgtgttgaaagggtcagcaaatgagccccggggatgggcactcggccctgaacgtgtccagtcctgaccttgaaggcccccgctctagctttctagaggcttctctgagtggccaacagttcctcatgggggcctgaccaaggtggctctgtgccctctgaccttggcttcgggtctctgcctcccagagtcccctcctcctcctcacctgggcttaactttttcagagcatgtccccatccccaaggggaggcaccggggagtgaccgttgtccggagccaccacggtgttttggtgagtgcaggagcgagaggagggagggccttagggaggctggtgctasccctcgtggttgaccctggtgttgagaccagttctgactgccaygctgttcccgaggctgagtctagcgtctccctggtgccaaccccagggctgactgtagctctgaccaccctgataccagggctgacctaggtattccctgtgacccagcacactcctgcaggtgtcggcctcggccttgaygccaacactgactcctacacccggtgaggggtgggccagctcttcctgtgccccctgcctggttgagccactgagttctggaatgggggtgagaatgtggctgtggctcgggaatcgggaggtgacctggtgtttccccaccctctcttccctcccacagatatgcattcaagtgctggtccggcggcctcacagcctcagctcagaactcacaggcacctgtagcctcctgggccctgacctccgtccccaggctcaggccaacttcttcgaccttggtaaggattggacattcactggccttggatagctctaaagagatctccttggtctccaagaaaaggcaccagctcacggcagatgcagtgggacgcaggcccacagtggagcaaggcagggttgaggcatcacgtgaaaggaatcagggcagaaccatgtgtgagcgtgctcaggygaggatggagcctttctgactctgagctcttccatgtgtgtttttaaagaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggtgagaagaggcagatctgggttgctctgagtcyatcagagccaattcctaggctggtggcctccaagggtgaggggtgcctcagtctgagagatggggagcagtggctggactttacagacctgacctgtaccagctccayccactctttcttataagtggggaaactgaggctcagagagtggtagtgatgggaatggctcacacagcacacaaagcctgaccaggttctagctctctttttgaagggggagacaaaagcttctctcttggggccaggtgaggtggctcatgcctgtaatcccagcattttgggaggctgaagtgggcggatcacttgaggtcaggagttcaagaccagcctggccaacatggtgaaaccccaactctactagaaaattcaaaaattagccaggcatggtggtgtgcattatagtcccagctacttgggaggctaaggcaggaggattgcttgaacccgggaggcggaggctgcagtaagctgagatcccaccactgccctccagcytgggcaacagagtgaagctctgtctcaaaaaaaaaaaaaaaaaaaaaaaaaaagcttccctcttgggagcttctccaacttcttccctgaactgagctggttgtcagggctgcagtgggggtgcatgccctacacatgctacccttacatctgcctcacatcccatgcccactcctgacctgtttgtcttggccaggcaccgagattgccatcatcctggatggctcaggaagcattgatcccccagactttcagagagccaaagacttcatctccaacatgatgaggaacttctatgaaaagtgttttgaggtgggcttcyctaagagctggttaacacttatctattgctgagaatcaccctacctcagaacaacaatcaccacatttgctcacaattctatgggtcacatacttgggctgggctcagctggatgattcttctgtccrtcttgcctggagttaccctggagctgcaggcgtctggttgcttgactggggctggatggcctaagatgacctcacttacttgtctggaccatgtgtctttagcaggccagcccaactttttcgtggcagcaacattctaagagggccagatccaatgcatgcaagtatttttcaagtctctaattacatcacatttgctgatgtcttattggccaaagccagtcacatgaccaatcccatcgtcagtatggagggcactacacagggagctggggagaagtctgtgattcactgggggcctttactatcgcacccttctccacccctactcgcttagagattttgctctgccttagcatctctttctgcccagggataaggtagaaggagtggatttttctgctgcttccagcgggagacatttcaggggcagaggtggcaattcttccaacctcctgccctcctgcccatcccctgcagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttgtgagtgtgggggctgcaggaattattctggccatgcccagagtctctgtggcatcactcatggaggaagtggctggccagaaccgcaggagaagagaattagggctccagcctttccctggccgagagagaacgtgagggatgacacctcaaggctgtcctccaaaaagtcttccaaagacttcctcttgtgagatgcaggagagcagagtgctcagtggacaggctggctgggttcaaatctcagctctggttttttttttttgtttttttttttgagatggagtcttgctctgtcacccaggctggagtgcagtggcacgatctcagctcactgcaagctccgcctcccaggttcacaccattctcctgcctcagcctcccgagtagctgggactacaggcggccaccaccacgcccagttaattttttatatttctaatagaggtggggtttcaccatgttagccaggatggtctcgatctcctgacctcgtgatccgcccgcctcggcctcccaaagtgctgggattacaggcgtgagccaccgcgcccggcctcagctctggtttgtatctgtgtgaccccgggcaaactgaaggaccttgtgacctgtgcttcagtttcctcactttaaaaatgagaaaaataggctgagcgtggtagctcatgcttgtaatcccagcactttgggaggccaacacaggtggatcacctgaggtcaggagttcaagaccagcctggccaacatggtgaaaccccgtctctactcaaaatacaaagttagctgggtgtggtggcaggtgcctgtaatcccagctactcgggaggctgaggcagggagaattgcttgaactcgggaggcagaggttgcagtgagctgagatsgtgctattgcactccagcctgggtgacagagcgagactccatctatctcaataataataataataaaaataaataaataaaatgagaataataatagtactcacagcttggagcagtggcttgtgcctatagttccagctactcaggaagctgaggcaggaggattgcttgagcccagaagttcaaggatgcagtgagccatgatcacaccactgcactccagcctgggtgacagagtgagacgccgtctctaaaaaagaaagaaaaataatagcacttgcctgatagattttgtgayggttggatggcttaaaatatacagtgtttacaacagtgcctggcacatgataagtgccatgtgagtattatctatcgttttaatatcatgagtcttcctgtacgcacacaagaggaatggactgccaggcagtaccttcctgctgggagcaggtgagaagcaagaacacctgtgttgcagccctccctctgcccagcctcgctgcgtgacttaagggggcatcacccccttctctgggtctttcgggaggattgtgaaccctcccaattctaatacaggtcagagaataaagtctctcctggagctcggtcatccttctggcaawgctctcttcttcatttactctcccctgcttagagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtaagagccaggagccgggagacacctcctgaacctgcacagcctggggtggggagaagccagggttgtcgatgggggcttttctgtaagcagcttatccagaccctgttctatttgcaaatgctcctcttctctycatgctctgtcatcccagagagggctcatttccccatggtggtcacagcttactggccaaatagtggtgggagagccacaggaaacacaccaaggagggttcctggaggaccgyggtgccaagctgagtcctgccagacaaatgggagtagctggcctagggcacaggggaggcagagaggggccctgcaggcagagggaacagcatgtgcagaggtgaggaggagcttggtgtattcaggagaacaggtgtactttggtaaaactggaattttgcccagagtatgggtagaacagggagcagggaaaggaggagaaaggaaggaaggagacaggtaatggagggccccagaggccagatggaggggctcasctctctccctgggcctggggaatccacgcagcrctgactcgctgacccaggctgtctgtgcaggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggtgagggctccgggacccaggccaccgcaggaggcccgagcctatgctccagcccggcctctgtcccatcttcatgtggtttctctgagcaactcccatcatctccctgaacctcagctcttccatgtctaaaaaggcaatggccgggtgtggtggctcatgcctgttatcccaacactttgggagacagaggcaggtggattgcttgaggccaggagtttgagacccgcctgggcaacatggcaaaaccccatctctactaaaacaaaaagtagctggggccaggtgtggtggctcacgcccataatcccaacactctgggaggccaaggccggtggatcacctgaggtctggagttcaagaccagcctggccaacatggtgaaatcctgtttctactaaaaatacaaaaaaatgtagccaggcgtggtggtgcatgcctgtgatcccagctactcaggagcccgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggcacaagttgcagtgagctgatattgagccatggcactccagcctgagcaacagagtgagacactgtctcaaaaaaaaaaaaaaaaaaaaaaaaarrscaacaatatccccaggcctccttgcgtcccagaatctccatgaagctctgatgaactgagctggtgctggagaaacaaggatggctggggcatagtcccttctcccaggagctcacagacgaggaaactgaggcctagaaagagtgaactgcccagatagtagttgctcaaggagaacctgggtctctaccctcagccgggttctcttcctgttacaccaagcatggttccttctgggagtgaggccaagctggactgtcccctgactcagtttctcccttcacctcggcccacagcagtctcactgggcttcttggcttgcaggcacggttggagacgcccttcactaccagctggcacagattggcttcagtgctcagatcctggatgaggtacgtggctgactcagcaccaggcaggcttgcccattggtgaggggcccaggacacctaggattcagggactcctgcctcccatccagggctctgccctacctgtggtgattcctgtaaaagagcgattttattttaattaattaatttatttatttattttgagacggagtcttgctctgtcgcccagtctggagtgcagcggtgcartctckgctcactgcaacaaaagggtggccatattgatgacaggaggtcgcttttttctgtgtgctcaaacatccagttgttcccctgaatacagaccaggcaacaggactcggcctgggtcagcttatcaaccaagctgcttgcttctcccggaggagggagtgcaagggcacgaggcaggagcccagtgttggccatctcaccttcccgcctgcatctctggccaggcgggcactagaccaccgaacgcccccctgctcccagccaggttagccgcgctggcccggagacccgcggccaccgtggcccggccttgggtccctcccactcatctgggccccatccccgtccccttcagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggtgagggcggggccacctgatgagggcggggccacctgatgagggcggggcctggaggctccctgatgagggcggggcctggaggctccctgggcgagggtggggcctgagggctacgtgggcgagggcggggcctacctgggcgagggtggggcctgrgggctacstgggygagggcggggcctggaggctacctgggcgagggtggggcctgggggctacctgggtgagggcggggcmtggaggcyacstgggcgagggtggggcctgggggctacctgggwgagggcggggcctggaagttacgtgaggagggtggggcctggagaccacctgggwgagggcggggcctagaggccacctgggcgagggcggggccgagatggggacaccgaggctgcgcattaggctgcacttgaggtttccggatgggggcgggacctggtcagtcacatgggccgaggggcgggtcctggttagggaccstgaggctgagtactacagcctcctgggtaggtacaaggcctgtcaggtacaccaggcacagcagccacccaggggagggcggggcctctccattaataatagtggtgcagtagctcacgcctgtaatcccaggaggccgatgcgggcggatcatctgaggtctggagaccagcccggccaacatggcaaaaccctgtctctactaaaaatacaaaaattagctaggcgtggtggcggatgcctgtagtcccacgtactcggaaggctgaggcacaagaatcgcttgaacccgggagggggaggttgcaatgagccaagactgtgccactgmactccagcgtgggcgacagactgagactctgtctcaaaaataaataaataaataaataaaaataataatagtggtgggcgtcctctcacccctcttctccgtcctcctagggtgtgtgtgggagcgtgggtagtgaatgtgtgcgaacgagtatttcgagcaaagctgcatacgtgacagacagcgtgtgcatcatatctgtgtgatggggatgtgtgtgactggcaaagtgagagtgctcgctgatgccgattttwaacatagtgagaaagacagtctctcctattttgccccccwccccaggccactttgaaggcctgactgggaaggtgccggggccaagagagaggccaggtgggagcacacggtgtgttcacagccacaccacccttgccccaggttacgctgtggccgtgctgcacaagacctgcagcctctcctacrtcgcgggggctccacrgtacaaacatcatggggccgtgtttgagctccagaaggagggcagagagkccagcttcctgccagtgctggagggagagcaggtacctgctggggaaagcctccaccccttatgaccgatggggaatctggaggcccccaagggaaaggagtgggtcccacggtgcacagtgggccagggcccgggctgggtgaaactcaggctcctgagtggagctcgagggctctgcttcagctctgcatgtctgattgctaggcagtttcctccgctgtggggcctgggctgctcctccactcttctgttactctcagtgagcaaattgatatgtaacgacccaaaytgggtggtccaggaagcacgcgggcaggggtgtagccttgctgaggggtgsaggagcggggctcctggtgagctgagttcctcccgggctgtagatggggtcctattttggctctgagctgtgccctgtggacattgacatggatggaagcacggacttcttgctggtggctgctccattttaccacgttcatggagaagaaggcagagtctacgtgtaccgtctcagcgagcaggtgggagagtctccatcttcatgagcttgctgaggctgtggcactcagcctgacacagaggtgatggaggctgggagtgccctggccctgcctggcaccagtgggcagtgatggggaggtgctcaggctggatggcggctgggcggggcagcggcatcgctctccgcacccactttcttacccaagggtgatcgttgatgataatatctctaatatcyctttttttgtggttgttgtttttgagatggagttttgctctcgttgcccaggctgcaatgcaatggcaggatcttggctcaccgcaacctctgcctccggggttcaagcaattctcctgcctcagcctaccaagtagctgggattacaggcatgggccacacacccggctaattttrtatttttggtagagacagggtttctccatgttggtcaggctggtcttgaactcccgacctcaggtgatccacccacctcggcctcccaaagtgttgggattacaggcgtaagccacctcgcccagcatttttttttttttttccgagactgagtctcactctgttgtccaggctggagtgcaatggtgcaatctcaacttactgcaacctctacctcctgggttgattctcctgcctcagcctcccaagtagctgggattacaggcatgtgccactacacccggctaatttttgtaattttagtagagatggggttccgccatgttaaccaggctggtctcgaactcctgacctcaggtgatccacctaccttggcctcccaaagtgatgagattatgggcgtgagtcaccgcgcccagctgataacatctcttacagctgcatggttggcaaagcccgtttagtccaggatctcacttgtttctcatagtaactatgggaggtagctgccactctcatcttacgggtgaggaagctggggctcggcgagcctcagtgatgccgagacttgctcaagtgtacctggcatgtgtgtggcagagccacgagtgaaacccaggcctcccatttgcagcaatgcacccctgcccatggaactagaggggggcgggctctgactcctgaacttccaggtaggaggaccccagctttcccctggtgctcactgtatggccttgggaagktccctggccagtgagcgtgcatcctgggtggcaacggagtgggcacccaccagcccagcgagcgtgcatcctgggtggcaacggagtgggcacccaccggcccagtgagcgtgcatcctgggtggcaatggagtgggaacccaccggcccagcgagcgtgcatcctgggtggcaatggagtgggcacccaccggcccagtgagcgtgcatcggggtggcaatggagtgggcacctagcaccccttcttgagggctgagctgtttgtttgctttacaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaayggacactgggacggcctctccgccagcccctcgcaggtgacccatgggrccctctccttcctctcctctggggctctgacctctctcagatatgatgacccaagccccaagtcggcttcagtcctaagtgctgggcaggtctcgggggttgggaatgcccagtgaaagaaagaagtcccccaggctagggggagcttccagaccagggcctcacctcagccccttcaggttgggrggaggttccagaccagggcttcacctcggccccttcaggttcrggggaggttgtggcggtacctgtctccttccctggcctataccccctccttccacccacctgcctcgggtccctgcttcctctctttctgtccctcgctcctgtctcccacccagcacctccgcgccttatctctcattccccagggctcccttgccagcctctcacactgcatgtattaacaggcacttccacccacctccagctcctcatgagcacctccacctggatggcccccaggcatctcactcccacacggcccatctgagagcacctgcttcccctagaactgatgctcctctgagacctcatccccctccacaccccacaccggaaacctcagacagtcctcagcacgctcacagcctgcacagcctgtcagttcccacgtcctcatgattctagctgtctcccaactccagccccttctctctatccccacccctgcggtcccagctcaggccttgccatcccactcccagcccacccagcttcctcctcctctccatcttccaccccatgtcttcagtgccatttctaaagtgttatcctgattatgtcacttcaaaacaacagaacctttgttgacaccccccatccccaagccccacatcaagcctccttgtaccccaatcccctgtggtccaccccgtccctggccctggctgcttctcagaaggccctgctctttccccaygcctcactctttcccttactctcccctgtcaagtcccacctgccctwcgaggctccatccaaatgccacttcctctgggaaagcttgctccctctttcctggttctagactcggggctccctggggctggatggtgcctgcgatgctgatcgggatagatcatgaaaggactccccgccccgtttccctcccttccctcgccccacgccttgtgtttctgcctccacagcggatcagagcctccacggtggccccaggactccagtacttcggcatgtccatggctggtggctttgatattagtggcgacggccttgccgacatcaccgtgggcactctgggccaggcggttgtgttccggtagggttctgtcctgctttctggggtcccaggcccagcctcacccatttgccctgctctaaatagctccatgcagacattaggcactgagggagggagccagcaccgtggttgtgggcacaggctctggagtctgcccgtctgggtttgaacctcagctctcagccctctcagcctttgggcaggttatttaactctaagaccttacctaggaattataagagcacctacctcccagagctatgaggatcatgcaagcgaatatatacaaagtatttagcacagtgctcagcgatggctgtgattgcagagttttttgttttttgttttttttctgaggcrgagtcttcctcttttgcccaggctggagtgcagtggtgtaatcttggttcactgcaacctccgcctcccaggttcaagcaattcttctgcctcagcctcctgaggagctgggattacaggtgtctgccaccacgcccggctaatttttgtatttttagtagagacagggtttcaccatgttggccaggctggtcttgaactcctgacctcgtgatccacccatcttggcttcccaaagtgctgggattacaggcatgagccactatgcctggccaagaattgcagagtttttgtgccccatccctcagtgaatgatcaagtcccgtggctgtaaatgagctcatggagcgcccgtctgtcccgtcctctccaagctgcagacttgctgtctacccagcacctccctgagctgctgctcacagtcatcccgaagtgaacacgtctaaaaacagagcttttgctgggcgcagtggctcacacctgtaatcccagcactttgggaggcccaggcgggtggatcacaaggtcaggagatggagaccatcctggctaacacggtgaaacctcatctctactaaaaatacaaaaaattagccgggcatggtggcgggcgcctatagtcccagcgactcgggaggctgaggcaggagaatggtgaacccgggaggcggagcttgcagtgagcggagatcgcgccactgcactccagcctgggcgacagagcgagactccgtctccaaaaaaaaaraaagaaaaacagagcttttatctccccccacccttcattcccccaaatctatcctgccctcaggctttctgtctcagcaaatggcatcatcatccacccagcaattcaggatgaaaacgtaggcgtcatctttgatgcctcttttccttcctctccaccacatcaacaagtcttagttggctctgcctccagaccagtgcaggcactgtcttcactycctggacactgctgccacagcctttcctgcttccagcccctgcgctccattctccacacagcagcagccctatcccttcactctgctgcctgaaactcctccacggctcctatttagagtaaaatcccaattcctcaccatggctttacagggctcttcgtggcctggcccttcccgcccctccattcccatctcctcctcccatcctctgtctcactaattagattccaggcatgctgacctttgtgctcctcaaacaaaccaaaagtgttcctgccacaggcccttggcactggctgtgctttcttcctggagtgctcttccccagatcctcacacagctggctctttcttgttaacaaatctcaaccgaaatgcctcctcatcagccacgccatctgtgaccacccagtctcagtagccctcggtccttattaccgtatttttgttgttgttgttgagatggagtcttgctctgtcaccsaggctggagtgccrtggcaggatgtcggctcactgcaacctccgcctcccaggtttaagcaattctcctgcctcagcctcccaagtargtgggattacaggcgcccgccaccacacccagctaatttttgagttttttagtagagacgatgtttcaccaagttggccaggctggtctcgaacccctgacctcaggtgatcckcccgcctcrgcctcccaagtgctgggattacaggcgtgagccaccgcactcggccaacagtattttaatttttctcatagccttgccaatacatagtatctccctgtttctctcgtttatttgcttgttgtctgctttcccaccaaagcagaaacttgtctctttccccactgtaccctgagactcagggatcacctggatgtgggcatgtttgatagagaaccattgaatgcatgaaccaatcagccaggccctgacccagaggctgagcagtcacttctcccatcctctttgctgtcttgtttagctcccggcctgtggttcgcctgaaggtctccatggccttcacccccagcgcactgcccatcggcttcaacggcgtcgtgaatgtccgtttatgttttgaaatcagctctgtaaccacagcctctgagtcaggtaaaaaaatggtccagctgacccctgcctggtgtgatggtctttcctttttggcttctgtaaggggcagggaaagaggactggggcggggggtgggtgggtgttggtctgaggtcctggtgcttgaaatccctcgattagagcttagctccttagtctccaggtttgttaaatgcaaactgcctcaagaaagggtggtctgaggttatgtccacactcagaaggggtttagagctgacactgttgggaagagggacactggggcccttcctcagggttgaagggttgagtttctgaaaaaaaagactcagaaggccgggcgcggtggctcacgcctgtaatcccagcactttgggaggccaaggcgggcagatcacgcggtcaggagatcgagaccatcctgcctaacatggtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggygacagagcgagactccgtctcagaaaaaaaaaaaagactcagaaaaaggcagccatttctccatgcccacgtgtgtgcgtgtgtgcgggggcttctgagacacaccctcctctttctctctgacttgtgtcttctccccttccctcctcactatgtgcctccggcccaggtgggattggatcacctgttggaggcctggtttctctttccttacctgaaactcattaggagactgttcccagaaaggaggtggtgggcatggctttcacagcccaggtatttactgctcatccaagagctcccccctggaacgattcctcagcaacagtccccgaggtttaatctctcaggagcaatctctgagatggtctctgcctcccacagtcagagagcagtctcctggggtggggtggctttcccaaagcagcaggctattatccacctggggattgaaaatgacagacctggccgggtgtggtagctcacgcctgtaatcccagcactttgggaggccgaggtgggcagatcacgaggtcaggagatcgagaccatcctggctaacacggtgaaaccccgtctctactaaaaatacaaaaattagccaggtgtggtgacagatgcctgtagtcccagcactttgggaggccgaggcgggtggatcacaaggtcaggagatcgagaccatcctggctaacatggtgaaacgccgtctccactaaacaaaatacaaaaaattagccaggtgtggtggcgggcgcctgtagtcccagctacrggggaggctgaggcaggagaatggtgtgaacccrggaggcggagcttgcagtgagccaagatcgcgccgctgcactccagcctgggtgacagcgagactctgtctcaaaggaaaaaaaaaaagaaaaaagaaaaaaaaaagaaaataacagacctgtcccttccaggacacagagctcgatgggctgtgcgatgctgggcaagtgtctctccctagctgagctggttctgttctgtacagtaagagaggcggccccgggatctccacggtgcttccagctgtgccgtcctggggtttttctcckcagagtccctctttccctctccattctctttgttgtctctcttcctccttattttcttcttcaatctcgatccccttcccragccctccttccctaaagaaggctgactcagtcctgggaatgtgctgctccgggtttggggcgggagcactcagagaccctggtcaggtgtcagaagacggtgagaaaaatatctttgaaaaaccgacgcaggagtccagccgcagggaagtacctgcatggggacactgttcaggaggggccacaaggaacctcaggcaggctgggggccttctgtctgcggctggctcatccccacctcatcgggaaggtctggtcttcattcccaggcctccgygaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagaggtaagtgacggagtttggatgggagtcaggaggggtctttgtcattgagaaaggatttgaggtgatgcagtgaagggcacatacccagacctacaaatgaggtgattaaaataatcataacaggccaggcacggtggctcacgcctgtcatcccagcactttgggaggccaaggcggggggatcacttgaggtcaggagttcgagaccagccgggccaacacggtgaaaccctgtctccactaaaaacacaaaaattagccgggcgtgrtggcgggtgcctgtaatcccagctactcgggaggctgaggcaggagaatcgctggaatccaggggagggaggttgcagtgagccgaaatcatgccactgtactccagcctggccaacaagagcaagactccatctcaaaataataataataataaatcaagaaccacgtaatggcacggaagatggagatgctgtcattgctgacgtttttcttggtaataactcaggaatgccagtgttcttggcatgcgttatcmgacctcacctgataataactaggaccgagggcctgaatgtcagttggcatcaaaaaagtgaacaactaaaaggaagaataaaaagatagaaacgaccatctagaaaggtttactcctggcaaaggtgcccagagacatggggtaaaaaaagtatgtcgggactcaaaccctgacaggatctcgaactttggatctatatggatcgtttattccaataaacaaatgcatgaattcttcttctgaatacacatttacccccaaagtgattgttaattggattaaagtctacagccttccttaaataaaggcttaatcacattctctaccagagaatcatgctcactttctcccatgggcttgaggctcttataggggcagaaaggcttatttaaacaaagagagtggcaaatggtatgctaagcaatctccttatcttctctcttacctctctaatatgtcctccatgttgctttgagaaagatcttggttggttgggcgcagtggctcacgcctctaatcccagcactttgggaggccgaggtgggaggatcacctgaagtcaggagttcgagaccggcctgaccaatgtggtaaaaccctgtctctactaaaaaaaaatacaaaaattagccaggcgtggtggcatgcacctgtagtcccagctacttgggagactgaggcaggagaaccttgaacctaagaggcagaggttgcagagagccaagatcgagccactgcactccagcctgggcgacagarcgagactccatctcaaaaaaaaaaaaaaaaaagagagagaaagaacttgataaacccaggtgtggctgtgactcttcccttctgtctgagccagttctttacccctttgtgactgggataagaaccatagcagctatagacacaaaaccgtagtagaatgaaggagatttttcccaaagcacttggcagcttgcttgaaggacgtgtcccttcagcctggcttatttggaagatgcttaggacttctgactcaccacttttattgtttatttcttcttatgatgacatcaaagtagaaagtattcttgcaaggtgcrgtggctcatatttggaaatcccagcactttgggaggccaaggtgggtgaattgcttgagcccaggtggttgaggctgcagtgagccatcatggtgctgctgccctccagactgggtgacagagtgagtgagaccttatcttaaaaaaaaaaaaaaagaaaagaggccgggcgcggtggcttacgcctataatcccagcattttgggaggctgaggcgggtggatcacttgaggtcaggagttcgagaccagcctgaccaacatggcgaaaccctgtctctactaaaaatacaaaaattagccaggcgtggtagcacacacctgtcatcccagctactcgggcggctgaggtaggagaatcgcttgaacccgggaggcggaggttgcagtgagccgagatcacgccactgcactccagcctgggcaacagagcaagactccatctcaaaaaaaaaaaaararaaaaaragaaaaaraaaaaaaaagcattattgttgtcatcttctcccccacatccaactctaaccctgccttccgtggtgaccccacagctctgtgaggaggactgcttctccaatgccagtgtcaaagtcagctaccagctccagacccctgagggacagacggaccatccccagcccatcctggaccgctacactgagccctttgccatcttccaggtgactctacccacagccagtacccagccctcttaagagcctatcccacagaaaccacctgctcccctaacttccaagaatggtggagttgggaggcaatgtcttcagacggcatttgggcccctcaccgtactcatggtgaaactgagtccctgagatggtgttaatgtgtccccgtgagtgaggactcatgggtaacgcaggtctccatctgcccctggggcttgttcctttatgtctttatgttcacaaaagcacttgctacatctttcatgaggcacatgcatacattgcatcctggggacctcacttggcaagcggctctgatgacgctgtgatgggggttccttgtgggagctagactggagctgtcgtgtcttgcactgcagagaggatgccctttggcacacctgcctgttcatgccctgccagggccttcaggctgaatggccccaccaaacctgtatcctagcctctcctcctggtgcccatcagtgcagcttagacaggcgggtagtgtcataagaaacttttgtcagccgggcgccctggctgatgcctgtaatcccaacactttgggaggttgaggcaggtggatcacctgaggtcaggagttcgataccagcctggccaagatggtgaaaccctgtctctactaaaaatacaaaaattggccgggtgtggtggcatgggcctgtagtcccagctactagggaggctgaggcaggagaatcatttgaatcctttgcccaggaggcagaggttccagtgagccaaggccgtgccattgcactccagcctaggcaacagagcgagactccatctcaaaaaaataaaaaataaaataaattttaaaaaatacaaagattagcccagtgtggtggtgcatgcctgtagttccagctactcaggaggctgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattgataaaatactattatctaatttacaaactttattcaaattttgccagttgtcctattaatgtcctttatagcaaaagaaaaaaaaggttctggtccaggatcattcatagcgttctacagttatttatcyttagtctcctttaatctggaagggtttctcactcagtcttyccttgtcttttaatgacattaacatttttgaagggtacaggccagtccttttgtagaatgttcctcaatttgtctgatatttcttcataattagattcaggttatacatttttgttttgtttttgagacagagtttcgcccttgttgcccaggctggagtrcaatggcgtgatctcggctcactgcaacctctgcctcccaagttcaagcaattctcctgcctcagcctcccgagtagctgggattacaggcatgtatcaccatgcycggctaatttttgtacttttagtagagacggggtttcactatgttggccaggctggtcttgaacacctgacctcaggtgatctaccctcctcggcctcccaaagtgctgggattacagacgtgagccaccatgcctggccaggttatgcatttttgtcaggaatatcacagaagtaaagtgtgtccttctcagtacaccatctcaggaggcacctaatgtggacttgtccattcctagtgctgtttgcctgtgtcattaataagcacgtctcattttatggtgagatgccttgcgattgtatcctgcttaacatctctttatgtgtctttccttaaccagtgatgactattatgctatggcaaagagatttttaaaaagttattccccgtataaaatgggtgaggaaaaaaccacgtggtattaggcacatcggtgttaccagagagtgcgttctggctgggagtttagatggcttaaccccattctctttcactggggctgggtggaagagatcaggctatgtggctatattaaaaatacaacaaaagsccgggcgcgggggctcacgcctgtaatcccagcactttgggaggccgaggctggcggatcatgaggtcaggagatcgagaccatcctggctaacacagtgaaaccccgtctctactaaaaatacaaaaaaaaaaaaaaaattagctgggcgtggtggcgggcagctgtagtcccagctactcgggagkctgaggcaggagaatggcgtgaacccgggaggcggagcttgcagtgagcggagattgcgccactgcactccagcctgggcgacagagcgagactccgtctcaaaaaaaaaaaaaaaaaaaaaaaatacaacaaaaaaccctgcatgaaactgttgacccacttagagagagcgccacgctttgacttctgcaaatggcatcccccttccgcaggaagtagaaagttccctttcaagccctgggctgtcattccccctctaggccrtgggaacagacctgcagacagctgccgaggtggccaccgggagagaagtgcgaagtgcagaggctctccagccgaggagctggctgccttccttcataatacaaaaacagacccagctactttagaacactggaatttttaaaaacacgaactggagcttttcaacctccatggggccttttgaaatgtggctttcagaattagtcgattatgtgtaggcaagggaaatagttagcttacagagacgactagccaggccgggcgcrgtggctcacacctrtaatcccaacactttggaaggccaaggtgggtggatgacctgaggtcaggagtttgagaccarcctggtcaacatggcgaaaccctttctctaataaaaatacaaagttagccaggcgtggtggcacatgcctgtaatcccagctacttgggaggctgaggcaggagaatcgcttgaatcckggaggcagagatggcagtgagccgagatcgcgccattgcactccagcctggatgacagagcgagactccatctgaaaacaaacaaacaaacaaccraaaaaacagatgactagccatgaggaaggaacctccaaggcctggaccttgacgatatttggctaggcatcccccactcctgcccgggctgttctgcctatatccgaaaggactaaggaagcttctcttygcgtaggtgtctgctccctgaatgctcaaagtcgtgagctgtgtgttgctgctgaattcgcatgatgtaaatgtcatgggcacccctaacattccgtgaaggtcaccccagtttttaccttggtcaaaggactgggtcacagtgtgcccatgttataggacagatccaggaatgtcacccaggaatgtcacagtccctgctcttcggggacaatcccagcctgcacccctcacctccctgtaactgcacttctcagggtgagcaggaggcacagcccaaaacttcctataaggagaagagccggaggcagggctgctggggaaggcggagcctgggctgatcgggactctctgtctggttacagctgccctatgagaaggcctgcaagaataagctgttttgtgtcgcagaattacagttggccaccrccgtctctcagtgagttggacatagccgtcagyttcctcgattaaccttctcccgaacgcttgcctgggcaattccttcattaggacaccctgcacatccccttcccctctccccgtggcccacaaatggcttctgcacttattatctcaatatgtcctcagctaccccagaagggaggcaagacagagatctgtcttcccactttctagattaggaagcagactcagtcgccgagggccctgcataggccatttggtggacttgaacctgggtctcttgacatcccggacaatgctatattcagaacccagcgttcttcacagccaggctgacctctacctcagttagaggtaacctctttcccggcccacctcttggccaaattaactaatcaatcaaatatttctggaccatctactttgtgccaagcactctaggtgctggggatacttctgtgaacaacacagacaaaaatccctgccctcctggtgctcttagggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggwtgggtgtctaagggaagagcagctgcaggtaccctgggttggaagcctgcctggtgggtggggggcagggtgagragctagtggctgcagtggagtggggcggggtgtaatgagggaaggggaggaagggggaagaggccatggggcttcttaagccctcagaagggcttttgctgtgagctgggaagtcagaggagtgacacactcatgcagcttagcaggatccttcttgctgcttagctgagaagagaagcggcacttgctccctttgtaaccactcaggtgagaggcggtgtgggctgggccatgacgggagtaacagtttaaagtgacagctcatacgtagcacgtgctgacagaatggaggcggagggaggaaagagggccacagccccagcatgcggcactgcactgtccaacacaccagccacgcttagctgtttacatgtacatgagttaaaattaatcacaatgaaacattttgttcctcagtcacattagccacacttcaaagactcagtggccgcctgtggctggtggtgttgggcagcgcagataccgcctgtctccatcgctgcagacgttctattggaccacactgaattccagaatgacagtgttgccaagcacatgagtgtgggtttagacatgtagtggtcttagaatgccccccaggccgggcgcggtggctcatgcctgtaatcccagcactttgggaggcagaggtaggcggatcatgaggtcaggagtttgagasaagcctggtcaacatggtaaaacyccgtctctactaaaaatacaaaaattagctgggcatggtggtgggcgcctgtaatcacagctactgggcaggctgaggcaggagaatcgctcaaactcgggaggcggagggtgcagtgagccgagatcgctccactgcactccagcctgggtgacagagcaagactccaaaaacggggagggggggagggtaacaaaacaaaacaaacaagcgtccttggcgactagtgttgtgtatgtattgtgattctgttggccagctggctggagttgccgtatatggggaagaacgcagttccccaagtcctggtcagccctttcatagacatttgcaggaccarttgaagactttcaaatgctctggaatccaggctaacaagcaggcacagctgtttccagcagggaattaattacagccaagaaccaacctcccagccagctactgggggtagtagagatacagcacgcatggcttgccctacatcgccccctagtgtacatagcaagcaaacgcttctctttcaaaaacgctagtgagcctggtcgtcggtgtccagctgtctcagtggtttttgacctgaggacatagatccccaaaagaatctaatgaagactacagacccctctccttagaagatcacatgtgcatacataaattttggcattccgggccctctgagacggtccctaggcctcagattaggcaacgctgttaatattctgatgacactgaggtctcacgcctgagctctaagatgtgtgtccagctgacatgtyagcatctctgctttgttatcctatatgcacctcttgtcatgtccccgattgaacgcatcttcttccacccttgggtcttcctcccatgttacctccctcagtcaatggcaccactcagccaccggcaccactcagccaccggcaccactcagccacctgagctagaaactcagaacttgcccttaactcctctgtcccccctcccctgcctctttttcgtttcatttgctttactgtctctgacttctttccttctccactactgttgtcttttttcttcttcttcttcttttgagacagggtctcactctgtcacccaggcaggagtgcagtggcgcgatcttggctcactgcaacctccgcctcccggcttcaagtgcttctcctgcctcagcctcctgtgtagctgggatcacaggcgcacgtgaccacactcagctaatttttgtatttttagtagagacggggttttaccatgttggccaggctggtcttgaactcttggcctcaagtgatccacctgcctcacctcccaaagtgctgggattacaggcgtgagccaccgtgtccagscatccactactgtttccttatttcaggcatgtatcatctctcgggtggagacagcaggctctgtctctgcttcctgtctctccctccagtcaatccagcctcttctcagctgggataaaaaccaaaccaaaaccaaacaatgggaacaaaacacacctcacattacttcctaggccgggcgtggtggctcacgcctgtaatcccagcactttgggaggccatacttcctagatctgcacatctcatctttggacatttcagatggaaaacagttttctcggtattgctaatatgtttttctgtcdatctcagctactgagagtggttctgcactctgggtccctgtgatacctcagcattctggaggaccctttcacacatccccaggaccctcttttccaggacatgtggacccatgtcttaaaccacagccttttaatgggaagggtctgaatgattttgtgggtaggaagctgaggccaagaaacggggtaggacagtatgtcttatgcacactgttctccagtgcacagcagtgccccataaatattgtggcatggatgaatttgtgtcatagagtacctcacctagggtcacagtgaattggtggtagaaagaggatttgggtacaattctctcaattctttggactactagactccaggcatttaattagccttttatttatttatttatttattttgagacagagtttcactcttgttgcccaggctggagtgcaatagtgtgctcatggctcactgcaacctctgcctcccgggctcaagcaattctcctgcctcagcctcctgaatagctgggattacaagtgcctgcaccacacctggctaattttttttttctttttttgagatggagtctcatgctgtcacccaggctggagtatagtggcgtgatctcagccctctgcaaactccccctaccgggttcaagcaattctctgtctcagcctcccgagtagctgggrttacaggcacctgccaccacacccggctactttttgtatttttagtagagacggggtttcaccatcttggccaggctggtcttgaactcctgacctcaggtgatctacccgcctcggcctcccaaagtgttgggatgacaggtaattagcctgtcttggcttctgtttcctcttctataaaatggagagtagctgtactatttcacagggttactatgagggttgagcgtgtgagacgcagtccttggcacatggtaagcactaaataaagggcagctattatcgtcatctcatgcaacaactgagatgggcgtggcagtccagctgtttgcttatgttgagaggaagaatgtctaagctaaacgtattccttaggcaacttatctaagaagttacttaagaaggtgctattctgggctgtgtgcggtggcttacacctgtaatcccagcactgtgggaggccaaggcaggtggatcacttgagcccaggagttcaagacccgcctccacatggcgagaccctgtctctacaaaaaatacaaaaattagctgcacattggccaggctgggtggctcacgcctgtaatcccagcactttgggaggccgaggcaggcggatcacctgaggtcaggagttcgagaccagcctgaccaacgtggagaaaccccgtccctaataaaaatacaaaattagccaggcatggtggcgygtgcctgtaatcccagctactcaggaggctgagacgggagaattgcttgaacctgggaggtggaggttgcagtgagccgagatcgtgccattgcactccagcctgggcaacaagaacgaaactccgtctcaaaaaaataaaaataagaaaaatattagctgggcatggtggtaaacacctgtagtcccagctactcgggaggctgaggtgggaggatcacttgaacccaggaagtggaggctgcggtgagccgtgatcattgcaycacagcaccacgctctagcctcggtgaatgtcctattgtattgcgttgaggtttttacagatgaaataaactgtaacatttttatctgtaccctgtgcaggcaggagttggtggtgggtctcacaaaggagctgaccctgaacattaacctaactaactccggggaagattcctacatgacaagcatggccttgaattaccccagaaacctgcagttgaagaggatgcaaaaggtgactgtgacggtggctgtggaaacaggtccctcacgcccctccctcgctgcatgcctgcttttctgtggtgrccccctcactggcacccctgcctccagcctcctcctggtccaaccaacagatggttaataactagataaatccccgccagtccrgctccatgcctcccgaggcaccatattctgctgcagtrccaccctccctatgtgcggccctttcttcaccagggttctgagagagaagtgagtctaatgccctaagacactgagaaagtaaaaattagcttagactgggaaagtgaaaatctgccctgccattcccaaggctggatacagacacagatactaggaaacagtctgtttcccgaggacaccctgtggctgacaagtatcactgcactgagaaattttattctctaaaatcacagatsagaaaactttgggccgggaacggtggctcacacctgtaatcccagcactttgggaggccgagacgggcggatcacgaggtcaggagatcgagaccatcctggctaacacggtgaaaccccgtctctactaaaaatacaaaaaaaattagctgggcgcgatggcgggtgcctgtagtcccagctactcgggaggctgaggcaggagaatggcgtgaacccgggargcggagcttgcagtgagccgagattgcgccactrcactccagcctgggccacagagcaagagtctgtctcaaaagaaaaaacaagaaagaaaactttgctgtttgaagtagttacgtcrgtaattatgaacccctatccctcttgcctggagagtgtaagtcattttgaccaagagaagagtctgtttccacctgaggtagagagcttcagatacagtgtctgtcaactttctactccatattaatggtttcccaggaagcgggccctgggtctgattcacaggctggcctgctggtgactgactccttgacactcagccctgctttaccatcaaaacaggactttatttacatttcatctgaactccacccttccctggagtcctttaataaccgccttttccattgttcagtgatacacacaatagtgtagtttttggatgggtgcagtggcccawgcctgtaatcccagcactttgggaggccgaggcgggcggatcacctgaggtcaggagttcgagaccagcctggccaacatggcaaaaccccgtctctactaaaaatacaaaaattagccaggtgtggtgatgtacacctgtaatcccagctactcgggaggctgaggcacgagaatcacttgaacccggaggtggagattggagtgagctgagattgcgccactgcactccagcctgggcaacagagcaggactctgtctcaaaaacaaacaaacaaacaaacaaaaccaaagtgtagttttcctcattgcagtgagtcaataaatttgaatttgttggactgtagatttgtccccggtcatcttaggctatttgggctaggacagtatccattatatgaatgaagcaatctcctaggcygggcaccgtggctcacrgctgtamtcccatcactttgggaggctgaagtgggtggatcacttgaggtcaggagttcgagaccagcctggctaacatggtgaaaccctgtttctattaaaaatacaaaaaattagccgggcgtggtgktgggcacctataatcccagctacttgggagactgaggcaggagaattgcttgaacccgggaggtggaggttgcagtgagccgagatcgcgccacttcactgcagcttgggcgaaagagtgaaactccatctcaaaaaaatgaaaacaaaagcaaaaaacaatctcctaggcatctagaggggaactagggatggaccgtccctgggagaattaagaaaactcactgcagtcatcacctgcccctcgggggtccaggtggggagccctggtggctacgtggcagtgctggtgtgtgccggccttccagccaggctgtgggttatatttgcatcagtccatggcccagctcaaatgcctccttccccaggaagaccttacgaattcctccgagttggaattcatatttctccactgctgttctctgcagctccctcacagaagcaccccttcgaccttgtatttaaattcctcggggatctactgctgaccctgcctgtccggcttgtgaggaagacagggaccaagtggactttatttctttagctcctggcagggtgtctgacaggcagaaaaattagtgaatgtttgctgaattgctgtgaggaaaccacgtttttgttttgttttgtttggctctttaagagaatgtcatctgctctkttaacagcctccctctccaaacattcastgtgatgaccctcagccggttgcttctgtcctgatcatgaactgcaggattggtcaccccgtcctcaagaggtcatctgtgagtcggtttggacygattcgctcttctcaccaccctgcagttggcgtcttctgcaycttggtctcayctcaatctctcggttccagctttgcgcttcgcttgactgcagtgtgtccccagcagtgcttacagtggctaagctggctctgaaagtagggggtgatggggaygagagctttccagtacacagccctaggtgaactgcctgctcacctccrtgaagcagagtgaagttgtgggtagtatggagggcgtgtcagacaaaaagtttttttgtttgtttgtttttgagatggagtttcattctgtcacccaggctggagtgcagtggcacagtctcagctcactgcaacctccgcctcccgggttcaagtgattctccttcctcagcctcctgagtagctgggattacaggcgtgcagcactacacccggctaatttttaaaatatttttgrtagagatrgggtttcaccatgttggccaggctggtctcaaactcctgtcctcaagtgatccacctgcctcgacctcccaaagtgctgggatgacaggcatgagccaccatgcccggccaagacgaaaagttattaaccctgatctgtcccttgtcatctctgtgctgtgggaaatctctgaagtggcttcttcacctgtaaaaggggaatgaggccgcctgccttgcttactccatatttgtatttgaggcttaamtgaaataacggggccrggcgcggtggctcatgcctgtaatcccagcactttgggagaccgaggtgggtggatcatttgaggtcaggagttcgagaccagcctggccaacatggtgaaaccccgtctctactaagaatacaaaaattagctgggcgtggtggtgcgtgcctgtaatcccagctacttgggaggctgaggcaggagaattgcttgaacctgggaggcagaggttgcagtgagctgagatcacaccattgcactccatcctgggtgacagagcgagactccctctcaaaaaaaaaaaaaaaaaaraaaaaggaagggaaaggaaacatgctgtgttagaaaaatgtgaggaatgtgaaaatctgaggaatcgtctcctaggtctgttccacgagtagctagcggtctgaattgtgagtggcatagagagaatcaactgaccatttttccccctttaaaataggctcatgtttcagtcgtttggcagctagaggagaatgcctttccaaacaggacagcagacatcactgtgactgtcaccaagtaagtactgcctgggtcacagcagagtcaggctatgaccccggaagacatctccctgccacatgcacgctgtgagaggaacggcccccttacagcccagggagaaaggaaaccccagtgagcccacagaaggcatctgtttccctgcagggactcgactttctcttcttgttaccagagataatgaaaatgttcttttgttcacacacaaagtaaaactgtggtacagcctggtggaatgagccctggagttctggttctygttcactcagctttggaatagcttgggatagctatgttayctgcaagacctctgtgttggggggtaaggtggggaacrctgctgggaagagttctcaaagggaggtgattctgcccaccagaggctgtgcctgttttgattgccatgacttggggaggggggtgttcagtaggacatctggtgggtagaggccaggaatactgccaaacatcacgcagagcagtacaggacagcccccacaaccaagaactaactggcccaaaacgtcaatagtgtggaggctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcarttctctgcctcagcctcccgagtagctgggattacaggcgcccgccaccacgcccagctaatttttgtagttttagtagagatggggtttcaccatcttggccaagctggtcttgaactcctgacctcgtgatccaccagccttggcctcccaaagcactgggattacaggcatgagccaccgcgcccagcctctgagagccttttcttatctgactcccagtgaccctggggagccaggtgcagaagcacctgttctgcagtgagagcacatggacacagggaggggaacagcacacactggggcctgtgggaggggcagggttggggagagcttcaggaagaatagctaatgcgtgttgggcttagtaactaggtgctgggttgacagctgcagcaaagcaccatggcacacgttcacctatgtaacaaacctgcacatctgcacatgtaccctggaacttaaaaaaatagccaggcgcagtggctcaygcctgtaatcccagcactttgggaggccaaggcaggcagatcacttgaggtcaggagttcgagaccagcctggccaacatggtgaaaccccatctctactaaaaatacaaaaattaactgggtatggtggctcacgcctgtaattccagctactcaggaggctgaggcatgagaattgcttgaacccggggggcggaggttgcagtgagctgagacrgcaacactgcactcctgcctgggcaacagagcgaagccctttttaagaagcacttgctatgtacaaagcaggtgtgctatgaactaacactcttattcctagttccaatgaaagayggtctttggccaacgagacccacacccttcaattcaggcatggcttcgttgcagttctgtccaagtgagtactcccaagaggccagcagcggtgtgactccatcgcccagggggcagctttgggctctctctcgtagatggagctggtggtcaggatgaatgtggacactgtccttctgagaggagcctgcttagaacccaggctctgatattgatctctagggtgctaacatttgggtcacaraaaccccactgtggtcatcaaaggaggtgtattgccaactagtcgtgctacaaaagggaattaatatgacgctgtggagggaagaaggcagctgtgggactgggaagtaaggaggggatgagtaaggccatttgagggataattagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttcaagcgattctcctgcctcagcctcccragtagttgagactacaggtggacaccaccaggcccagctaatttttaaaaaatttttaatagagacrgggatttcaccatgttggccaggctggtcttgaactcctggcctcaggtgatccgcctgcctcggcctcccaaagtgctgggatgataggcatgaaccactgcacccggcctcattcctggtaaaggtctggtgccctctgtcctaatgtattcagttgaaagcagtcgagttcattcaaaaagagaaggccrggtgcggtggctcacgcctgtcatcccagcactttgggaggcygaggtgggtggatcacctgaggtcaggagttcaagaccagcctggctaacatggcgaaaccccgtctctactraaaatatgaaaattagccaggtgtggtggcaggcgcctgtaatctcagctacttgggggcttaggcaggagaatcacttaaacccaggaggcagaggttgcagtgagctgagatcgcaccactgcactccagcctgggcaacagagcaagactccasctcaaaaaaaaaaaaaaaaaaaaagggatgagtgtagtggctcatgcctgtcatcccaacactttcscaggctgaggtggaggatcacttgagcctgggaggttgaggctacactgagccatgattgttccactgtgctctagcctgggcaacagagtgagaccctgtctccaaaaaagggagaaagactcctcaagggctgacgcatgtcctstcaattgcagaccatccataatgtacgtgaacacaggccaggggctttctcaccacaaagaattcctcttccatgtaagtacttattwttgtaaagctgtagatggcaaagcaataccagctttgatttcctactctgattttaatttgcaggtacatggggagaacctctttggagcagaataccagttgcaaatttgcgtcccaaccaaattacgaggtctccaggttgyagcagtgaagaagctgacgaggactcaggtatttaaaggcagttmtttatcagtcacacctctttccacagtgactacagagtctcaagtataaaaaccagagttctagaaacagagtgaagrcaagttaaccatgggaaaagattaggagtaaattcccgaagtcctgttcagaaggactctcaatcactcagctcttaaagcaacctgtcagttttcctccctttgaggaaaaataagcaaaaattggccaggtgcggtggctcacacctgtaatcccagcactttgggaggccgaggcgggtggatcacaaggtcagcagatcgagaccatcctggctaacacggtgaaaccccgtctctactaaaaatacaaaaaattctccgggcgtggtggcgggcrcctgtagtcccagctacttgggaggctgaggcaggagaatggtgtgagcccgggaggcggagcttgcagtgagccgagatcctgccactgcactccagcctgggagacagagtgmgactccatctcaaaaaaaaaaaaaagcaaaaattaaaaccttgtcagtagacagagacattttccctttgaaaattgataaattctgcttctctgtgtgagygatgtaacatgtgacatttcttacactgccccctataagttgcttactagcttcccttcttctcccctgaractcttttttggtctctgctttgcctcagcctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtcaggtgccatggctcactcctgtaatcacccagcactttgggatgccgaggtgggtggatcacaaggtgaggagttcgagaccagcctggccaacatggtgaaacccccatctctactaaaaaaatacaaacaattagccgggcatggtggtgtatgcctgcaatcccagctactcgggaggctgaggtaggagaattgcttgaacccgggaggcggaggttgcagtgagctgagatcgcaccactgcactctagcctgggtgacagagcaagactctgtctcaataaaattwaaaaaaaaaaaaagagggtttataaatataaacgtttgttttcacatgtagtttatttatttaaaaaaatagagacaggggtcttgctatgttgaccaggctagatatgaactcttgggctcaagcgatcctcctgcctcagcctcccgagtagctgggaytacaggcgcacgccactgygcccggctagtttacttctttcagaacatttgttatcagcaaatttaaacatttcaacaaatatttcagtttccatttggaaacaaaattcttgtttgaaaagctgactggaaacctgtgagaatgggagttccaccctcctgtggggayggaggttgaaacagcaccagaggcttcaagaccagtctcctctcatttcggggcagtaagatacatttagcttacttaaacagactgtgctggcagagcaagtcagtggcagagctgaagttcagcattgtcctgtggaactcctggatttttctcttaatttgcttcatggcaggagtgttacatttagtcttgaaggtcatttgtttcagcatcttgtctgtcaggtaatgtaaccagagcacattactataagggtgatattcaccccagcggttgttattctccttcttcatgagcctgtagatgtcaaactggtagtcaccgtcaccggtaaacaggtcctcatccatggaaacgtcacagaaaaccacaatcccatcccgttccaagcgcgacagggtgtagtcaatgatgctcacttgcaacccacagctggggatagtgctgctcttcccattgagggtgtagtggagttttttgaggctggttttctttaagagcacgttcccccagtgtaagtctcggtgctcaaagcgcagtgatgcctctgccactgcgagggaggctgtgagctggtgtagaatgctctttgcagtagccaaggaagacaacttggttcgcatttgctctaagtcaatccctccaaactcaaattccagcacaatgaagagctggtcgtctttaaaaaaatcaggccggtcatttgcagagcctttggttgaattatagtgatcccaggctttgaggagcaagggagggtaagatccctggacacagtgcactgagttcagcccgataaagccttctgtgcggttgcacacttcaccggataagaggctcaactctttggagatgatgatctctggcaggatttcctcaaaggttttctgatgggatccattgactaaatctggtccttcaatagcaatgatttttatggctacgggtgtgtgatcagcaattgtttgaaacacttcgccaaacaccccttccccaatcttctcacagmgttgcagtttttctgtgggaaggcaatggctaaaggggacaggacccttctgactgcattccccataaaccttttcagcatcagatgcctttttgtttgaaatacttagagtgtttaaggggcttagcaaatacatagaggaggagtgccaagaggacggagcaccacttgttctgttcatgacaggccggtytgaacattctgatargagggatccagagagagaagtggcagtggtatagatgctgcagacctctgacacatcagtcacaattttcttcttgtggaaactgaaggaagccctggttttggtccaaaagcagrcattctgtaaaggagtcaggtcctgggtggggaacgaatcttttcccagcttttggccctttttaaagcggtgggaatggaggagagaggtttccgttgcctcctgatgtttgctcttccggcttgatctagttctctccagcctgtctrttccccttggcacaatgcggcccttgggaacactggcctcctgatgctctctccggacggcctcttgaagccctctctcttgacaagagtcctggcctgtggccctcctcttgcctgtgcttgacagacctggaccctctggtccatttcccaccaccagtttccttttacagcaggactctctcatattcttcccatctgcccgaaactcagaatcctcaggggttcctgagttcataaggccaaagagaactgacctgaggctggcgcgggtttggtggaccatcctggtgtccttggctcctcctgtcgcttcctcctgggagcaggggagagatgctcggtccagggagacttctgggaggtggaggycgctcgggacggctgaggctgcaaccagacaggcggaggtgccgatcgagatgacactgtcccttggcgttggggacccggggcagggcgaggccagagagctgaacagggaggcactgatgcccagctcgtcgccgtccctgggctggccgcacacgctgaggtccgggctgaggcggccggagtcgcggctggggaagggcggaagtcggagcgggccrcagggtgtgctgcacttctgcgggggccgagctcgcagccccaggcgtcttggggtcacggttaggcttgggcgagctcgcagcttccagcgctttggggtcacggtcaggctgggccggtccttgggcactcggccgccgggacrcctccgccgccgcctcwccgggctgccggggaagtcggggtcgtcgggatcgtcaggatcgtcggactgcgaggggtcgccgatgctggcgtcgctgctgccgctgctgttgaagaaacgcctccggtcctgcggcgggaaccactgcgcggcttcccggcccggccgccgctgtctcctgccgtccgcagccccatatgtgcggaaaagccggctcccaggtcccgggagcgaagccgccatggccggcacccgccaagaggttcaaacgcaaacatcgcgagacttccgtgcgacgcggacgcgcccgcctgccgcggggtcctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcaggtaagcgcggccgtcccgagaggccaggggagggcggagggcctgaagcgggtaacgagaggccaggagactgtttttcctgggttacccctgcckgccagtgccgggggctgccaggccctccctagcttcgtccctgggtctcaattgctcccgctggagcttygcttgggccgaggtgagcgctgaaattgctcacaccctctattctgggaccttacgatgctctgtgtccgaagtgttaaaaagatttcagactttccgcacggaaaggaattgtgttcactagacctcgcttttccagcatgtggaagaakggcattcagtgagctgtgtcatcgcttcagataaagaaaatgtcaccgtggctgcagagatctcctgggatcactctgaggaggtgtttgagactgaaatgctccagatttgattatccagttgctcacgggcatcgcccctagaagagataatagcatctttgcataacrtgtccatgtccawaatagrtcttttggtgcaaaaaaccaaccctctgtcccaacccgttccttagctaccctcaggagggagatatactccagttacagtacaaggaactcgagggattacctgtgactcctctttcctacatccccacgtctattccagcagcaagccctgccatttcagggccaaaatatatcctaaacccattcacttctctccatttccactgccgttgtaattcaagctaccctttcttgccagggctgttgcaataascttcggcctgcctttcttgcctctgcttttcccacattctttacaaataattcccacgtaacagctatccgtcttctaagagcagacattagattgtgccaytcccctgcttattaaaaataacaaacaaacaaaactgatgcttgagcacacttagactaaaatccatacttttttcatggccagagcaaggcagtacttgatctggtctctgcttaattcttcaacttcatctcctagtactcgcctttctctcccactgccccttttataatcgggttattctgtcctattcttctagctcgccagtacagcattattctggccacaagactttgtacttgctgttcctttgcttgacactgctcttcctctaggtcctgacgtaggtggtttcttcttaaatttagctcaggtgttcttttcttttytttttttttttttttagatggagtcttgctctgtcacccksgctggagtgcagtggcacgatctctactcactgcaacctccgcctcccgggttcaagtgattctcctgcctcagcctcccgagtagctgggattacaggcgcyggcgaccacgcccagctaatttttgtatttttagtagagagggggtttcaccatgttggccargctggtctcgaactcctgacctcaggtgatcgcccgcctcagcctcccaaagtgctgggattacaggcgtgagccaccgcacccgacctaggtgttcttttcttttcttttctttctttcaagacggagtttcrctcttgttgtgcaatggcacgatctcggctcactgcaacctccgcctcccgggttcaagcgattctcctgcctcagcctcccaagtagctgggattacaggtatgcgccaccatacccggctaattttgtatttttagtagagatggggtttctccatgttggtgaggctggtcttgaactcctgacctcaggtgatccgccctccttggcctcccaaagtgctgggattacaggcgtgagccaccacgcccggctaattttgtatttttagtagagatggggtttcatcgtgttggtcaggctggtcttgaactcctgacctcagatgatctacccacctcagccwcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacargaaataatttaaaaaaaaagaattgtgagtgtggtggctcacatctgtcatcccaacactttgggaggctgaggcgggaggattgcttgaggccaggagttcaagatcagcmtggrcagcatagtgaaaccccatttcttaaarataaataaatacataaattagccacgcatggtggctcatgcctgtagtcccagctacttgggaggctgaggcaggagtatcgtttgagcccaggaatttgaagcttcagtgagctatgattgagccactccattccggcccgrgtawcagagtgagaccttgtctcaaaaaaaaaaaaaaaaaaaaaaaaaaaggaaaaatctcttacgttaaataaaatgaataagctgggtgtggtggctcatgcctgtaatctcagcactgtgggaggctaaggtgggtggattrcttgagcccaggagtttgagaccagcctgggcaacatggtaaaaccccatctctacaaaaaatacaaaaattagcccagtgtggtggggtgcacctgtggtctcagctactcaggagactgaggtgggaggatcacttgagcctggaaggttgaggctatagtgacccatgatcatgccattgcactccagcatgggtgacagagcgagatcctgtctcaaaaataagtcagtcagtcaagaactgactttggatggcacaagggaaaagaagttgaagaaaaggccaggcgcggcagctcacgcctgtaatcccagcactttgggaggccgaggtgggtagatcatctgaggtcaggagttcgaracaagcctggccaacatggcaaaaccccatctctactaaaaatacaaaaattagcctggcatggtggcacatgcccataattccagctactcgggaggctaaggcaggagaatcgcttgaacctgacggggtggaggttgcagtgagccgagatcgcaccacttcactccagcctgggcgaaaragcgaaactccatctcaaaaaaaaaaaaaaggaagttgaagaataactgcagatgtcttgtttgggtaactttatgtagtgttgtgtacgttagggccattamctaagcccaggaatacctttaaagggaaaggtggtgaaggctgttcaaacacagtgagttcatgtctaaaatatgttttgtttccctcattcctttccccatcttctagttactaaaagatgtaactgaactgcagatccttggtgaaatatctttcaacaaatctctatatgagggactkaatgcagagaaccacagaactaaggtaattcctggctggcttctgagtastgcccaaggaaaattgtgcctaacctttgagcacctccacagacattctgttgccctcttcctgttttcagccttaacacttctgatcttggctctgccatcgctgcctttgtgacctttgagtgagtcagcttcttatgaaataaggcaattaagaggcctaagctgaggagttctgagttgaaataactaggctggaatctgcagtatatactttgatttgaaaatggattgattaaaaaaaaaaatttcgcagctgggcgcaggtggctcacgcctgtaatcctagcactttgggaggccgagacaggtggatcacctgaggtcagragttcaacacaagcctggccaacatggagaaaccctgtctaccaaaaatacaaaaattagccggacatgatggtgggtgcctgtaatcccacctacytgggaggctgaggcacgagaatcgcttgaatctgggaggcagaggttgcagtgagccgagatcacaccactccactccagcctcagtgatagagygagactcagtctcaaaaaataaataaataaawaaaaaatgarttacctaagtgagaaattgttttttgtatccagtaactgtcttagtgtgctgtatcagtgtttagttatagtattaaacagtactcaggaatgcataaatcttttataagatttagactagatactggaactcttggaattctttttgcaaaagtatgactagaagtcagactgatgcctgtgatttgtggactgaatgctttgtgtgttaccstgtgttttcattcttgttgacccttgcctggacatggcttcagaggtgatctatctgtgagctctgagctctttagttaggcatgattctctactagagggaatgtcaggagagtgatgctggattgctaaatataaggtcctctgttttcctccctggaggrggagaaaggagcaattctctagacatgccaatataacatttccttttatttttaagtagtgtatttctttttcttttcttttctttcytttttttttttttttttgaggaagaatctcactstgtcvcccaggctggagtccgttggtgccatctcggctcactgcaacctccacctccccagttcaagtgattcttcttcctcagcctcccgagtagctgggattacaggtgcccaccaccatgcctggctaatttatttattttttttaaatagagacaggatttcaccatgttggccaggctggtctcgaacttctgacctcaggtgatctgcccgccttgacctcccaaagtgctgggattacaggcatgagccaccatgyccggctaagtagtgtatttctaatacagaaaatagarggaaatggaaaatacagaaaacggaagaaayagaagtgccccattattgcactgcccagattttaacaaataaaartaatagcaagaaaatccaagccatacagagaatggtaccaaatgaaaaataatkgttccttcatttctcccttcccatgcccccagcagggaggagttactattaagtttcttatgtgcacattttaaatttgtatgtttccccctcttacttactgatacttttatytctatagcatggattccccaaaattcctttctttaaatccaatatcctaagyaaagtgttaagtagttcctgacaataagcccctgacttacagtgactctatgagtataaacaaactgtatccaaatgcatttcagccacaagaaagggaaaatccagctcatgcagcataagggcatatgctgtttatccagtgagggaggccggcctggggcgatggcctggcttctttggtccttgtactctgccgtgtgggggacgcattccttcatggccagcacaaagttgccacatctccaaatgctrtaytttcacatggcaggatacaaaacaggaagcaagaagtcagtagcaaaaggatgttggatttttcttcatgtgccttcccttttcagggatgaaacagtttccaaaagctcccaggagacatcctcttacatcttattagtgagatctgaatctcatgtcagtcactggcaaaggagaatagctgtgtcatgatcacctgagaccaacgatgattcctgaataaaatccraaaggagagaggggcccctgggcaggccagcatccgtgtttgctgcaaacagtagtacccggtgccttgcttctcccttaacctctacytgggcatctttggggcacttttgggaatctgtgggtttagaagaagataaagggaggtggctttgagaaatagggacatttcttctactcamatctggcctgtttccysagtcaccttgggacttcctttcacttcccaaacccagggtcttgagtccccctccttctcctgtagaatattccagccctctttctgttcttcctccctctttgttgctatggtacctccctattctcaaagcctaggacttcactcctatttagttcagctacctatgagctaaataggactggaaggtcaactttaggtcaaccagcatttataacttaattggaagaggccttaaaggtaagtttgtccagcccttcaccccgtacagaaacctctccaaagcacccctgaccttggtgcttaaacatacacgtgaagggttgctctgggcaggcagagaagtcttgttggctctctggccccacctaagtcctgggaacttcctctggccacaacttggaagggccatacctgggtctcaggaagsacatctcctgaactttctagctgagccctgccagaagagagattagactcccgaaattgggagagcctttggaaaacaaaacctgmggatgacttctaatagctgagctctgcaagtagtacacatggatataatttgcatttattatgtcccttaggtaatacacactttttagtctggtgaggggaagaccagtacttttgtcatattttatgtggggaaagtgtattaccaaagcctttagggatctgtgcaagatcaaaaagagccgtcagaacggagttggaaaggacttggagatcatttaaaggaagtcatcattttaaagagcataggcacggggctcagggacatagagcagtgtagcggcgtgacagcctcacagtcctgtgttgagaccggattccgtgggaccctctttcaagctgtcagarcatctttaacagaaggtcataatctcctgacagacctagcccttctagataaggggccagaatagtttcttacgaagtatttgggtgattggatagttttagatgatctaaaatgctgcatcagggaatatctagctttttgctttactgtcatcagctttgatcaatacacgggttgttgccaagtcctcgtattttgctccttaaaataacatgtaggattttttcctygtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaaggtcagttctactcatggcatcacagtgagggaagactgggctctagttttgggcacagaactccttaggacagccaacctctgacttagagcagctgccctggcctcgtggccacttttttctcctccttcaactgcacacccccatttagacaaatgagtaaaacagtatctgtctgaaaagagaaaactctgagtwataaagagtgattttatatatatttctttggtacctccctrttctcaaggcccagaacttaatactgttatgttcggttacctgtgagttcaatagggcctggaaggtcaaccctaggccagcatttataacttacttggaagaggccttaacrgtaaggcsttaaaacagatgtgactgttgttcccctgttgaaatcttttccttgccttcccgtcttaatgtgcaaactcttctactgctatttaagatcctctcctctgtccgctacccgtctctgcccttaagtgttgcttttttttctttttttttttgagacggagttccgctctttcgcccaggcttgagtgcggtggtgcgatctcggctcactgcaacctycccktcccccbrccctgaccccgggttcaagagattctcctgcctcagcctcctgagtagctgggattacaggaatgtgccaccatgcctggctaattgttttgtatttttagtagagacggggtttcaccatattggccaggctggtctcaaactcctgaccttgtgatcctcccgcctcrgcctcccaaagttctgggattacagkcatgaaccaccactcccagcctcttttttwaaaataaacaccagggtctttgtcccccaagctggagytcagtggcacagttaagggctcactgcagcctcstactcctaggctcaggtgatcctcccatcttagtctcctgagtractgggactgttactcaggtgcatgccaccacacccagctaattttttaattttaattttgtggagatgaggtctccctatattgcccaggctggtctcaaactccggggctcgagcsatcttctcatcttggcctcccgaagtggtggggttacaggcataagcacctgaccttgcttttttctcccaacaagtcaaactattccctaaataggttcgtgcctctgcmtacgcgtaggctgcttttcttgtcaggaatgccctccatgactgctcacttcactcactgtcttccctgaaagcrgtctagagactcctgagtcctctgtgctggcttctgtgtgtttgctgtgagctcccttctagaaacccttccaaatggcagtcatcacactgtrttgtaattatctctttttcctactagatgatgagcttgatgtaggaagctgtacttgatctccttctgtcttcagcatcataggctatactgagtatttttgcataaataagatkagatccagtacagccgaaattatcatgctttgcaaaataagttaawaaggttcarctgctcgggagagcagggttcagaggaaggtggagtcagttctgattgagggatgagcaccagaggtcttgaaggattggactctccaggagagattcagagtaagttaggagaagggagtagtaagtatgagaagcagaggaatataggggctatttaggcaacagccagaatgccrgttttctgaaacagatggctatctttggcctgtaactggacttttccttcctttgtttcagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcwggatgatctagagcagcatggagctgttggtagaatattagtttttaaccatacattgtcccaaaagtgtctgtgcattgtgcaaaaagtaaacttaggaaacatttggtattaaataaatttacactttwctttgcartagtgcctttaatctggaaatacagtattacttaggatttgcagtacattttgcctgatrgggcaagttttcattcttatttttaaaaaatgatagattgtggcygggcatgatggctcacrcctgtaatcccagcactttgrgaggctgaggcaggcagatcacgaggtcaagagatcgagacyatcctrgccaacatggtgaaaccccatctctactaaaaatacaaaaattagctgggcatggtggcgggcgcctgtagtcccagctactcaggaggctgaggcaggagaatcatttgaacctgggaggcggaggttgcagtgagccgagatcgtgccactgcactccagcctagcaacagagtgagactccatctcaaaaagaaaaaaacaaaataggcggggtgcggtggctcacgcctgtaatcccagcactctgagaggctgaggcaggtggatcacraggtcaggagatggagaccatcctggctaacacggtgaaaccccgtctctactaaaaatamaaaaaattagccgggtgcggtggcaggtgcctgtagtcccagctactcgggaggctgaggcaggagaatggcgtgaaccygggaggcagagcttgcagtgagccaagatcacgccattgcactccagcctgggcaaaagagcaagactgtctcaaaaaaaaaattatcgattgtatcctttcagrtaattcttaagtatcaatttttcagatttccagaagaaactctttggggttttaatttaaacatacaggttaagtttgggagcattgatatctttatagatttcctttctactccgcttgctgygatttattttttawtttttattttactttatttttttttttttgagacagagttttgctcttactkcccagactggtgtgcaatggtgtgatcttggctcaccgcaacctccgcctcccrggttcaagcgattctcctgcctcagcctcctgagtaactgggattacaggcatgcrccaccacgcccagmtaattttgtatttttagtagagatggggtttctccatgttggtcaggctggtctcaaactcytgacttcaggtgatccacctgcctcagcctcccaaagtgctgggattacaggcrtgagccaccrcgcctggcaatgctgagatttttaaaaacactctgyagcaaggttttataattttcttcaaaggggtcttaatttataaagacttacttccagctgcatttttatttgtttatttattttgggggggtctcactgtgtyrcccaggctggagggcagtgatgcrgtcataggttgctgcagccttgaacttttgggttcaagccgtcctctgcctcagcctcctgygtagctgggactacaggtgcaagccactatgcccggctcattttttaatttttcttttgtagagatgggatctagctatgttgaccaagctgatttcaaactcctggcttcaagtgatcctcctgccttagcctctgaaagtgttggggcgtgagccactgcgcctgacctgttattatgcttttgttgctactgtgtgaaaataccgttttttccccctgactgtttagagtttgcacttagaacagttggtggttttgaatgtttatcttmtctggccattttactgaactgtggttttgtttttttggagacggagtctcactctgtcgcccacgctggagtgcagtggtgtgatctctgctcactgcaacctccgcctcccgggttcmagcaattctcctgcctcaccctcccgagtagctgggactacagggacccaccaccatgcccrgctaatttttgcacttttagtagagayggggtttcaccatgttaggctggtctcgaactcctgacctcaggtgatccacccrcctcaggctcmcaaagtgctgggattacaggcrtgagccaaatccgggcccggccaaactgtttttaaatcactctttagttgattctttgggatttttctaaggagacaattytatttgcaaataatggcaatttggagtctttctgatatttctacttttggctacccttacttctttgactaggacgtggagagctctgagaagtaaaccgtgtacctggttgtaatgggagggcttttctggccctcctctgcctgcctcacacctgcctgttaycccagccccggctgctctgcctttgggtagtttctagggcttggttggagcagcccattcacctctcatggagccccgtaccttgccagtgttacatcactaggctgttgggcacsatctgcttccctgttgatctgattccatcatcttcatttcgttcagaaatccgtctgtgctatcggtcacttgatgatattgttctctgttttccaatgctgccacaggcttttcccctyccttgtaactcttgggttgtttcagtggaatttgcctttgagggaaaacacacaggtaagtttgcttacttattttcctgttgtgctcaggagttgtgtccaagttttcatattatataaaagcccctgctttttatactttttaaaattgcaaataagaccccacttccatcgtcactgggaagcctgttattgacttactgagtcgtgctgatccaattggcgttagagcaaggcagctgtaatcgggggactacatcaggaactacttaatgaggaggaagacacttttaagtgcgacatggttagattttacaaattcatatgctayggcttgggccaaggtctgtggcatacacctgtagtcccagctactcaggaggctgaggcatgagaatcgcttgaacccagaaggcagagtttgcagtgagacgagatcgtgccactgcactccagcctgggcaacagagcgagaccctgtctcaaaaaaataaataaataaataaataatgaggccgggcgcagtggctcacgcctgtaatcccagcacttcgggaggcgccgacgtgggcasatcacctgaggtcgggagcttgagagcagcctgaccaacatggagaaaccccatcttcattaaaaatacaaaattagctgggcgtggtggtgggtgcctgtaatcccagctactctggaggctgaggcaggagaatcgcttgaacccgggaggcagagcttgcagtgagccaagatcgygccactgcactccagcctgggtgacagagcgagactccgtctcaaaaaaaaaaaaaaaaaaaaaaaaaaaagaatgagtgctgggctcagccctgtggagtaaccttttctcgtaattgaatgaggtctaaataacgtggccaatttaggttttcacacctgcttggtttcattggtttcatccctccaaagttcagatggtatcatgagagaaacaggttattcgaatctgcactcactatcctgtaccagggcaaaggagaacagaaagcacatggggtactttcccagccgrtctttcttctacaagctgccttttaggtgctaggcctttctcatttccttttcaccctctgcctgggacaggaaatggtagagcttgcatagatccaagaacagtgagtcatgccatagggccactctgctacccagaaaaggactgagctgggacccgctgaactttggatgcagttattggagggaacagcagttttttttgttttgttttgtttttttgagacagggtctcgctctcgttcatgctggagtgcagtggtgcgatctcggctcattgcaacctccgccttctgggttcaatcgattctcatgcctcagcttcctaattagctgggactgcaggtgcatgccgccacgcccaactaacttttgtatttttagtagagatggggtttcaccatgtcggccaggctggtcttgaactcccgacttcaagtgatccgctcacctcggcttcccaaagtgctgggattccaggcgtgagttgccacrcccggcctcctgctgtcttaaataatctgcactactgcattattctgtgcacatctctaatacatttacaaggaggggtttttggttaagattttctgggtcttctagtcataattatattataatggcaccagaattttaccattacttgaactaggaacagattcagtatatggaatcaagggaaactttcattttattaattwattwattwatttatttatttgagatagagtcttgctctttctcccaggctggagtgcagtagcatgatctcggctcaytgcaacctccgcctcccaggttcaatcgattctcatgcctcagcttcctraktagctgggactgcaggtgcatgccaccacaccaaactaatttttgtatttttagtagagactgggtttcaccatgttgaccaggctggtcttgaactcccgacttcaagtgatccgctcacctcggcttcccaaagtgctgggattccaggcgtgagccgccacgcccggcctcctgcagtcttaaataatctgcactactgcattattctgtgcacatctctaatacatttacaaggaggggtatttggttaagattttctgggtcttctagtcataattatattataatggcaccagaattttaccattacttgaactaggaacagattcagtatatggaatcaagggaaactttcattttattaatttttgtttgttttgttttgtttttctttgtttgttttttgagacagagtctcgctctttcgcccaggctggggtgcagtagcatgatctcggcttactgcaaactccgcctcctgggttcaagcgattctcctgcctcagccccccgagtagctggaactacaggcacccgccaccatgcccagctaatttttgcatttttagtagagacggggtttcaccatgttaggctggtctcgaactcctgacctcgtgatccacccacctcagcctcccaaagtgctgggattacaggcttgagcctccactgcacctggctattaaaattttttaacttttacttttggagactggggtctcaccttgttacccaggctggacttgaactcctgagctcaagtgatctgcagtagctgggactaagggcatgtgcyactgtgcctggcttagggaaacttaatcacttcaggaagcatcgtcrtcctaatagcagagttcaggaggatgcacctaaattgacaattcccaacttcggttgacttgctttgtttttttattagtgggagcaaattttgtaaagtacatgagtaataggtacatttctcatagtgaaatcagtaaaaagtgaaaatttgcctttgtcgcaaccttgcttcattcaatgctcttcctcagaggctgagatgacctggtttaacgtgtatctttccaaacccatattctgagccgggcactttgggaggccgaggtgggtggatcacctgaggtcaggagttcgagaccagcttgcccaacatggtgamaccctgtctctactaaaaatgcaaaaattagcctggcgttgtggcaggmgcctgtaatcccacctccttgggaggctgaggcaggagaatcgcttgaacacgggagggggatgttgcagtgagccaagattgtgccattgcactacagcctgggtgacagagcaagactctgtctcaaaaaaaagaaaagaaagaaaaccaaaccatattctgtgcatctctaagtatttatatatatttatatctaagtacaaaggttttttttttgaggggggttgcataaataagatggtatcttctgccatttgtgaccgttttcaaggaatgcatgtcagaagctaaatgctgctgctaaatgctgggggtcaggtgggggaatagagggaagggtatcatcttgggctaacataatctttggggaattmatcacaatttgtaaagaagcccttttagctttttccaagagtggaattaaaaactttttgtaattgctctgcagtgccgaagtgctttccagaaagaccgg

SEQ ID NO: 13332 - DNA, 94510 bp, Homo sapiens
  misc_feature (1)...(94510): n = A,T,C or G, or insertion/deletion polymorphism (see Tables 1-2)
agttcagcccctcaggttagggatggacaccccaggcctagagagggagaaggacccactcagtctcctacataagacagtggaggaggaggcagttgtgagcccaccctcctgaaagcacacagccaagaggcaagaaaccgaggctgggtctgtcctgcttttctacgaacccctgaaccaccttcatcctctcctttcctctgcaagatgaagggattgtgcagctaatagcaataatgcagctaatattaatggtaactgcagataattcttacagagttcttactatgtggcagaaacaaccacaaaggcaataataatagcaatgacttatatagtgtgtacttaagttcttagaagggtttttagtacatagtacacactatataagtgtatacatagttggcyckctctatccatgggttccraatcctggattcaatcaactgcagatcagaaatattcaggaaaaaataattgcatctgtactgaacatgtacaggctttttatcctggtcaytattccctaaacaatacatcgtaacaactatttacatagcatttacattgtataggtattataaataatctagagatgatgtaaagtatacgggaggatgtgtacagattatatgcaaatattgtatcattttctatcaagcacttgagcatctgaggattttggtatctgcaggaggtcctggaaccagtcccccatggatacagagggaggactgtattaattcatcctcacaaatcctacgacagtgtgtggcagccagcctccaagacagcccccagacagacctcctgggagtcacaatcctatgtagttcccttccacatagaatagggctgatctatgtaaccaacaggatattgcagagatgagggagcgtgacttccatggtcaggtcatacaagacattgtgacttcattgctttctctttctttgatctgtctccctaaggaaagccagctatgtcaatgtggacactcgagcagtcctctggagtgagccacatggtgaaaaatggagtcctcctgccaccagccaaaagggacttgccaaccttgtgactgagccggcccagacactccagccccagttaaacctttggaagactgtggcctcaccaacatcttgactgcaacttcgtgagagacccagagctagacccatgcaactaagctgctccccaattcctggcccacagacactgggagagataatacatgtttatttctgtttgaagctgctaagttttgggtaatttgttttgcagcaataggtaattgatagcattaggaaacattagctaatgctaacaatgttttgcagatgagggaattgaggcataaaagtaacttgccccaggtcacacaggtaacaagtcgtttaaaccatggcagtttggatctaygtaaagttcagtaataaattagaatctctcttttacaggaatcaggacactttgcctgctcagagggagagagggaaagagacagagacacaaacacagagagacagtgacatggagaagtgcgccgtgggctcacagtaccatgtgaaggactggggctgcccttctgtaaagtgaaggcagtggagaagtgaagtgaagtgtaagtgaagaggaaagtgaaggatggtagagagcacccttgcccttgcagcctggctgtgtttggcttggggctgctggtctccgaccctggctgggctggtgacacagcctaaggtacctgggggtggaatctggcrcccctgagcagacccctccctggctcttgtccccctgtgctgacactctctgtcccaggctctctctgcctccagaccagagctcctccagggaaaaggtggagtcttgttcgtctgtgtccctcacctagcataaggcctgccagagcaggctgggcgaggtgaacacagaaggtcctctggccctggtactggagaggcatcatcactggggacagagtgagaaccaggatgatgctgtttgttactggaggagctcccattggatggaggagccaacaacgacaggccagtgtgatcagggagattgggacacacagtgccgtgggggcccagaggagcagggaggatctctgtggagkaggcgagaagtcttcccagaggaggaggcatttgaggtgaggcccaaacggtaaacagaagccaacccatgcgggagtgttctaggcagagggcatggcctagcagaggkcacagcctggcaaagttctgaagctccagttcctggggggcagtgtgaaagagtaggctgctggggctcccatggctctggagaccaacatgggacttgggagtggcagggtgccatattgacagcaggtgaaatatcacctacatctgtctcatggggaattcattacattttgggttrggtttgggagttttctttggaaactcagggtaggcagggtctgtaagcttgagtcagcccaggatggagaggcagggtaggggagaaccaaagtcacctgggtggccgaagctttaccaggacctcagtgtccatttggtgtcttgtgtgtttcaaggactgagctttctccctttgcccctcacagaaattaaccagtttatgtgccctgaaaaattcccacttccaccctctgggttcgcatgctggctcagtcacttactagctgtgtgacctctctgctgcttagcttactcatctgtaaaatgggataaacacaaaacctgcctgatggagatgtcgtaaggatcaaagaggaaaaagaatttaaaacatttagaatggtgcctgacccccagcaagtatacaataaatattggctattgttgttattttatgtggttttcttttaactttttcaagtaaatataacttacctmatgcttgttatgtgtcaggycttgtatttatcctctgaagacaaagatgaggargacatagtcctcctaggggtacaaatccttcaataaaggcagaaacaagcattggtcaaatgtgccctgtgccaagaatccagraatgcaggagagcgggctcctgtcctccagcagctcacagagtgacgagggagacagttgcataagcagactgtggcaacacagggtggtcagggctgcggcaaagggaagcccagggactgcaggagcccggggaagtggcccaaagtgggtggaggctgagaggagccagaaggacctctgctgaggggactgttgagagacaaggatttgcccactttggcaactggcatccttctcccttggggaggtcgggggatgcctgggctcagtcttgattctgggtattggaaagccatcagggttttgtgaacagggaattatgtttgaataatagtaacaataactaacatttctcatgcagctactatatactgtatgctgtgcgtacacaatctcatctcatatcctcaccacaatgctgtgaggtgagtactatcacctttctcatttttcacatttagagccacagagattgagttgcccaagttcacataactagaaagggaaggaacagactcagacccaggcagtctcacccacaggcccatgctctccatttctctcttttttccttccttccttccttccttccttccttcctttctttctttttctttctttctttttttttttttgagacagagtctggtcctgtggcccaggctggagtgcagtggcgcsatctcggctcactgcaacctccgcctcccgggttcacgccattctcttgcctcagcttcctgagtagctgggactacaggtgcccgacaccatgcccggctaattttttgtattttagtagagacagggtttcaccgtgttagccaggatggtctcaatctcctgacctcatgatccgcccgcctcggcctcccaaagtgctgggattacaggtgcgagccaccacgcccggcctcttttcctttcttttcttttcttcatctgctgcctctagacttcggcccacatactaatcttacagttggaatgaacctcagaaattccttatctcttccatttcccagataagaaagtgagactgggagataggattgactttcctaagaccacagagtggaggaggaggagggactgagttggataggtcagtttgggcagcaagacgggcttctatctttatcccacagtcccaggcaccattgtgcttgacacagaatccaaactcccagctgtggcctacaaagccctggtgatcagggccttgccaactccctccagcctcacctgaggcacccactccttccctgtcatcaggccccggcccaccttgattgccattccctttgccaagaatgcccttccgcctgatcttcatgggtcaggatccatcttgccattcagtgaaatgtcacctcctctgtgaggccttgcctgatcacctctacagttacccccattgctctcacctgggtctgttttgttttttccatagaagttatgatgacctgaaataatcttttgttttcctgcttttgtgtgtatctcttccaactaagacataactgcaggagagcagggaggaaccttatctgtttccactgtatccttgagccttgaagggcgtttggcacatataggtgaaaggacgcctgcatttcgttgtctgtgtgctaatggtctgtctccccacaggtcagggacctctccggggctggcaccatgcctgattcaccttggtacccgcaggcccagcacagggttggcacagaacagggcctgaaatgcttgctgaatgactgaatgaacaagggacaggaggggtgatgatggcaggagcaccgtgccgggctctctggggatctaagtccctttctggtggggtggccacagatattgccgctgggctgccctttgggggactacggctcaggaggctgctgaggagacagggtggtttccaggccaagggctaacagcacctgcccatccgcgagggaggtgaaggggcaagaggggagggagggtggacctaacactggctcttggcacctgcaggccggttgttttgagtggccaatgccctggaatctcattctctaaagaaggttgtgtgggttggacccggctcacaagtctgaggctgaaatcgaatcccagctcgctctccgcacccattctccccagtgtgggtgaggcgggctgcagccctccagaggaagaggtgccttctccttcctgcagaagacagcaggggcggacagcgcgggcctaggtgcgcggcccctagcggcagggatggcatcccttccgtgccctccccttcccccccgcccggcccgccccacagacctcgtctttctccatcacagcgaggattccttgtcttccctgcgggccccccctggttgcccctctgactaggggcctggagcgtacttaacgacgatgaatagtctgtgcaccaggcccaatccacctgcctcacgtccccatgatcacatgagcgtgcaacatgcacagatgcacatggcacggaaaccaaaccagccacagggatttataatatcccagccggagcccatgacaggtgcaggggtccagccctgcgcccccagcttctccctgctcatccacatcttgggatctcacccctatccctccctcccccgccccacgcgcacactgcacaggcctgttcgtcctgtaacatcatttcccctcccgcccaggctcactcctagacatccctcagcctctgatccgcctgtcacctcctccaggaagcctctgctgcttcctctggacctgctacctccgtggtgaggggctcgcctggcccatccctgcgtctgcagagcccagcactcaggcgagcccagagcagggccgtggagcgcccgctgagagaagagtggacgaaagacaggagggaggagggcgaggaggcggcggcagggggagcgtggggcggaggcggcagcgggagggagcgcgcgcgctggcggcggccgcccagggccggggccgcgcgcccagcctgagcccgccccgccgccgagcgtcaccgaacctgnnnnnnnnnnnnnnnnnnnncggcggcgcggggagcgcggggcgcggcggccggagccccgggcccgccatgggcctccccgagccgggccctctccggcttctggcgctgctgctgctgctgctgctgctgctgctgctgcrgctccagcatcttgcggcggcagcggctgatccgctgctcggcggccaaggtgcgtgcaaaaggtctctgactcggctctgctccgccctagccaccaacaaagcgcggccgggaggccggagcggggaggggtccagaacccggggctatcgggggctcccgggcggacaggctccacgcgaagcggctattcctgaatttgccctcggccccccgcccccgcgggcctcggtgttgagggctctgccctctgggcagcggmtcttgggggaggggtgcaggggggcttggccagcggggaactttgccggaggggcggccattcatggttccggatgarctgtgtgattctcgccgttggggtttatttgacacgcgcgctccgcggcggtaatgagcagagccgggcggcttctccgcttgacaatgcgtttccgcagacccctgcgcgcggcggagagagagggggctgcctgccagggtgatgtgcctgcggctcccactgcgcctggcgcgcgggcgcggggactccctrtgggctgtatctgagcagatctctgactatgggtcgcgtgtgcgggtgagtgcgtctgaatggaggktatacccaggtcgtgtgacactttaagtaggtgcctggtctcgccgtgccaccgagcggcccgacatccacggaacccctgccatcgtgccctccctttggatggagtgtgcctgaagcccccggggtctccataatcgccccctttcctcctccccagcgggtccttccgggtggcccggactgcatggtggggagtggggccgagtccgctgatccagctcacgctccctccccctcgcagggccggccaaggaktgcgaaaaggaccaattccagtgccggaacgagcgctgcatcccctctgtgtggagatgcgacgaggacgatgactgcttagaccacagcgacgaggacgactgccgtgagtggcgggccagggagctcagacccggggagagaaaaggaacggtggggggcaccatgcttggcgcgcacgtggctgcagccgcsgcgctgccacctgcgcgggacttgccgccggagcctgcgaccgggaaaccgcctgggcaccgcctccctcggggccgggtggctcttagcgacccggagcgggcaggaaagctggcgtgtyctggtggggccggggcggagccccgggcagtgtgccggaggaggaaggcgcaccatgctggggagactgaaccggagctgtgggcggggacgcggcagtccctgcaaaggtctagcttcccgaaacacggccctctcggactcttgcctcggccccgcgggacgcgcgcgtgtttcaaagttccacgcagctccgggccgcactgcgctccttttcctgmtcagtttttgtgaatgaatgggctccccagggcccctgattggctgggcgaggaccaccccataggcccccgtggccggagcggccaatcgcggagcagacggatgtgtagtattcsggttccctgggcgcgggggcaccgccctgccctgccccggccccgccccggccacacccccgcgcatatccttagggtggtaggtgcaggcggggctcgggcgccgcttttctgccgagtcacagtgaagacctttttgagccaccctggttagcagaccgcgctttcctgctagccctgcccggctctgagtcatgtggcacaccaggaaggagggtaccaggagggagagtttgtttcctggaaggggcccgagaagcccgaggccacgcgtgaaacggctgccggccgcctttgctgggcgtgcgcgactgatttagaagtttcttctcagagtgcacagggtttcagagtgtctgcgggaccgggagctagttagcaggcagttgtcacggtggaagaaatgtagctccgggaacagaaaaacagggctctcctagagacatagacccgggcagtcattcattcatcattcgggagcatctgctgcgtgccaggcgctggggcgccctccaagacaggccagccctgccagccagggagcactgacggggtctgagggaggagggcgacaggtggacaggcccacagccccacactgcacaggaagggtcacgggacacttggacaggcaccctctctgttgaatcgttttggtttttgactgtttgccagtcaccctcccgttcactttcagacctaacccaaagttggctttgtgtcttgtgcgtggcagaactagactgactgagtctatgtctctagcacatctttccctcctgcctcagtttcctcacctgaccacttgggttcacataattcctgccccagcaacatcattggactgttttgaggaccagttctagaagcgaaattggaagtaatgagactaatgtgtgctgaccattaactgtgccaagcactgcagtaagtacttatcttgtataaactcctttaatcttcataacagtcctattttagagattaaaaaacaaaacaaacaaaccaacaaaaactgaggcactgaactgtgaagttacctgcttagcagctactgagttgttaagtaggagcctgaacttaagcatctaactctagagttcttagtctaatcatgaccctggaccatttcccagtgctgttgaggttatgaaaatggctgtgccttggtaaaatattgcagtgagtttcctcactgggagttgttctgtggtctccttagagtgggagtactgaggacgaggcaaggaatagaaactgcgtgtctgggctggttatgccttatctccctggctctttataacaactgtccttgtgaggatggctgtgaaaagcagaaattttcttgtcattctactttctagataaggatgcctcctcagagaagttgagtgacttatgcaaggtcacacagctcaggatgacagaacttggtcaggatctctgcctgcctcgagttsagggcactgtctgctgaggtggggagtgtggtgcggaaagcaccaggagtgtgatctaggagctggaaagacgggctttaaatgttaggcctggtgcgtttcagctccatgtgaggctttggacgagatggaggagtaaagtagctgggtgctgagtgacgctcaggtgggccaagagagctccaatggccaagctgggctcctgcatggctctgagatgcatggggtagagtcataggcagggagttattaaacaaaagtgaatgacgtcaagcttggagtggaaagggtggcggcgctgctgatagtaccaagtagtaatcacacatggcttggcttttctgagcttgtttcctcatctgccaaacaggggcagctgtccctccaacgctggctgtgcacatagacacacagggctggcaagaagggaacggatggatgagtgttcccacctccacggcctttagaaacggactsctggtagccataaagggaaactgaagaaacggagtggggcttacgtggctgtgttggggccaggtgctggaaaatgttctttcctcagcccttcccgcattctaggccacctgcccagactgaatttctttgaactgttctccctgcaggagagagagctgttggctcgtccctgaggagctctttattaaacctgggatggaggggtgataggtgctgggataacaaaatctgctcctccctgagcagtctccgtgccttacccctgaccaccctctttggcacaccaccctgcaagagggcttgagctgccccacctttgtacatctctgggcctgcaaaatgggggttggaatttgtagatagagtctgcgtgaggcaaaatgagtccaagttcccaaaggggccagaatgcagcccctgaataccaagaggctggaaggagggaacttttaaggaagccaagaaaggcttcctggaggaggagactgctgaactaggcctgaaagatggtaactaatagcattcccccrgagtttaccatttaaaaacaggtggtattgttcctatattatagaggacataggcttggagaggtgaagtgactcccccaaagtcacagagctcctcagggttggagctggaactcaaactgaggccttctaagtcccgagcctcatccacagtggctgggacttggctctttggagacacagatggagcttgcgggatggaagagggaaaagctcctggggctttagttctcagctcaaagaaccttcaaagtggaggaaggagctggaagctagagagccaggcccaaggaagcccagccaggggaagtcgggtgggattcctggctgtgggcctgggtcacgtaggccagctggcccctgggcctcagtttcctgttgctccctagtgtctgggggcagaggcagagattccggtctctggcctggcctttactcccagagtcacaacagtaaccatagcgccgatgaacgctgtctgggcacttgctgtggaccgggcatcgtgctgagattgtccacacatcgcccctcgttcctctattctataaaatggggcaacactatgaagtacctgaaatagtcctatctcatcgaggcacagacgggttacgtaactggcccaagggtgtagaactgctggggtgtgaatgygggtgaccagctatggaacttgtactgtctcaagtactggctggtgacttaggtaggtccttcccaggccttcatttccctgtcttgagatgacatcttaaggctactccacctcgcttcctcctctaggaagttctgtgcttctcgcggaaaggctgggtagacaggtggaccagttttgtgctcactgacctcgactttgttcaggcttctttggactcttttgttatcccagcacccatcacccctccatcccaggtttaataaagagtggccacagggaggtctcccatggctgagagttcattagctgggcaaggccaggctgcaggagtgctgagtcttrctgggaaacagcctcataaataattaaagctcggccacagctccctgcctgtgctgtagcccgcatctggccctcagtgtgcggcctggacgtgtgctcctgacactggacccagcctcatctccttcgtggatggagccatctgacgacagtgtggctcctttctgaacctccccgtcttcacctgaccgggcaactccaccatccagagtcctcctggggctcccaactatccagagaataaagtcagtgtagactcctctgtatttggccctctgtgacctgctcctgttacccacttccctgcaacctcttcccgcctcttcctgtgagcctgtgacaccaaattagcttctgccacactctcaccctcctgctgcttctcacctccaggcctttgtgtgtgctattcctcctgccggacaccctgctccctcactggctggattcattttatcatcctaagagatccggtgcaggtgtcacctcctctaggaagccttccctgacaccccattgcctccaggctgagatacaggatttgagttacttagagacccatgtcaaagtcacaactcagacacacctggtttttacatcccagctgtcgcctcctggatgaatggttgtgaggatgatactaggccctccttttcggagattaaatgtgaggattaaatgaggtcacatgcctggtaagcaggaggtgttcagtgaatggcagtgggtgaggttgttcttggtgggaggggtttcactgaggtctctaggtacctgacgtctggtctttgcaggccaacccggaccccttgcttcccctgctcctgtctgcttagccagatgtcgaggttcctrcagctggtgctcgcctcagccagggagttgcccagccacygtagaggtgacagaaagctgcttggaaaggagctgggggaagaaatgagtcaaacaggcctagggccctaggaggggcagcggatggcttccctctggctgtgtgctggtcctagaggctggcttctgtcctgtctgctcctttcctctyggctgtgcctggggaggagaggagggcctgcatcccccatggcactgcccakcaggccctagcaggccttgggagtgtttgctgaagactttcccttgggccctcccaggtcagcattccccrgtgtgagtcccttgggcctcagggatggttggcttcttcctccccagttgtctgctggtggycgacttgacaactttcctccttggggaaatgctggtagcaggtgaagccagagagagagagacccccagggggcagtgaggagcgagagcccagagggcggatggaacaggcacgcccttgaaggaagtaaatgcatgcatgctctcccagcaccaggttagtggtctactcccaggcccatgctgtcccagggggccagcactggggtctgtgggagggtgtggggttgtgtccttagggttgtggagccaggccttgcagccccaggcctaagtaacgttggtagcacctgccccccaaatgcccacacatccagatcacccaggctctgaaggcctggcagggatgccacttcctccagagatgcctttctagacccctgtcctccagcccctcaggccctgagctcccacaacgtgtccttkttcttcccgcagttgcagatccttctcaacattgtgcactccgccagccttgtgctgggcagtaggaattccaaagtcgtttcctcaaggggtagctaataacagctattggctgcctatatcccatgcctgggaccacgttggacaattcacatcctttarcttcactactcacaaccctgggagggctagtttttcgttctcatttcgaagatgatgaaactgaggctcagaaaggagacggaacttggccaatgtcatgaccattaagtggtggagccaggagctgacccaggtctgtctggtctggagcccagactcttcttaagccgttccccgctgagcgctgtctaccctggtggggtcagaggcyggtgcttggagggtgtgggaggaagtagggagcagctgcaggactcagcagtgcctccctgagctaccagtttctgacctggggagtgggactggggagggaccctgttctctggagaccccgcagagccctcacataggccttttccagctcccatggggatgacattccagttttcataggcttctctcagcctttgcctgttagatgctgattcttcttctgactgtatggaaggggaaactgagaacctgatgatagtgatgcacatgacctcagggagtgtcagcccagggtcatctcttttactctctgtagtaacacrgggcctggctgcctcctcgcacccmggcttagaaaggtgaaactaaggccctgatggtcgaattggctccatcgtcagtagggcaccattctcagaactcaggtgtcctcaattctgggtgggactggagtcagaactgtatgtgcttccccctcccacccccaccctctttgttccctgctggatccgggaacagggtgctctcaggctgaggggtggacacaagccttttgcagtaccgaagggctttgggctcctgactggggacctcaggtgcaccactggccccactgggccctgcttgcccacytctggattgccaagaagtcatctaaaatactcacgttaacactaagaagagttagggagcgagctagtgaggggctttctcatgcaagacctccttcagccggtgccttgaggtatcatgactgcatttcgcagaggagagaaccaagactctgagagatgaagtcacttgccccgggtggccccgctggtcagtggcaggactgggccrtgcctgtctggctgcaggtctgaggcagctgaaaggagatatgcattcacacatcccagtcacgatgacagtaaagtgtggcttgcaggctgtgctggggcctctcttcctttccaggcgtccctctttgccagcacctgctagtgggtgtgccaactccctcctgagcagcccagccccttgggcgccctccagcatgagctgggtcccccggcagcggttttaattatcagccctgctcaccccagctcctctcacaagctgccatatgtcatagactccagtaatcaccccgcagccggagtggcaggggaggggctgagggccttcaggggaatcctgctcagtcttgaccgagttcctcactgactgtacccgctctgacctctttgtctctggtggggcccagcctakgtacccacaatgggagagccgggcctagctgctttgggggcatagaatgcggcatgctctcaggcgccatggagtgtccttgggaaactgagagtcacccagcgagcccagggctgtggggctcatgtggtgcacacagttcccatgacccctcatggcctctacacgcctgccccttggaacgtggcatgtggcaggacagacaccccaaagctgtctgccagtctgtctaggagtccacgggagtggtcatttggcccccatcctcccctggtcactggccttgaggtaccacaggggacttcatcccagccactctggagggcatcttagtttccagccctctcaacctgccgtaatccttggatggcttttccagttggtgcctcacaggtgtgctcctgggaggcaggcggtgcaggagttcattatgatccccattccttgatgaggaaaacgaggctcagagaggataagagactcacccagttattggtagttctggagctaaaactcacttcaactgattttacttatttagttttccagggkaagtaacttctggttagctgaaagtaactttacacttgtaatgaaaaacatagttaataaagaacaggaaacgaaggttgcagtgagccgagatcacaccactgcactccagcttggacgaaggtagttctcacccttgctagtaccactatgtaagcagcatagccttctagagatttttctctgcatgtgagctcttgggcatgaacatatgtattttttttttttaacaaaaatgaggccatgttatgccggttgttttcacatatggctttctatggcaataacagtagttcacatccttgttttaaagggctagatagtattgtattgtgtggatcttccataatttaatgacattttctcccgttgatagatgtgtgtttggttgcttccatgtttttccctgctctgtgcaatgctaggatggacatccttgaactccatccttgtgcatttgcttggtcctttctttaagataagttcttaggaaaggagctgctgagtgtgtgcattttcatcattgccgttctgctctctagaggggagaatctttcccatctcacaactctctccctctatggccccayggctctcctttccagcgaggcaggcagctgaaggacttccctcttctctgagcacagggccacctcattctggtcccatgggacaaagcagccatatccaggccacagaaagcaaagccaggagagagaacaacgagcggtgttctggccccaagggctttcacccccaccaaaaaaaaaaaaaagcagaagagtacaaaactgttccttcattcttctcaggatattggtagaaggcatctcctccgcagcgttctaattcttctatctatgcccctaacttgctgtgtgaccttgggtgaatggctctccctctctgaacttcattttcctttcactcattggtccttattccacctgcactgcccccagcacttggagcagactcctgtgcctggagctgggttcagggctggagctggccagtccttgcctagggcagggatctgtgccttactacctggtgacagtgcggggagtatagctggcttggtgggctggattctgggcagggaaacagggcagctggactccttagctccacttccagagctccaccctgaggcccaggttccttgggtgactttcccttctgccttcttcctgcactcacaattgggccggatgcagtgcagtgatggagaaaaatggagtgaggcccaccagcttcatgagactttccgaaagcgggaaaatgagcccatattccggaggtgtgcgggctgaggaaagtactttgcccagagcctggccctgaaaatgagcgtttcccttcccttcctgagcctgtgattcctgcacagggaatggctgagtaaaaggaaccgtcctcagctttcctcctcctccaccaaggacacaacaagagggcagcagcaaaatagcagcaggagagatttaggtcaactggccagttgggaggacttggctgcctgagagaacagcagctcctcgggctgggagggactgtcggagccatctcatcccaccccatctgcgctggggccccagggtggctgcttcctgagtggcccagtggggctggttagccagccgggcctgccacggtagttagccacgtggggccttggttccccagtgggtccaggctaacatcagagacttggcagctgatgagaggcaggaaggtcccatcaggcccaggttaagctgcccgactgaatagctggaggccaagggtgggctttcctggtggcctgaatccagggacattcaagccagcactcctcccctccctccctcccccacttcctggaccctgagccgccatctgctgccctacactctcagagccctttctcggccatgggcatgggcacatgtgcgtgtgcttggggtgtgtgcttcagaggaggggctgtgtaccaggagggaggtgactattctggacccgtggaggctatggggccaagatgacactcttctcccatacccgctaagtctgcccaaaccaagccagagctccccgcctccccaccaggccgtcgtggtggggaatgatttgtagctggagaggcgccagcagtctctcttcctrgcctgccccctgccacagcagcctctcctccccaggccaygtgtgctctggtcccacccggagagggctgcttgttataaacagcagccttcctcctctgctcccaccttgccgagtggccatttggcagatgcttgcccctcttggggtctctgccccttgggagtagggcatctccagcccctctcaatcccattctgtggaattcttttgttttcccctaagagtcagggattcacatggtgggagtctgccatggccaggccccaggtacagggtgctccaaggagctggccctgttctctgaggcccagggctggaagcatgggggcaggggctgtgaaatccaaccccatggggccccaacaggagacatggcctaaaccacacaactgtttattagcagagcctacatctactggaggctttttacacctacttattttkgtgctgagctctgacggggctgattttttaatacctatgagccagtgagagcagactctacatcagctgcctatgcaacactcttttgtctccctcccctccccattcccagcctgcctctactgcctactgtaggggccaagtggtacatcaggccagcgtggcctctccagcagcagccagacctggcttccagctgcagctctcccacttcctggttgggaggccccggggcaagtcccttgaatggaaccccagactcccgctctgaacaacatgggtaataaataattcctggcctatgtaaagtagcagaaacctccttggccctcagtgtgtgagttccatgagccagtcggttcttcttacaccactgaattggaccaagcaaaccagggcagagtggtctggcagcccatgtggcttgagcccctgttctctctgccacctcccccaccatgccttgccctcccctctggcccttggtctctcccacccttgaagatcctgtgctgatgtctcccctctgtgacagaggcctgatcccttgttgctgctggctaactgacctacctggctggctgccctccaggctgtcagcctcaccttgtccccaacatgccatgtgatctgggtgtattcctgctctggggctctgagagactgaggattagatcagtggtttgtgtcacttggggcagctttttaaattctgccccagccccttccaggcccatttggtgcgaagccagctgggaggtgtagatgtgcaagtccccaggacgggcccctacctcatccaggagaggatctatcacgacatggataacagcagggccctaccaggccgcctggggtcaagtccacacctcaccacttcccagatgtggggccctaagcaaatgacttcacctctctgagcacctgcctcatctggaggatggagccgcccctcaaggtggttgtgggattgacaggtgagttaacttctgaggcacactaagagcagtgcatggtgcatgcgcagtkctcaattcaagattgcctgggcttcttttgacctccttctctgaacctccctctcccatctgtccttcaggaatccccatccttactgggctgctgcactgcggggtggagtaggaggagccagggagcccccagaaagactcctttatctccctttctcccctgccgctccaggctgtcacttgctggcccagtttaattagggagaggccttctagggacctcattaggaaatgagcccagagccttagggaccttcaggaggggtggggtgcagaaggagattacattatggttggccctgcctggcccctggctttgtgccctaaatatgcctaggaagttatggacacttggtcctttagtggccaggacacaggcctgtgacatggtgcatggtcagccagggctgaagggacccatgcttctatctcctactccccctgggctctggcctcacctcccagatcaggatggagaagggtgacagaggaggcttatctggttctgctccacccagcccaggtgcccactgtccccagcgtggctcagagcaggccctggtgaaggtgttgagtgaatggatgtgtgagctgtgggcagcatcttcattaggccaaagcggcctcccccttccatcccagtgcaggagtttcctcagcagcctagtggggtggaggtcagggggtccaatgcgtccggggactgggcgctcacccactgacgaagcagctccccgcccctggactgctcttcctgttagaaaacctgctcttctgtcaatcccagatctgtctcctgcagctctcctgccctctctgatcccagctctgttaatggggcctctgcttacagagtctgcccccaccttcacggcaagcctgccccatgtcccttcctacctgcattcttgccacagcccccatgcttagggaagtccagcctgtgacagctgacttgtggtgtgggctcagataaggaccatcctctctggggccattgctgctttggctcccctagcatggggcctggtggcgtgcacattcgcaggctctataaatgttagctgcatcctgtgacttgcctcccagggctttgagaagtggagggtgaggacagaaatgcygtgcctggaggcaaaggtatcrttatggacagcttgctctcctgggtagcagggcagcagcgcccagatcctgcaatgactgtggcacagcacatagcactggggggctgtggctgaacgtcttctgcctcttggactagkccggagtgcaggcattgcctgggccttgggcaggaacctgggagtcatcacaacccctctcttccttcccccragscctcaccttgaataggggaaggaagaaggtcccgacactcaccctgcctacctgccagcctgggcctcccccgcccctgccacccactgccatgcccttcctggatctcagcagcagcccctgcctagtttctgttctgtcctccaaacccatcttcgctctgcagctgagtgctctgagagatgcaaagctacaccctttcctcgctcagcttctgcagtgaygcccacccctcataggaccaagtcttcttaactgacattcagagcccttcaagacmagacatgtacctstctcctctccaggtctcayctggcactgaccccaagccccaggcgtctcctgtccagccacacctccaagagaagcctcaggcccttttgcatgcaggcccctagcctggaaggctccatctctgcttgtccggcctcacctgacctctggagtcaccatttccagggtgcttcctcccctaggtgggtcagagtctcctctgggctctctcatccttgtgtttccccacactctataccatgatgtcctgatttagagtctgtggttcacaatgcagtccacaagcctcagggggacagggacctgtggaggacggtggaggaaggaggggtggagggtgcctctgggctccgagtgtgcactgtgcccctgaccccttgctaggtttccagcccctcttgccgcacatgactgggtgtggttttctgtgagtccctgggaagcgcctgctgtggactggagcctttgggtcccagctccaacattcactgagggtttgttctgtgccaggtgccctgccagracctggggaggatctacagatgggaaagcaggccacgccctgggggcaccagcccctaacttaatgtgtgaccttttctgaacctcagcttcctctgctgtgaaggggatgaggacccaagacccttccctgttmccttgggtacatctatgctgtggctgggatcagacatggccccgcatgaccctgaggctgcagctagaccagaacttgccctccactgggcctctggaacactggtccaagcttcacaggagcaaggggtgagcagaggttttgctctcttttcagcgaaaacgcccacttcatttgcccagcacgtcagcattgccrtgtgcttgccatgcataaattgaacacggctcctcggctgctcagaactatcccagttttaaaactcaacatcctgcatctcaggaaccccttcagttgtgagcaaactggracacttgaccagtctagctgagcccccaagccctggccactgctctctcaggtccccaggaggtcctccccatccctkgtggaatctgctagctgggcacggctcacttaattaaaaacaaagaaaaaggccaggcacagtggctcacacctataatcccagaattttcgggaggctgagatgggaggatcacttaaggccgggagktcaaggccagcctgggcaacatagtgagactccgtctctcaaaaaaaaaaaaaattagccaggtgtcatggtccatgcctatagctacttgggaggctgaagcaggaggattgcttgagcccaggagtttgaggttgcagtgggctatagtcatgccgctgcactctggcctgggtaaggaagccagaccctgtctcaacccctgcctgccaaaagaaaagactgatttcttcctcaccttttgggagaactcaagaaagaaacagaggatcttggaaggtctggaasagcagggccaaacattctgagtagggagctgtgtggatagggccaggaggcctggccgctgttacagactgcctctagcccrgctgtgtgacctccctccctggcctgtttccccatctctgccctgctcacctcgtatgactgtggtgagaatcataacattcatgggcctgcctgtgttaccaccgccatttctattcttccaggcatgtggctgtctgtctrtgtcccatgttggcctcactcctcccaagtggagggcagcactgagatcgttgttctcatgatgaatagaaagaagctggaggcgctggccacgtgccttgtatgagkctctgcagtcgacaaggcccttcccacatgttgcctccaggctcatggtggcccttgggaggtgggccagcaggaatgactccacccrttgtacagatggggacactgagcccatagwcccacagcatctgactccttaatggtggggagaagggaagccacatgggtggctgggctgtggccgtggcgtgtggtggttacgagtggggtcactggttggctggtcctcttcccctccctatgcccactctgtcgatgtcttcatcagtagggagagatggagacagatggaagagaaggcagagacagaggagtagggagagagagatggggtgggctggggagcacactggggaggctgggggcagggagggtccacgcagtatcgctccttcctctgtggttctcacagtctgtctgcaccgattcctgacagatggagggaggagagagctagtgccaagaggctgtcaccacaggcgggcagagttgggggagggcgctttgtggccagggcttgtgtggggaggggaagcagctggtggtytggctgytgggcctccttggagcccacaccccaggaactgccaggggacaagaaagtgggcaaagggtaagcccgccacctgcctgggactggccgtgcccatgcccctgtccaggcagagacagctacccctccccgctcctcacaccctgctgccagcagggccctccctgtaaactatggattcctcctgcgcacccctcactcggtgttgggggtgggcaggggcctggggactggccctgagctgtgatggrggtggaccagggcagggaggcccccgggataccggagggcatggcagctcagagcaggctggggtctgggtcttgcatctgctggctggagctcagccctcactgtgctaccctggatgtttcccaagccccttttcatggcatagggcctcctgcatttcctccgggctctgaagcatgtgcagggctgggcaggcatgacccggggtcratttggcacctttgtcatctcctgtgtctttatagtatggctttcttcaggcaggactggctttcatgcactctttcccaaccccccagtgcccatcacagggcccagcacagaggaggggcccattgtatgcttgttgaatgaatgaatggatccccctgcttgcatacctcctgggatggaggcctcactcctttatacarcaattrgttccaagattttcagaaacraagttctttctggttcttcccgagaggctccatggctcccaggcytgccacaggggccacacagacaccctggctgatcctgcgtcctcagagcagcgcagaaaagaccagagacctctgagccagcccagctcctcacaggctcctgcacggctgggtctccactgcactaacctctgggttgtcagtaatcataggtgtcacatatggagccctcactgtgccaggcagcatctcattccattcacatcagcctgtaaggcaggtagttctcatcccccatttacagaggagaaaaatgacttcctccaggtcacacggcttagcaggagacagaacatctgagtcaggagggtgggaggtgggctggggtgggctggaggaagacctcctggagcatgggattgtggcagggcttggggatactgggggcttggcaggagggggcaaggctgaggaggggcccaagggcttttctggaggtggaatctgcccctgcccctgccccagcccgtctcttccctctccccatgctgtctccaaatggatccctgacaccaagactccaactggggtagtcccagaggtgagacctgtgawcctggggcccagagcscttcctgtccccctgaaggccagggtgtgrgtatgctccggggcagagctcaaggccgctaaactgacaggaaaggtcagtccagtgatccgagacgtgcagggttatggctgggggcgtggggactcccatctctggtgaagcgtcggggtaggtgggtggggctgggcttcctttctgctgctgctcaaagttggttctgctcagaagcatcctcccattcatatgaataacggcgatcactgatgataaatgaaggtgtgcctgcccygtgccagggctgggctgggtgccctggggacagctgagaggagtcggaggtggaatccatccygagagcaggggcacagctttcaccacctttatctcatccccggagcctgacacaggctgggccctcagggggcagcttagtaatgccttagtcattgaaaaacagggacctggcctctctgacgagatgcccactgtccaagggtacactggtccacagcatggccccgcagcctgacctctcccctcaccgtggctctctggatccttcraggggctcctgccagtgactgtagtgggtgactggagcctcttcccccaacgtcacacagcatgtgggctggatgagccacctcccctctcagtgtcttggtttcctcttctgcacaggggcgtcttggcaggccctacctcaaagggctgttggytgggaagattaaatgagatgatgagccccacgcactatcatcaatgacgcttatgcttatggggagtggggtgggaagcacctctgctctccatgcatgacttcatgaattctttttttttaaagatggagtctcactctgtcgcccagcctggagtgcaatggcatggtctcggctcactgcaacctccgcctcctgagttcaagtgattctcttgccttagactcccaagtagctggcattacaggcgcctgygaccatgcccagctaatttttgtatttttagtagagatggagtttcatcatgttggccagactggtctcgaactcctgacctcaggtgatctgcccgtctcagcctcccaaagtgctgggattacaggtgtgagccaccgtgcccggcccatggatcctttaacagccctctgaggggggatctgtcctgtctctttactgatagagatggtgaggcacagagaggtggggaaacacccagggtcacgtagcataggagtggcagcagcaggatttaaamgygggtctcttgcactccaaggtccacgtgttagccagtgcaccaggcaagggataaaggacttagtgtgagagctcctttggaattggagttgcagaggctctggcttcctgtgctgatctcctgcaagcctccagcccccagtcacgtctgtcagcagctctgagagccctccttgggcctctcacctcccacatgagcagggaatcagcaggcaaggtccgggcggtgaggatgggggatttcccgactcacttgagatccgtcacattaatgttaattaagccttgttaattcagccctctgcttacacatggctcctgacagcaaattgctcataagtgaggcagtaaatttattgctgctttttccaaacatttagcagcaaagacggtgccccaggaaaggcagaggagagacctggagggccagtgatgcttggttcctgctagcctgaaccccccaggatcctcatggcctagagaataaggtggggctccccaggagacctgggtgagaatgaaattctggcctgctcggagcatactgcctggagatgcggtgagcactgtctcagcactaactctctggtagctctgtgctctgtgaacatcccgttccctgygctgtcctcccacagtgccttgaagtgtgccctgcacagtagggctcagcaaaggtgtgtttggatttggatgtgcagccccgagcccacctccatgtcaggaaagcctcgctgcagtgcagtctgataggagagccagcagcctccgcagggactgagcgccctgcatcctgaggtgtgcacctggggccagaccactccgccagggctgctgggaaggggtctctccctgtcctgggtcataggagcactgttggaaccaggatcaggctcagattctgggcctgtgaccccagccccttgctaggctaggtatctactcaccaggtgagggggaagcctctcctgggtatagtgggacaccctcgtcctaggtcctgcttcccgccttggcctcagactgggtcgtgcctggaccaattgaacaaacccaggctttgggtacctagaattttaaaaaattaattagagcattaaatggcagccctctgggagaatcccaccatctggctgtcatgggagaggcaagaaaatctatgcatatttgtctgcagtgtgtgagcatcatatgaagccaactgtgcatgtgtgggtatgcggtctgtgtgctgcagtgtgtgtccagcatgacatgcgtgtctgagtatgttcagtatgtggcgcacacctgagtgtgcaagtgggtggtgtgtgccttgctgtatgcacgggtgcccatctgcaagtacatgcgctgtgtgcatgtgcctgagtgtctgcacgtctgtctgaacatacctctgtgtgtggtccatgctcaggcctgcctttttggtgcagtgagccaggctgagctgtgtgcagatagggaaggggctcgtgactcctcctggctgaggtggtgggcacagacagctgtgtagaaggtgggayggggtaagtgtggcaagtgcacagctggccttcagtgggtgaggcagggcaggcatccttgccctcatttgacagatgggaaaacccaaaactggagccygggctctggggctccctgcgtggtgctctttctgttccagcgggctgctgccctggctggcacctatgcttttggcatctttatgctgttagattttcatggtggctcaaagtggttctgagagagtaccaccccccctactcagtattgctcagggggcaaggtcaggattcccactgcacatcctgtgttcttcctgtttcaaggaggagatatcagggctgctggagaatgctgggcctgatagtcctctgactgctgtgtgacctgggcccatcctgtccctctctgaacctcaggggtgattgtaagaactaaatgaggagacatatacaaagggcttcgtaaaccasgagatgaggtgaggtgatgtagacagatgagggcctggcccagagatgrcatcacaatacgatcagagccaaagctgaggcccaagttcatgtgtcccagggtttcctgaggagcaggccaggaggtgggacccaggacagaggcaggtgccctcccagccttgcagactctgaacctgtcctcagaaccatctgcctggtgccagcactctcctccaactccagccccagacacatggctcatggcagtgaagtaaagcaggaacagacccagggagcagtgggatccaacccctcaactggtgttgacgctgaggcccagagagggggagtggcttactcaaagccacgcagcagctcggggggtagagctgggaccaaaacccaggcctcctggcccctggctctgttctccttggtaccataccactgtctttggcaagagaaagaggacacaagagctagttcacatgcctggagaaaaggatgtgggagtgccacccagctagacagcactagaacagaccagagccccacttcctgcatgaatggaggatctgaagcaaggcttcaatgattactgcttttcctaggtatgcagaatgctggagggtaaatagggtttgtgtcctgggctgtacattctgtatagatggaaaagccccaggcttccagattgcctrcatgcgatgccttcagcacacgcttcctcagtgcctgcctccaccgagctgctagtctggtagagaaagatggttgagtgccaccaacacaggatgatgaggctgtggatcagaagaggtctctgatcccacatggggtcgtggaaagcttcccaatagaatagagaaggggaggagggtcctccactcccaactcccagagagtgaggaatgtgtgygcctcagacaccctggccccctggcagtctgggcctcataagagctcatgcttgggcaggctcaccgttcaccctggartgggtggctgggtgccttccagcttcctcctcagcgcctctcctgtgccagggcccatgcacgtgggtggaggagaggccattctagaggcccctggctccctgtggggctgaggagagactagtgtgggggcaggggtggaggtgcagggaagctggtggccagacctcctgtgacctccactcattgcctgtgtgtccaggtgggccagtctcagctgccccgcttggcgttataaccattgtggtgttagccagggacgaggcttctgaagtagcctgcactgtgagccccgctggctgccaggtaataattccacccgccttgacctttttctccaaggaacaggccttctactttayacatggagaaaacaagtcacagaagaaccaggtggcccaggatgacagaggctaggcctccagatgccctttaaaaattgcaacaaaaacctcttaaggactcactgtgtacaaagcctggtggtggggctgccacagcggctgggataaagggaggaggaacttcggtcactgaatattttctgtgtgccatcccttatgtcgggcactgatagacgtgatctagcaaccaactgccctccgagtcaggatctaccaccacatttttaaatgaggaaacatgggctcagagcggtcaggtagcctgcctgaggtcgcttagctagtaagggacaaaggcgtgatttgagtcctgcgttccttcacctgtttttgtgggagaatggccatgtcaggcagcagactgggatcttccaaaccttagttctgggaggaaggttcacttgcaggaaaaaccaaggtgagtggaatcatcttcaggcagccagcagtgctcactgggcaggctgtttaaaagtggcttcctcttcaagctgtagtgggacctgtcttactgggggagccatgctggctcagaacccctaggctgatgggcacccctctgtaaggggctctgagaagtggccggtgtggctgaggtctgggccaggatgccagtgggcggtgagggtttgctgggcacatgaccccacacctttcctcttcttgcctcccacagccatgtctgtccccttctgcccagctctggttggaggtgctgagctggggcttgtggccatgaaccatccccatactgctggccctggggctggcctcagatgggtgggtggtcccggccagagccctgaaccccggccctgccagaaccaacacctggagacatggccacctccgaaggtcttacctaactgcagggcgtgccagcatctagcagggtccctcacgcacagytggcctgctgcttgattattttggcttccagcagcagagacctgagactttcccggtagcataggagtcagcagaagcttggccttcccagaacatgggaccagaggaggtgtcctggacagggccrggtgaggggaggctgctggtggcccctcactgagcctttctgcagtgggcctggggaccccctctgccctgagcatttgccaagcagtccagtggctgcgcgtgggcctgcctttcctcccccactttggcatggctgtctcccaggaaacggggaattttccctcattcccatcattagggtgccagggcaaacaaacagtctaatccagatgagccctgggccacaatcacactctctttgggggttttctcttcacttggagcaatgttgagaaggctggagtaattggtattccacccaggttaatagaactgctgcctcctcggtattatgccttaatttcctttatcgctcagcaagttggaattcatcgcccctttcctttctttttcccaccgaaacctatcaccagcctgtctgctgggtaaagtcatttcatggcagctcttggctcctttccacttccctgggagtctttctgaccgagccaaagaacaaggaggggtgaaaaatccatttgtacaaagtggggatctcctgttgagagcttatttccctccccgttcaagaggaaggaacgtgttcagcctccagccagcacggctgactgagtcccctgtcgctgagagcattcaagagggcgaatggccatatgtcagcggtgggaacagaggattccagcactggtgggggttgggggaaaggggcaggcctttgccactcctggtgcctggattagattagaagcttctagggttttgttytgtttgtgagtctaagatttgtgatttaaaactggaaagattctgtggctccttggtcctaacgttcaacggaatgagcctaagtacttgtaaattgtgtgttttacgattctcagatcctgagacagggagattctgttctgtgattcgaagactatcttatgattcctccagtctcttcagcggcagttttgttcctgactgggtcttgggaggagtgcaattgctttgctgaggttgccatgggagcgcgaggctgctgtggccccttttctcatgtatgaaatccaagggctgggccacatggccctggggcccaggtgtgttcagcctgcagcccccttggctccaccagagcctcccacaggccctgtgaggactggctgctccccaccacctcactggacccagatgcttttccagctaagccatgccccttgcctgtctgcccccggccctctcccattcgaacggggaggcaacccagctctccccaaagtccctgtaggaaagctggagcagtgggggagtggtggtggtaagaaataagccgcatgattgacaagagctctacctgcttttgtggtgatgtgcaatttcaccatgaatttcaacattacaacctctcttaattcccaccctctgaggtggttagccccattttattgttgaggaagctgaggctctgagaggttaagtcactcacctataatcatacaggttgttcccaggccctgactctggatcacctgctgtagtacggctctaggccgcctgggcagcatgatgaaactgtctctacaacaaaaatccaaaaaaaaaaaaaaattagctgggtgtggtggtgcacgcctgcagtcccagctacttgggaagctggggtgtgaggatggcttgagcctgcaaggttgaggctgcagtgagctgaaatactactgcactccagcctggccaacagggaaaccctgtctccaaaaaaaaaaaaaaggcattgattggcccaaggtcatatggcttgaggcaggaccagaacccaggtcatctcattcctaatgcagtgcaagcaaaggaaaaagcgagaggtggacattcatcatagagtctatagccaaactgaggaacaaaaaccctgggtgtaacagccacaacccagaacaaaaggagatgggtcttggttagactccggggtggtgacgtcactcatctcccctctctgggcctcagtgccccggctgtaaaacaaggacaccgaccttggtggtctccaagcccacatcatgttaggttccggtctaacgtgagcccgaggctgggaatctgcttgttgggtgggggttgtggaccacacgcttacacctccctgttggaaccaatcctggggcggttaaagagcttcagagaatggrccccatttccttccaaacgcactgagaagccagaagcagccttctccatctgctttcagaatccaccttttccttctggatcaaacatagttccctcgggggcaggcttcctcagcccctactactgccagccaaaatcaccccctttctttgaggaccagcttaaaatgtctctcttccaggcagtgagccctccccaggcctgcctcctctccctccagcagaccttactcacaggcaagggagatgcaggcttggagaccaccaaggtcagtgtccttgttttacagctgaggcactggrgtccagagaggggagatgagtgacgtcaccaccccagagtctaaccaagacgcatctccttttgttctgggttgtggctgttacacctggggttctcctttcctcagtttggctatagactctctgaaggaaggtccacctctcactttttcctttgcttgcacagcattcgggakgaaacaacctgcgttctggtcctgcctcaagctacatgaccttgggacaatcaatgcctttttttttttttaagacagggtttccctctgttgcccaggctggagtgcagtagcatgatcatggctcactgcagcctcaacctcccgggctcaagccagccgaccaccccagcctcccaagtagctgggactgcagatgtgtaccaccatgcccagctaattttttttggtatttttgttgttgtagagatggggtttcaccatgttgtccaggctggtattgaactcctgggctcaagtaatctgcctgccttggcctcccaaatttctggcattacaggcgtgcgccaccatgcctggccagttcatgccttttaaggtctttgcttcctaatctcttaaagtgggtggtggcttctgcctcacacccacctcacagctgccctgaggagccaggccgagggactggggatggagtctcaaacctgtcactcaactccayacccgctaaggacccagggccagtctgctagatttctcttgggctcagggagtatcccaatcagacaattcccttgttccccaatgcccccatgatccccacctctgagccgaaggttctcaggagcccctggcttcagggcccttccactctctccattgagcacctgccctgagccacgtgctctgctgtccgcatcacccagcarcacacctgtctcccctcccggagcgggtgctgactacactggcccacaccactccaccccaccccccacacctcgagcaccctccttctgtccctttcactctcaccttgtgaggtaacccaggcaggcctttgaatggtacacatgaaaacctgactcctccaatgtctaggtgaggaggctgaggcaccagagggtaaggggcatgtccaatgtcaccccagaggtcaagggcagcctggaggggtagccagggctcccgaggcccaaactactgagacggtctggaacccaggcagggctttgtggaactccccagagaagccctgtgaaggrctttctcacaccgagggcccagctttcactaggagactgggaagggtttgcatctccctgagccctgctttatgacagtggccgagccacgtgtcactggcttactgagctgctgggatgacttctgagcctagtccggtctggtggatggctcctgaggtctcccctggccagtggggccgcagatcttcatctcagcactgacggccagggtgggcacagcctggaaggggcttcccgtaggcactgcctgggtcggtctgccaaaatacagcagcaaaataagcaccccatggagactcgagcttgctaacgtcctacctttggtgttgtgggccctggctggccctgggctgggatccactcatttctgctctgtcagaggtgggggcatttggatgggggcattgtcagacaccatgaacagctgatgcttgagctggccatcaggggtgggagagttttgcccatggaggtggaagaagggcttctggcctgggggagctgcgtgagcaaaagcacctggtatgaaggccaatggcttgtccataaccattgagtggttactggaggcaggtgatggccagggatgggccagagcagtagcagggcasgttgaactgttcctgagtgccctgctaaggcagttggtcatattcaaggggagatgggaagccagcaggcaaggaaagatggctctttgattacggagaggactttggtaggacagtgactactggctctggatttgtagcccctggagccacaggagtggactgtaagggactggggaccaagccacagttccctccctctgtcagcccactctgggcctggtggtgggtaaaaccatacctaaaaaggagaggaacttagagcttatctcatccaactcaccatgccatgaaagaagagagcaaggcacagagaaggccagagacttacatcaaggccrcagagcagagccaggccctccaggccaggagtggcagayggcccattgctaacyccattctcagtgagatattcttaacctctctccagaaaagccagcagactccctgcacaggcctcagcgatatcacagagtgatactttaacctgcagaccttctgctgggcacacaggtgggcacaggtgggcagaggctccctggatgaccaatgtgaggctggggktggcagagagctcacaccagcctcctgggcacagcctgccacacactccctggtgaggagcccagagcccagcacagaggagcactccagagaggcagcagtcccacaccaggagatggatttcccaataacaggtgctgcccatttatcaccgggatgggccagtgaggctcctgctaggaaatgcttctcctaccagcctaattggtgaaagcatttgcgtttttcactagccagggctgcttcctagtgtgtgcagtctctacctggtgggcagaggagagggtgctgcarcgacccactgctgacatcagaggcctgagtgccctgcctgcctgtgggtagcagccagggacccgccacccctccccacacaggcaggggtcatcactgaatcatttgctccacacaggcagaggtcatcactcaatcattcgctccacacaggcaggggtcatcactcaatcattcgctccaccagaggagtgtctgcgcctcgtgggttcttgaatccctcgggcctggcctccttggccctggctgcagagttctgctctgggagccctgagcttcccacttacagttagtgggggccgagagcccagagaggcctgycccttgtcacacagcgtgttggtggcagagcagggctggaatgagatctagaaccttctcctcaactgcaaaagaagmagcggaagagctgcccctccttccctcagagggctggtggcaagaacagggcctggaatgcaggggtccttggcaagctccaaggtcagcctgcccaagggaggcggagctgtggacccatcagccccagggggcctggctggggttagccaggaaggtgccctggtcagaggaggccacgtttccactggggtaggagtggaaggggaatgtgaggctgggagcctggcaatgactctggctggagggcctaaagggtctcctggccttgccttctggcctctggaagcttctactttaagaatgtcatgagttttcttctagctgtttctctggaacccacaatcccagtgccaaaacccagggtggggctggctggagcctgggagagggcaggaacgtggtcatcttctcagcgtgctgcctgctctcagcagcaccccttgcgtaatgcttggtccctttgcaggcgccagccagggacycctgctgatccmatcctgcccacctctcccccatacccacctcctcccagcccctcagctgtcactcgttcaatacctcctgcaaccacaaatcactgggacaggaagacgcctttgtcggtctgtccctcggagacgctcttcttccctgtggtgacagggaggcctacataccccagcaagggcttgggcctcccttggtgacagtggggccagggtcyggcagtatctgagagcagctgggatgtactggggcctggaggaggtgcttggttgtgggaagccccagatgacctctttggaaggacttggaacagcaccaagatccacaacccctccgtgtsacggggtcactaatccagaaggtcagctggagggggcccttagagatgtgttcacctgaggaaactgaggcccagaatgggaaggggtgacactccttccaccgctgggggccctgctgctgcctcccattttgtctttcctcrggcctcctgatctttgcaacctcattttcatgccttggtgttttggrgcaaaggtggaccacttgtttcatgtttggaccacttgtttcttgggaaataaatagatttatggtcttaggatctggcttggttagaattgtgtaactccttagtggaatgggttggaggagagaacccagaaaattttgagggaaactcttcccgatttgraagcaaagccgccctcaccaaaaagtgctccttccgctgcagcctcttcattccgaatggggtgaatcctttggctggagcccttcgtgtgtctccctcctcctcagcacctgcagcttctcagtctccccaggtgggatgggaaggtgggggagagggcgaatttagatgtcgcctgctgatggatgatggtggcttgagccccagagcccgctgggcagtacaaagccacrcaccgagtcccgcccaccacacgcgggtgctggcycctgcaccctactgtcaggacactgtgggaaccgttcgccttctgggaaccgccgagccttgagtagtcagagactgtccgcatgtggacttctggactcagataaacagttcctttcagggaaggcatcagaggctgccatccgcagcttatcgacatctccgactctggcggtagctgtcatggagtcttgtcacaggggcttagggtgcaaatcagagtgttacagccttagaaccgtaggtccctagagtgtcagaagcagagccatgtggaagctgtttgcaatgttataatggacccacgggatctttaaactgagggytttaggaacatcacatgtccagggaggggttaggatttgaatccattgctgctggaccccagatctgctggcgatggaggatttgaatccagtgctgctggaccccagatctgctggcgatgggctctgggcatcacccccaccaccacttccaaccgtgcagctccattttaatctgtcttatatgttgggggttcacttgggaaaagggttcctctgcttaaaaatagttttccaggccctgtgctgagccccagctccatgccaggacccgccacagcctgagagggtggctctggtagtgggacrgccgtcaggccagggcccccgggtggggtgcaggttgctctgggccacggtctcctccccctctcattactgctctgtcgttgctgcagccagagaacactctgggtctgtcatcctgttgactggggtgacagtttaatagtagcttcctggactgtcatttaaatctgcctgccaggttagtaggccaggggcgggctggcacgccccctgcccccaccccggatctgcattctgctggaagckgtcgtcttggcaacgctggggcatggcgagctctgtygaagggtaactgttggtgggagcagccctttcatctccccgacccgrgtacaagtggcccaactgccttagggccagagccaggccaccctgtgctggcccaggcctgggagaggaagtgggaacatccaagtcccttctgtgcacccagctctccaagttaggggctttacctttgctctcagcctctcaactgccctaggaggggaaagaacctgccccagcttgctgaacaacaatgttgagctggaatccacctttcttaggggtcgctgctctgccttcagagaacattctctagagcccaagacctgtccacagaaaccagagatcagtcagagcctgtaaggctgacagctccctcatctccctgtcctaggwggctgggtatcaattctctctgttctttccagggcctttctctagacgtgtccmtgctctgaggattggggtctccagtggggtccctgcagcttcactctgggctccatgctctgtgaacactttgttctattttttatggcctagtggggctggcccagagacagacggctaagtacaactaccaggctgctgtgtcaacacgggctagtccctcccttctctgcacctcatctaatcatctgtaggatgagaggcttgtgccccagcagtgttttcctaggtgtggttcattggaccacttgtttcttgggaaataaacagatgtggcatctgaaaaaggagttccttggttaaacaagcttggaaggctggaggaaaccgtcaatcagatatctttactgcagtccttcccagggcctttataaaccgtgggcatcatgcatctccaagggggaaaataataagtgtctatcccaaatatcctggtgcatggccacccctgggctctgtcctgccccctacccctcccctcctctgctaagggccgattttctgtsttgcatggcctcacgaaatcccaaaggaagctctggcagcctggagccctgggtttttttggctgctggagagcagccctgtgtttagcaagaggctggatgggtccctgggcaagctcaaggaaagccaggcccctgtgctgggcctctgcagggcagctttgtgcacaacttggtgaacaactccaccagggtcaattgttccctggcctggtggagctccaggtcccttgccacttgccttgtccccagcccctaatggtcactctgctcgctcctccatgcccctaagccccattatccttcctcctggaatgctcttccctgctctcttcactcccacagcttggctgactcctcttccttgaacacagtgcccctcctctgggaagccttccctgacccctgggccaggtcaggtggccctcgcctggcttgctggctacaaagtgggattgggagtcattacctgggttcaagtgcagccctcccacagacatgtgctgtggctttgagcagtcacttctcactaggccttggcttccaggcatgtaacatgggagacccacgtagggggcctcaagaccctggagtccaacacggcaggacattcggattgccaagaggaagctgcacagagcagtgcccctgggcagcccggactaatctttattttggagccttctctctgcaccggggctccacgatgcgtgtgggtggggagcagcatgggaaggatgtatactgtctcagggaaggatgtctctggaggcgggggaagccaagaagtgctgagtgattctaacagtttcacaggatcacagacactgagtgtggagagggccttaagacttagtcagcgccacacctccatttcctgatgaggaggaggcaagctcagaaggtttgacggatgggcccagtgttacacacacggcagctggggccagggctgtgacttcacacacctctaacttgcacctttttgcttctcagttcataaagccctggggccatccttagcttatttgcttctcacaatgaccctgtgtgtcccgtgaagcagacgaagaaagtgcggctcacaggagtcctgtaacttgtgtaaggtcacatagcctacaagtggcagggcgcagtttgatagaccatggactgtctggcactttccttggcccgtgttcttgttataaatagcatttcccacttcctttgtcctggatttcccactctcccctactctaccctggggtcagcccctcctcactgcccctagaatcccctagtcctttgtggcagcccatctgttgccatggcaccagattatgatgtcgcagaccctggttgactatgtatcactcctgggctgagggactcacagaggtgggcattgtccaaggggcagactggcatggggggacataaatccctggaaacagggagccatggccttgagcccagctggggaatcaccctgggaaccagagccaaggccagcagagtaggggtctggcatggctttctctgacagccttagaatggcggcacagccctcatctcatggcagggctgatatggtctcttcacgagggactattgggctcattgcactgaacggcctgacactgggtgttcaccaggrtcccccagaagagtctttttgccttttgtccttgtgacaaagctgcatgggaaagccacatccccacttgcccaggttcaccccgaggtggctatgccaggagtcagtctccactctgactccagatccttccatatggtcacacttccaatggggccctccagcgtgctttagtctagtccccaccctgaaagtgctgtccattagcagagcaaaagccgtcccaggcctgggtttattctgctgcacacttctgggcacattccaggagacctgagagatgtttcagtacatttgaggactctctggggtcctcattcttagcctggtaacactgaggtggctgagggtctgagtggaaagagatcaagctttggcagctgccacacacagttgaaatcacacttctgccacctaacacccttacctctaagccttaatttcctcttctgtacaatgggattaataacaacagctaccaagayagctgtgaggagtcactgggatattgggtgaaaggtgccaggccagagcyagagtggaaaatctccaagctggtccagccagtgaacaaatctgttcccaaaaacaccaccgaatctgttgccaaaaacaccactctccctgcagctgccatttcctgggcggggctgacctcaaagctgccctttgggacagcagtggtgtttttggctgctctggcctccttgcccagtgcctgccagggcttggcacatggaggaggacaagatcacccccaggctttcagaatcccagggagggcagggtttttggggggtatctggttgtcctgtgcccagcaacagagccccatcatcaccttcttcaagcctgccctgctgttttgggcactgtctgaccacacatccttgccagacttgcctacttgctcttaattcccagagactgggctgggctgattctgtgttctcagtgcagaacgtagaacagaagcaaggttcattgaatgtggaactgaagcttgcacagggctttcccacctgctgtaaggtttttcttccacatttggtactgctgaatgtttgactggggagccgtggtggagatgagcaggcatctgactgtgggttcagactgtgaccctgctccccccagctgtgaccttggacatgtaacttaacatctctgggtctggatttcctcatatgtcaaatgagtacatagcaggccccctgccatgaggtttcttgggtaaaaacacctggcagagactggcacagaggaagcacctagtgagtgttagaacgagaaaaagagaaaactaggatatacgtttctttttttggatgctgagcttcttgtggggggaaaaccactggtgttcacattaggaaattccccaggtgctgtggttcatattggtacttactttaagatgattatggactatgatttaccaataggtggtattcgcatctatcattgacgatgacctctcagtgcaggaaacagggagggcctctccagagccctgggctgagaggcaggagagctgttcttatccctgccatgctgtatttccctcagccagcccctttccctttctgggcctcaatctacccatctgaaggtggactctgattcctcaggtttcttctagttctgcacgtacagaggcattcttctaagyaaagtgtgaagaaaactcatcttagaatgcagatgtactgcaaagattccactgagaaggacagacatggaacagattcagagacacagtctctctcaccaaatccttgccaggctccccagaggagggggagcaggcctgcagccccagaagcacccagagggcctgtgggtagatttgaataaaggtggtccatgggagtggcttcccagggagaaggcaagccccagaactgtaagtatggagcagaggctgggkggctgtgctcgcatttagctcagtgtcccgcactgagacctaccccaagctggattcttgctgaatttgacagtctctgtgctgcagggacagggaagaaagcaaaccatgttggactcgcaatcagtgatgatctagagcagaggtcatcaaaatacaggccacaggcctggcctgtcaccagttttttgtaaataaagttttattgaaacataaccatgctcactcatttatctaatgtctctgactgcttctgccccatagtggcaggattgagtggtgtgaccgagaccatttggccctcaaagcctaaatagctactatctggcccttcacagaaaaagtktgccaacctctgccctagaaggacattcaggggattgtaggagctcaggagaggctactgatcaagactggaggtgatacttaagcccagtgtgtaatggaaagaaggtgagaggtgggggaaggggctttcagactaaagacagcttgggcaaggtatgatggtataaaaagcatkgagtatatgaggacccaccggcagttgaggtggggctagattgggaagtatgaggaggggaagatgagggagcggggcaggctggggccacgggacttctaagcccctggggagaggccacatcctagtggcccctgatgttaaatccatcccaagctcattccaggggaggactttggtggtcygagcgccccaaggcctggggtaagtcactgctgtgctgaggtatcctcttttrggctgaaaagagacccccctgccgtcttcatttctgggcctcctgrtctcgaactaccacacctgaaagcttatctctcaccagatcaccctctcttttcctgatgaagaagctgtaggccagaaaagggccatgatgtgcttgaggatacagagcaaaatagcacagcagtgwctcaaatccagacctccggactccctgcccagtgctctcttcctcaccttgttctgtagcgggtcctggatgcttggtccagcaggaacagggcatgtgtgagttcaatgcagatttgatgcagatgagcccccaataattcagaggcctagggctgctacagagggtgcaggatgtcakgggtggagcgctcaaggccccttcccggtctccaacacccccrcacccccaccacctactgggggtagccaggcagcctcagttcccccatggaagycctgacagggcaactgctctcccccgggcctgctaggtgygcccagtgctgtgctgctgcttgggaagaagctggggcaccttatgacatgggcatccatctctgtttcctctcattgatctggaaactctagttcctcgtaggacaagacacagaaggcagtaaagaaccgggctggggatggtacctgcattcttatctcagctccgtaaccagctgtgagctctcagcctgctacatcccctgtgtggacacagaaccccattccttcagcttctaattaagactcaaaccctgaaaacaacagtagctgccacttctccagcatctgccatgtgcctgagtctgctgcaggttcttcatacattacgacttcttgttgctcctcctcaccgccttttgtcttcttctccctattatatagataagaaaatgtaggctcagagattaaggaacatcctcaaggtcacacagataggaggaggaggaggaggagraagtgggattgagatccccagagcagtgtggaggtcaccctgcaggctgtaggcacsggggggcagggactgatttgggtgtcttgcccagtagatcctcttccgactgctctgaacacaaaatacgtcattcatcttgccacaaaggaatcatctatgtgtaggattcatgatcacaaactccctggcgcctgcagaagggactttgacttccagtccagttggggaaagtgggacaggcaggtaaagagactgagaactggctgaaggagctaaggcagctgctgkagggtatcagggaaggcttcctggggacagtggcagtggaactagacattgaggggaagcaggagtgtggtggggtatgataaatcttgtcatgcttgctgggtttgagctcttggacttggagggcagagcagaatgtcacctgtcttcacgcagtgttcagatgcctaaggaatgaagaagcttgtctctcctgtcctctgcccttggtcagcaaggcagtccatggcctggtttgcagaccaagcacatcctggtcggcccaccaccctcctgactgctcccaggctcaccacgctctcttccttgccctgcagccaagaagacctgtgcagacagtgacttcacctgtgacaacggccactgcatccacgaacggtggaagtgtgacggcgaggaggagtgtcctgatggctccgatgagtccgaggccacttgcagtgagtcctgcccctcagtctgggtgggggtgggcctcagtttcctcctcagatcttccttgagaggctgtgaggctcaggagaggtraccagttgaacattctgtgccaygcactcagggygctcctggtaaacagatatatttagttgctggtttctactgacctgtttctggactttcttcacagccctcttgtaggttggaccctgtttctgtggcagcaggagctagaaacagccctgtcaagcccttctgcccagaaggagccctagcgtgtcctccaggcctccctgctgctgttcttgaggaccccgaccataattccaggagtgccagtggcagctggygcttcttaagcctttatcgtgtgctaagctctctgtgtgcattaatgcctttgataaccacagcagcctcatgaagcagatactgtcattttctgagttttgtaacggagaacactgaagctcaaagaggttgagtgacttgcccaaggctacccagccaagactttgaggctctggcccgttcctctaccctgggtgggctgagcctaggagctcctgcctccatggccagctgggtggtagcagaggcaggcagggggaggtagaggccagagctgagccccaggcctgccccctacactcagggctttgtctctccatgatttattttccaggccctaatcctcaaagcaaacttacacccggcaggtcattctgtgacatttgttaaattaaaaaggagatgagaagggggcggggaaggacccagcagtccagaggcagagcttcagcagcgtgagcccgagacaaaaggctcaggcaaaagcatgtggaggatagtggggctggcggggacccaggagcccctstttaggggtaacagtcgtcccagaggcagaggtggggacaatggagaccggagtcccatctaacgccgtggctggtgataactgggtttccttgtctcctagcaacagagctaccagtctccacataagagaaagagaaagggagagagagagaacagagcaagagcggcccccacccgagacaaggagccctcatttcctcgtacagctgctcctggcctccccagccatgccgcaggccccatcctttccttacmcaccacgtggccaaactccatgccgtcctgaaggctcccaggcaggagggaagcccagtgctttgtcctgagcttcagaaggaacaaagccctgccacgcccacttgtgactttcatcctcttggcaacctaaggaaggaggaggatccccatgtagagagaaagaaactgaggctggagtcagttctcccccttgcccaaggctgcscagctaacaagaggcagagtcgtgtgcagcctggagtgtgtgcttggggagggtttgtggccacagggagcttttccctcactgcagtcagccagctcctccatccgtacctcactccagcagatactccgacaatgggggcagaaagggaagggagaggagcctcatcgtggttatyagagggggctgccttgctacctgagggctaggctccccttctccccctgccccacccccacccccgtctctatctctttgtgtggatgtcccttttcatcttccattctgtccccttcggggtcccgcccacccctgccctcttgggctgcctcccttccctgctcatctcctatcctcaccctccctctcaccatctcttctcactgccctactcatgtgtccctctgtctttttccctcttgcccatcccagcacctgctgccttcccatcccctgggctgggcaggggccctcctgcctcattcctcctgcctcccaggcccgcttttcacagttgagggacaacaggaggcccagagaagttgatagacttccttcaaaaacacacagcttatscatggcaggtctcccttttatgaaaaaaggctcttcgagctctctgaggtttcataaggcgtctatgggagcagtagccaaggcagcaccccaggagacagaagcccagctctcctgtgggctcttccagctactcactgtgaagccctgcatatcttcccacctccctctgggccctgatcagtaacactccggaattccagaatcttctccattcctagattcctaaactcttagtattctgagaccccctttcccccttgcttgtgctagctggggtgcaagagccatgatacccacttcctgtgttacattggtcggtgtaggcaaggcggaagactgcctggaggaagttggctagagtgggagctctggtcagggtcaggcagaatttggggcagcaggacctgatagcaggcttgctcactgcttcccaactgaatgagaacctagcagccaacctgctatccatttaattggtgttgccatagcaacctccacggcccaccaggttcctggggctatgccagctcccaggatggagccccattccctacccctaaaagaaagattataggcagtaaagtgtagtgagtttgggattggatatagttgggttcaggtcttttaacctgttagacctcgggcaagctgcccagtcatcctgaacctcagtttaytcatctgtaaaatgtggtaatggtacctgccttagagggattgtgagaatcaaatgaaagaatgcaagtatcatcgctggagtaaatggcagtgttatttgtattattatattttggctgcaagccccctctccccaacacaacagtgtgttagatattaagatgttagattcttacagtgttaaaatagtgtcagtgaagggagttgcattgagcgggaaagggatttgagagaaggtcccaattcttgtgttttccccgattatgttgtctgtccctagctggctggggtttctcccagctctgtttccctctggttctgtgttctgtacctatcaaatgtagccaggagtcacaatggaaaagcccagaacatttgcctaatggcaatagcatttcagctctaattatagctcacttgattggggacggcttctgacccaccttcaggcttctgttgggaggggtgagggtgggggaggggaggatggttcaaggtgagttayagttctggatgctatttatttgaatatggaggctttttcatgcatcttagaacctttccacctgggaggggggcctctctgattaaccaggctcatcttgctattatagatcagaaaatggaggcccagagattttctgagctcactcagtaagttagggactgacccagctagcagcattttgcctggccttgactgaaggaacttggtgtaactcccccttctgcaccttgggtggccccatgctgtgcttcctgtggattgagtgacactggcagttctcaccaccggagcctctggtcccttagagctggcagtccccatttggaggttatctgcccctgaaactcacgtgggttgacactgtagatgcgttccctcaatgggcagccgccaagtactttcattctttaacagacattgcccttttcgttaatttgtgaatttatgaattggagaaagtaccaatggatttgaatttctggggcaggattctctgggaatttaaatgcctttaaatgccrtgagccactccaggatacagagtttcatgaaaagcccccttgccagctttggagggttcctgttgtctgagagacagtgggattcttcactcctgcctctcagaacctagggtacttggagagcaggccaaaggcatatggtcccctccgggggcatctgtcacagagggagtggctgtcctgggatggggtctgcatcgcggtggaccatgtggacttataatgtgcattccccagtggtgacaacaggcacgtccccagccattggcatttgcacttcatgaaataaaacaagggcaagtgttttctgagctcctagtttgttccaggctctgagtgtagggatttccatatggttccccttttaagccatccaccaaccctaggagattattcaaccccattttcagatgaggggagccagagtgcagagaggttcagtagttgcctaaggaccttagttttagtaaatgaaacttggatccaggtctgtctgactctaaaacccaggctctttctcctacatcatgctgctgggggcccttgggcttcagttatcctgagagtggacatcagatggccatcgtgcagaacctgcccaaaggctcagtgagtccccttcctccagtgacctctctctgggccagtggtgccagggagaccaacagggtctgcttgattctcttgtgcagtggttaggtgcagtaagttaagcactgtgtttggacctgggatggaagtccagatctgcctctcaccactagcctttgaacaaacaacttactctttctgggctttactttcttcattcataaaatggaggtaagaatatccacttcatagggtgataccatgtgtcagtcattacccagaccaacttcccaggactgtggagtagagaggcctgacctgggaccctgcgagccaggctcaagtcctacctttgggggaaagctacatcacaggagagacagtgaggttccaggagagacaggaattggaatacccaactgccagtagctgtgtgaccctaggcaggtcccttttgctctctgggccttggtctcctgccactccaagggatgttcatcagtgtgacctctgagatctctcaagtcctggcattccaagagccttggctctttgagggtggagggctgttatcaggcactgctgaatccttgagaacctataattagagctgtctatttagggacacagcaaatgtcttattaattataaagaaaggaagcagacagattgtttaatcattgtccttgctgaaaggttatgcaattaactatataaatattcattaaaagttcaagcagccgcttgctgcactggggtctgtagaacctggaggtccaccctggaggtggagcgtacagccaagggccctttctgtcacctgggcttttgtgaggagagtttggggatggttctggagcatgcaggatttgatggaagggcaaggctctagtcataggaacccaggctcggtctctcgcctgctgtgcatctttgggctagttacttggtctctctgagcctcagtttcctcatctataaaatggagtgcttacgtgcaggactgctgccctgctgtagtgcagtaagtggcccaggtatgtagtaagtaagtggcccrggtatgtagtaagtaagtggcccgggtatgtagtaagtaagtggcccgggtatgtagtargtaagtggcccgggtatgtagtaggtaagtaagcggcccgggtatgtagtaggtaagtaagcggcccrggtatgtagtaggtaagtaagcggcccgggtatgtagtaggtaagtaagcggcccgggtatgtagtaggtaagtaagcggcccgggtatgtagtaggtaagtargcggcccgggtatgtagtaggtaagtaagcggcccgggtatgtagtaggtaagtaagcggcccgggtatgtagtaggtaagtaagcggcccgggtatgtagtaggtaagtaagtggcccgggtatgtagtaagtaagtggcccgggtatgtagtaagtaagtggcccgggtatgtagtaagtaagtggcccgggtatgccacttatgtgatgacctttgtgaatggcacccccggaatttgcactggcagcccgcaaggcctgcttaccttacaacagacatttgttgctcacagttctggagggtaggaagtccaagatcaaggcaccggcagtttccgtgtctggtgagggcccgttcctcatagactgcacctccttgcttcatcctcacgtggtggaaggggcaaggaggctccccctgacctcttttgtaagagtactgatctcattaaagagagctgtactgttatggcttaatcacctcctaaaggcctcacctcttaatgctatcacattgaggattaagttccaacatggattttcaggggataccaacgttcagaccatggcagaatgaaatgaaaaaatataaaattttcagcacagagcagcctgacacaacttaggtgttcaaaaactgggactcccctccccctcccttgagaggttctgtttcctgaggcctggcttagggataagtagttgctttgaccttccatcccattgctctcttaggggcttgcaagtgtatggaacatctgtatcacttttatcgtagtgaattgaaaagagatgaaacatcccttgtcttctatgcttgcagaatgttaaccaacccaggggttcccaaatagaggtgcatgggaatcccctgggttttggtggggagttactaaaatgcagatccctaggctctgccctagaagtctagattcagtcagtatgagctgaggctcaggaacctgcactttgagtagctccctcaccccccaycctttgatgagaggaccccagcaaagcactggtcagcttcagcttcctgtgttccagtggggcccagaggggaggtgcttacctggggtcctgcagtgttggtgatagaggtaccctggaaggaccccatctcccaactcccagtttcccttcaccaccctgcactgcagccccaaggtggccttatataaaaggcctttgagggttagtactttccagagctcaacctgacagttatttgctcatccatcccacaagtctgccaatcctcgagcaagggaaatttctgtgaaatgaataccaggaatcctgtattcccaagggattgccctgtactcatgaaatgcattcctagggataacgttggggacctcactttcaggggcctaagatgctcttctcccatggcagtagtggtgtccagggaccttgactcagatacctgctcccctccccaactcatctgtgcccttttctgtatcccttgtggtctctcatcccagctatagaaatgggaagaggagaaactggtctgagatcagagagcaaaatggagggcgaagcatgagtagcccactgcctccggggagaaatggattgtgctgagtctccggcatcagacacagctgactttcagtcaatcctaacactgctctttatcagctctgtgaccagaacttagtgcctaccaccatgtttgtcacacagcagtgctcaaatactcagtgaataagcaaaattcagagtcatctggtatgtgtggataatcatagtaggtaacatttagtgagcactgggctgggtgttcttctaggtgcttgctttacagacattaacttagtcatcataacaatcctatgagagatagtattatccccactttattggcacagagataaggattgttggccaaggtcacatagtcagtgagtgattgaagtaggatttgaacccaggcagccaggctccagagcccatgttctccgcctctatgctggaggccagcacataatcctctcaccctgctggcttattgtgaaaattagatggaagtgtctagcaccatgcctggcacatcctagagaccacggaggtcgggcctcctgcacaccctggaaggctgaagggagccaaccacggaggtctgagatgcatctgcyttggctgagcctgtcacatgggtccagcagaaactcatgataagagctgtccccagccttgaatagggttctcattcttccttccaaattgagattcaaccctggggcttcaggcccctgattgagtcagcctctgattgcggctgcagtaattatagctatgcagtcccgctgggccctgccatgcagcagctgctctcagcagcaggatcagcaccatcactcggggagggggcttagaggcgggccgattggagccgttggggccttggtgagccctccaaatttacaggttccaatcatggagtcactgatctggaaggcaaactgaggcccagctggggcatatctcacctaagggcacacagctgggaaatggcagagaagagtgcagggcatggtggctccatgttgccagaacttaaagtggaggtttggagggatgggaggtgtggccaggaggggcaggcagaagtcaatggatcaaagggacttgagggccagggaccagggggccatgaaagatgttawgtagagaagggtcagatttaggatttgaaaattcctggcacagacagaggcttcttctcagctgatgaarctgagacatgggccagaagagccctgatggactcctagggccttggaccagrtggctggaacagggtggtaggactggttggcaccatgccctgtgtcccccttggctaagctatgcatggacgtctgtctccacagccaagcaggtgtgtcctgcagagaagctgagctgtggacccaccagccacaagtgtgtacctgcctcgtggcgctgcgacggggagaaggactgcgagggtggagcggatgaggccggctgtgctacctgtgagtctggggtcagatctccagggtctgccaagcatggtcaggcagcctcagggagtggcagccacttctggggagggggcccagttccccrtggggcttggtggtggagaggaaaggataaygatcaggacactagtaatggctagattctatggagacatggtcttctttcatcttcacaagcacctcatgagcagccattatcatccccattttataggtgaggaaactgaggctcagacaagggaggaaaagtacccaaggctgagtgatgaaaccaagattcagattcaggactggacagcaaagcccatgagcttttgttaccatgtctgacatctgctcatccatcccacaagtctgccaatcttggagcaagggcagggggaccagggagggtgctgcgtggagaaatggcggtggtctgagccagggcgccagcaatgctggggggagggggacggattcctgaggtgtcaaggacgactgttgctgaaatctcagattcaagcacagacgtcacagggcagagaagacattctcagcagcctcrgcagggacagatggaagtggtcactgggacagttccacatcactgagcttcaaacacaggattatctccttcccagggagcaggccagcagggcctgggccattggggagcatggccaggcctcactttttcaattcgaggggcacctactgtgtgccaggcctgaagccaggctctgaaagggacagtgaggtgaatcctacacagtcttccctctgggaacacatgattagtgggggagacagactggctgtcgctactaggctgtgcggctgggctgaaatacgggcggtcaccctggagggcttgccaggcacttgcccatcactgctgcctactcccctctgccagcctctatatttgcatcctatccatctttcctggcccagggaaaatgccatctcctccagaggtgtctgagtcgtcacactttaagattctaagtctggaatttgatgtgtctgaagcaggaagcatctgggtatggagggagatcctggctgggaacagcagtttcaaagtcccagtgatggcactggctcacttcctcagctgtgataattttgctgggactcactggccaatgagaatcctctttcctctttamcaagccccataatcagatgattcctccaatatgaaggccgctactgcaagggatgggagtctctccaactagggcatgttggaataggaacattccccawtaattatgggagagagaggtgtcagaaggtcttactgggcttctatgctatagcttccaccctcctaggcagaggaaagagtcctcccacccctcatctctcagagcttcttccgtttgtgagtgctaggagtagggtctctcggcctacgtaggcctgagaatatggatcttaaagttactgttggctccaaaacctcagagaaaactcagtatgaagaagcacttccttgccatccaagtcttcaagtaaaattaaaaattaaggcggggcgcggtggctcatgcctgtaatcccagcactttgggaggccgaggcaggaggatcacgaggtcaggagattgagaccatcctggctaacatggtgaaaccccacctctactaaaaatacaaaaaaaaaaaaaaaaattagccgggcgtggtggctactcaggaggctgaggcaggagaatcactggaacgcaggaggtggggttgcagtgagctgagagcacaccactgctctccagcctgggcgacagagcgagactccatctcaaaaaagaaaattaaaaaaaaaaaaaaaaaagcacttcccatcagaactcccagaaagcagtgagtccaccctccctgcacatgcacaagttgggtggggacaggcaggaagggagctcatctaggtgtcagcgtaatattgaggggcagtggcagtggcagcatgtgctttttccaccaatgccccagtgtctcaaaagcccaggaggggaaaaaaattcaactgtcagacacttggtagagctgtcagaaacgcatgacacgagctacctacctggkgaaactgaagacatcactctattttatcttcaataacaatgaaaattcacatttttccatcagaaagtgaaaacacagactctgggcgcccccacgtggaaagatctggtgctgccaccaccacctcacctttggccacagccactgcatcagtgccccaccggggcctacccccatcccggggccaggtcttggcctgtgtgtggacgcacaggagggagggaagtgaggaggtcactgccctgaaaaacagctggaaaaactccaggaagggaggagaaaaccagaaaagccaagaggaggagtcagagtaggaaagaaaagccccaaatgtgagttctggttctcttgttgtcatggactgtgtgaccctgggcaagctgctcctctctctgggcctcagtttccccatctataaactggcaatagggctggctggcctctaagttcctcccggccactgaactcagactagcctaccagagagaagcccagagccccargcagagccatgacgtgtgtccttaattactgcacatcccataattatacctcatacctgggccagaccagttccatccactccacacccactcactacagggagctctgtaccaggccctcaggacaaaggagggacacccccaggcagtgtggattcttggggcagattgaaaaggacatgaaactcagacgcctgcgcgactgaggggctcagaaacgagggcagaggcagagatttcccaagcggggaaacgccagggtgtcatggaagaggtggaatttgggcccttggaagatgagagctcatcattgcaaaatgtagtggtgggcaagaagtaggttcccagcagatggagcaacttgagtaaaggcttggaggtgggagcctgtgcactgggcccagcaaatggtctagcatggcgggagctgcgaacattcaggagtgaggtgatggagccacaggactgacccaagagacgccttggataccaggccaggggactcaggtggaacagtgcaggttatgctatgcatcgctatgctatgaggagccaaccccagaccctggtccctgggaagggtcagtgtcatttaacagatcatgtcctgggaccatagcagggtccttcaagacaggcagtgctctaaggtttcggaatccccctcctagtcccaccatgctcatgctcatttacccagtgaggcctggggggctcacaaagggcaggtgtgttgccagtcacctagcatgtccgtgttggaagcccgccttcgctatgcctaactgcacgtccaccattcagcccccaaagggcacttgttctggcccccgggtgagggtcggagcccctgtagccggaccagcggggccccaggtcggccggggagggggtcggcgggccgaccggctctctgtcccgcgcagtgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgyccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgccgtaagccccctccataccgcccagccccgcccagggattgcggatccgctatccgatccggatccgccaggtgcaggcttcctttcattgccttacctgaatacattacccgggtttactacagaggagaccgaggctgggagargtgaggtgacttatttgaattcacgcagctgccgggctgcggagctcargtctaactccagaagcctccactggtatctgtgtccctgctgtgagccctcccagtcgtacttcccacccccatcccccgaacccctcyacccagaaacctggcaggctcaggagctccccccatctctttacccgctaggcctgctcattcctcaaggcctggcctagactcctctgaccttcscagctgggctgggtccctctgctgggcaggtccccagcagctttctcttatagctcatctcacactgatgtccccatctgagcattcctcacccttgctctgcaccctgagctcctagaggatgaggaggctcttaggagtctctgggctcccacccccacctccaccyctcccagcacagcacctggcacaggaaggtttgccaaatggatgaagtcattaagtaatgagcaccaagactcaaaagaaggccgtgtgtctgttctgaggagtggccctggagagaggcagggacagggaaacaggagatctgggtttagtcctgaatctgccagccagagtgctgtgtgaccctgggcaaggccttccccctctctgagcttcagtctccccatctgtacactgaggtgccttggccaggtgtcctttgaggactcctgagttcagccactggttctgtttttgctgggggtggctatggcatggggattggggtggtggggaaattgtcctagcaccacactgactctgatcctctccccttgccctctcctggcagcactgggcacctgccgtggggacgagttccagtgtggggatgggacatgtgtccttgcaatcaagcactgcaaccaggagcaggactgtccagatgggagtgatgaagctggctgcctacagggtgcgtgtggtcagggcacagaacacatcctctgtgaggatgccctaggctctggtaactctccagagggcagagttgggaggagtttccccttggtccccaagatgcattttcccccagagcatcacttgcccctaaatcacctggctccctttccatggggtcctagtagcaccagaactggatttgtaaggactytgccaaagctgaaagacacctagggggacatgacagagcacttgggaagtccagcccccaccacttgtccaggtcccagctggtgagtggcttccctcactagttcccaggctgagcagaggctgagtcttgctccccagggagcccctttagttctcagatggttcttctggtcaccacctgccctctgcaggagcagggaccctcattcactagtcatcttggggaatggataacaggctgggcagtgtagcaacttccyctatccggggtccayggggcaaagtccccccaggagatgatcagtmcagcctctaaggtctctctagagctgctgcctggtcctcctaggacctgagtcctgcaagatgagacgcagatccccacagccctgcccagctacatgaggcttagcctcctaatcatccctgggatcctgtcctgtgagcagagcttcctcagttcctggatttacctgtctgtcctgggccaccctccagggacctgtgagggactggaactggagctctgcttgcctcctgtgggccccagcccagcccttcttgtccaaggtctcacaggcactgtccactctcttgtccggcccaacagagtcaccctgtgagggtccccrcagatttcagtgtaagagtggcaagcgcgtggacggcgggaaagtgtgtgatgtgcagagggactgccgggactggtcggatgagcttctgaaagtgtggtgcggtgcctgtctacgcccactggctggactcagtctcctaccatccccctcctggtatctaggctcaaggccctccagtgccccctgccctgacactttctgctctgaccctctctttggattcatgtgccgtcctatggcttcacatggggcttttcgcccccaggcctctggtctacatctctacaaagtgctaagagcttgtccatcccaggtactaaaaaattatgttttctctcacaaacttggcctttcctcattccttccccgttcagacctctgagaccttctggaactttctctcttcctcggtgttcctcccctgctgacccagccaaggccctgggctctgaggtcttctagccccttgcagaagacccagcagagggagaagtgggcacagcaggcaggcagccaggtgaagcacatcccagggccactgctcaggccatacctgtgtgggagtaaggcaggccttgcagcaggaggtggcaccatcctaagccctgaggagttcggacctgatggggagaccagacttggaggccagactaaagcgagacctggatggaagtggctgccctgatgtcggctacagctgtcagggtgggttccaggctagaaagaacagaggctccaggctgtaggtagggtgggcatcccagagaacatgctagaaacccagtgtggactccaggaaggttcatgagtttttttttgttttttgtttttactgttcccaggttagggcttgagggagatttgacagagaagccctgggaggacagaggctaggtcagtccctccctttcctgccttctggcagactgtttccccagcacctacctcctgggtgcttagaggaggttcatcctcctgagcttcccaggaagagcatatttccttccccttttgaagattaaaaaactgattgtgaaaggaagagtagttgagtgaaagtgactcagcttctacctgagctggcaggagayagacactccytctgcctccaggccctgccaagagaagtcccagaagaaggaacttgtggaaaaagagacagggaagccagaactactgagcctagctcccccaacacccagatttggagtagccagggactactgtcctactaatccctctcttctctctcgtcgtttgcatgacacaccaaagaggagtaygtacacacgtgcttgtgtctgtgtgtggcctctgtctctgtgttggtgagaggccggtgtctgtatccatgtcttcttctctgagtaaagcaggggaactgcattcatgcatctatgtgtgtgaccccatgtatgtgtgaatgtatctatggagtccatgggactgtttgtgctctgcacataagctggtatgtgtgcatgtagttgtgkgcatgctggtgtgtgcatgtaggtgtgtgcagtgacaccacttcttccttccatggaaggaagccgcaaatactactctggcctctctgcaccactctaccccatccccctcctctcctggctccccagcggaatcacacccaggctaggtagaattaagaaggactgaagacttccctgcaggcatttggggaaaggttacagggacagacaggtgcagacctgctctcctttctcttcccctcacccacctgagccctggaggactctgtgccttccttcatcagaagccagtcactttragttctctcctttccccttccccctttcagggccatcccacctacacatgccacttcatcaagtgctcagtaaatagaattgttgagttgttgctagctgcaaaaggagaggaaggaggcgagtggatgcatgatgggggcagtgggtgagtgggaggacagatgaatgaacggtgctcagggaataacacaggaaaggagaggtcagggagggctccgagcgactgaaagattcctagaggtgggagctgccgtggctcagcccacctccaagggtctgaggcttcccagggctgggcctggctgagtcatccctgggtcccccagtcatggagttgctgtggtcttgttctttcagttccgccaacattcctgggaaacaggaggaggcccaggggtaaaggggttattccctaagcatggctcaggctggaagtgggggcaccccatagctgtgcatggcctggggtgggcagctcagaccagctayatgcatggccatggctggctcagctcagcactgcttggcttggctggagtggcagtgcatgagcctggggggcagagggggaraggggcgcggcacctctccttggcttgtggaattaaccttctgtgactctaaagctcaggagaggctgtaagagcattggtcctggattccctgacctcccctaagaccctgccagaaggtagtgagggagtggaggatggggaaccagaaccagatgacctctgggcatcccttcacctcttgcagcaggtggtaatcctggaaccgggcccatgacaagataggaggaacagggacaggtgctgagaggagaggagttaaaaaacccatcatattagttcatgataggagagaattgatttagcaatggctccatgttaaaaaaggcccaggagtcttaaataaccacaagcacattagggggggcatcctgtgttgttcaggttccttctgggtggcaaactagctctgggccctgtccagacagggacatggacagatggagtgagtccagagaaaggcacccaaatggcaggagaccagatatcagtgctttaagggagcctgtgcaccctggccaaccccacacagcagagctgggagcacaagcagaagcctcagcaggcagtgctggtccacagtggagccagctgccccaggagggaagtgggctccctgaggctggagatatttaagcaggggcattttggaagggattcttagggtatcctgagggttggatgtgacacacacaggacccttcaactctgaggtcacgaggaaggaggcgctgtgagaaacatgtttgtgaaaggaaagaccttgggccactggggaaggcctagctgcctccagcttggtggtggacagagccccagccgggaggccggggacctaagttctggttccactctaccctgtctctgtgtctggcctggagtaggaacctgccctctctgtgccgcctgctgcccagaacacctggtagatgaggctgaggctcagtgaggttgtggagccctcctgcctctatgggagtcccactgccctgaggctctgcttctgctctaggtcctacccctgccctgcccccactcctcctgggctcctggaccttcaggagcccatgtccctccccagggctgaacgagtgtctgcacaacaatggcggctgctcacacatctgcactsacctcaagattggctttgaatgcacgtgcccagcaggcttccagctcctggaccagaagacctgtggcggtgagaccttctcccacacccccaagcagaagcagatcctcctgctggttctgactcctgctcctccccacagacattgatgagtgcaaggacccagatgcctgcagccagatctgtgtcaattacaagggctattttaagtgtgagtgctaccctggctacgagatggacctactgaccaagaactgcaaggctgctggtatgaacaccccaagggcagaggggcagctctgaaaggcatacaggaagcagcgtgcttccacttgtgaggagtgggcgtgtacaygtgcgcacacacaagaaggcaggttgtgttactgagaggtacgggaatcctcggtcccttgtctagcttgggagaaagaattcagccaagagacaattagtaacataagccgaaggtttattaaggagataagagtacaatctaagacaggagcaggctgacccagctgggagcagcagcaatagctgtgtttctttaaagggacagtgcactctgaaaggtgacgcagagtgggggcagcctgctaaaagagaatgaaccagcggcagccctaagagttctgcattgggtttttttcttgaagttcctgtctctgtcctaaatctctgccattttctttgtctagttttcccattcctgcttyaagtccctgcctgttcctcacctagttcccacccaggcttgtgggacctccccttactattagcttgtgtgcatgcccagctctgggcacaaatactacctaatggtgccatyactcgttaccaccaccctaggaaggttgtatagcagtcaaatctgattgggcctgcatatttcttagggatttcccctttgcccttcccctcctcctcaacatgcagctagctacattctgatgggagaactgcagagtgagcagtttctgggcatcttaaggggcattcctttctgcagaggcatttcccctcctctctgctcatatctagcatgaatgttttgggtggtctctaggtgtgagattttctagacttcccttttctcagggactcccccttctgctcatgtccagctgtctgcctactctagcagttgcacacacagtgctcaaaagtgtacatacacatcacacacacaacgcactgcacactaacacccacacagacactgtatagagccacccaatatagcccacagagatgacactcatacaacagaatatgaaccacacagagactacacacacagcatatggagtccacacaaagagcacgacctgggcagacctacacattgatcaattcagccagcagaattaattcattgtattcagttgtttatattgaacacctaacattgtagtagacactggggattcagcagtaagcaaaacagatgsaaatccctgtctgccctcaagggactcatattctaatgggtgagccaggctagaaatcagataaatamataaaatatagtgcatggcagatggcgataagggctaaggaaaaatagaaagtagagaatgggaatagggaagtccaggtgagcagggggttctagttttaaatggaatggtcagggaagccctcactgagaaggtatttgagtaaagaaggtgaagkggggtgggtgtggtggctcaygcttgtaatcccaacactttgggaggcctaggcaggaagatcacttgaggccaggagttcaagactagtctgggcaatgtagtaagaccctatatytaaaaaaaaatttaaaaactagccaggtatagtaccatgcacctatagtcccaagctactcaggagactgaggcaggaagatcccttgagcctgggagtttgaggtcacagtgagttatgatgccactgcactccagcctgggtracagagtgagaccttttctaaaaaaaawaataataataataataaataaaaagggagtgagggaggtgagacagtaagctaccatgcaattatctataggaacaagcatttcaggctgaagagacagaaaccgcaaaagccctaatgcaggagcatgcctagtatgttcaaggaatagcaaggaagctggtacagttggagcaaggaaactaggaagagatgaagccagagaggtggcttggggcagcccaaagggccttctagaccattgtaagagccagctctggatttcactctaactggggggaaaccattgagggctctgagtagggaagggacatggtgtgacattttattctgactgcagtattgagaacagactgtagaggacaagggagaaggcagggaaaccacttaagaggtcattgcaataatccagaagcgaggtgatggtggctgaacccttattcccacattattactgtgggaataatgaaaagtggacagactgcagatatagtgcaaaggccagccaacaggatttgcttatgaattgaatgtggaatgtggaaaaaaaagttacagcaactgaaaaaataagattgctacgtatgggcttgggaaagatggtgagggaagcaggtttggaggaatcttaggctgttttggacatgttatgtttaagaaaactggttaggtatccaagtagagatattgagaaggcagctggatatatgagtctggagttcatatgcaagttaaatacaatatacaacagataaattataacaatacagcagccataatactgacatgtagcccataaacccaaaaactgtaacacccaaactgtacaatatgtaactcatacattagtatatcacatataacgtgtaacctgttcttgcccccatatagaacacatgtaatacatgacacagattatgtacatgcactggagacaacatgcaactacccatgcatatacaaaatccacacacatgaatatttcaagtgcagttacataaaatctcaaatcataaacacagggggttcctgtcacagtcacagctgtcatttaagatcactccaacatgcccctttaacctggctcctgccttcagggaggtgaagtgtcattactgtcattttggggtgagggaaatcacagcttgtcagtggcagagctggcctgtaactcagctttcatccttgccccttcctgcaccttgagcccattctccatgctatttgtaccacacttctgtctcactcccaccctgctttgaattagtctccatcactacacacaggtcacacacccagccccaggccctacctgactctgtgctggtcccatcctccagggagcacatkagcttggcaaagatgcacagtgacagggactggtggctggcagaagtgtcagctggaaaacaagagaaggaggcacagggagcttgaggggcaggtgttactaggagcagcccctcagacagtgttggtgcctgagagtggcccaatacatctagaaacagcctgtgggagctggtgctaggccctcagaggcccatgggacagtgtcctcccatatggagtagccaggaaagtctaggtcacttatttatcatcttaaaatctaaccctaaatctaagaaaaatacaggttttgtgtatacatgagcagtttatgttgtctctactgcatatatataatctgtgttgtatatcatatatgtcccatctctgccattggctcaggatagagaacaaactcacccagctcataggaccttttgtgatctggcccctgccaatctctgaagctcatctcttgctatgtccccaatactttctatcctgaatcatctttttttttttcctttgagacagagtctctgtcactcaggctggagtgcagtggcacaatcatggctcactgcagccttaacctcccgggctcaaatgattctcccacttcagcctcctgagtagctgggactacaggcatgtgccaccatgcccagctaattttttttttatttttatttttagagatgggattttgccatattacccaggctagtctcaaactcctggcctcaagcgatgtgccagcctcagcctcctaaagtgctgggattacaggtgtgagccactgtgcctggcccctagttatctttctaagacacttacttgctcaggtagttccttcttgaaccacagcagtagggcccaagcagagaagatgatagttgctggaaagaaatacatagtaggtggaagggacaacctgagcaaaggctctgaggcaggaagcccatccatggctaggtaatggtatctggtaggtggaatcaagctatgttggagaggcgagtaatgaggctggacagggaacttggggtcacactgtggaaggctttcagtgcaggcctaaggagaaaatggggagccataaaagattttggagaagtttgtatctaataaaaagaataagaatcttcctgctatgcgtggtgctctgcatcttctgctttctgtactcattatttcatctgctcctgcaacctgtaaagtaggaattgtcactactattttaaggaaaatggatgtgtcakccagcaagccagtggcagagtcttggtctccaggctccctgcctcttgcactgactctttctctttcaacctccctgcatgacagctggmaagagcccatccctaatcttcaccaaccggcacgaggtgcggaggatcgacctggtgaagcggaactattcacgcctcatccccatgctcaagaatgtcrtggcactagatgtggaagttgccaccaatcgcatctactgstgtgacctctcctaccgtaagatctataggtgagcggccatatcctctgcagcaaggcatgaagagtgggggtgaggggtggtgacaggtgaggaggggaggagtggtgtctgcctctagagctcctcaggacagagttgggacttgggaagagatgcaggatcacagtggatatggaacttctgggactttactggggctggagtagtctgagggctcccttgggttagcagctttgagccccaaacacctgggatttgtctgacctctggaggcctaatatggaagcacaaracacaggaactgtttggccagggcagaaaggaagaaatcctggctttggggaggactttccaagcagctcacatccctgtgtgttggaacctggggacttagacctgstccctgcccagaggatcccactcacaacacagtgacatccatttgtgatgatcatgagaaagtacagaggaggcctccgaacccacctgggcatctgatctggcatgccttcctggatggcatcaccccaaggccagcttttcactgtctttgacgccacagtcagtggacctggtgcttgggaagctcttcacacactggaggaggttctctcctaggactttctcagatgccagcacctgccccactgcatgtctgggccctcttcaggcagtcatgtcctttctttgtcctgagatccacttggcaggaatgccgatgaccaggcgctgggtagacactgagtcactgatgaaagaatgatgggacagatgggtggaagagtggatggaagcaaatatagcaagtgctactcactgacaactagattcctgcctccctgcaacatacagacactccgttcacacacacccaaaaacataactagaacaatgcctgtccaagagwtgtaactgaaagaggcaggatttggtgacagactagatatggggctgatggaagaaatttactccttcatagtgaattttgggagtttcaggtttttggcttgggaggtttcatgaatggtggtgctgttctctgatgtgtgaagcagtagaggaggatcagggctcagggtttgggccgtctggttggccgaggggaagggaatggggatgaacagttttggacatattgagttcaaggtgtccwtgggacatccaaggggagctagttagctttgcagtctggatcgtaagagagctgttgggattggagacttagttattgatggcagtggacactaaggaactaatcacccagagagagggcaagaagaagaaaacctctggggaaacagcatttgctattttgctaatgttgcctcctgagtgtctactgtattcttagcccttctttccattctcactggcacggtcattcttcagactctcttaatctcccacccagatgctgtaacgtcctcctaaccagtttccctgcttcattccctctccttccaacccatccactccatagatgccacagtgaactaacatgcttattggactatatcctctggcctgtctagttatcactggggagaaatcctaattccttggcrtggtactcaaagcccatcaagatggggttcctgcctacacctgcttgcagtctgacacccacataagcagctcccctaagtatctcactgttccagagcagactcacctctggccatttgcacaagcctttcttgttccctaatggctttctgtcctggtgacttcatgctcctggtgaactcgtccttcaggactcaactataaagccttctcccgccctctcggatgaggcagtctccatgcctctgctgccatagcctctaatgctttccataatcacattgtattatatctggctcaccctaatgggcagagctgtggagcagccccaccttagaaagccagagaccgtggcccatgtaagtctgtacccctaccctggtaccccagggaatgtgtagagtggaaattatccacgttcctctaaaaatctattgccatggcccagatggaagagaggggaagggtgcacaggtagctccagatgggcccatgggtggaacatctgccccatggtcatctctgttttctcttaagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggtgagtgtcccaactgaacttcccattctcccaccataggtgctcagtcctcttgtgtctgtcacaagggctatcttgagggttctagaaagctctgggccactcagacacaggccatggggaagaaagtcttgttaatccccaaccaaggttctctgggcattggtcaccaaagttctccctggactctcccacccactcgttatatcgtagaattggagtgtctcagagcagagtagggctctagagatggcctgatagaagctcctgggggaggaagcctttcttcaggctgctgtaggtgrgcatctgacagctgctcacatacttccaaagacaggtagctcattacctcccatagggcctgtttcaccgtggggcagctctgctcattagaaagtgggtcttttcccctcataatgccaaatctatctccctgcaacttcctccattggcctctggagttacataaaacatgtctattccctgccctgtgagagagccagcaagatttgaggaccaagatcactggtctgttctgcttcagactgcctgcctccatccctacccctgttgcctatggtctctgggccctcaccacctaggttgccctgctctggccacccctcarttttgggagttagggattctgaacagaacaggactccctctctccctcagtgtggatatcttgagatggtttttttagcgttatatcatgttaagtttaacagaatcaacagctgcttcctactgctatttccttgttaaacagggataagaaaaccctcttcttcgagcaagggcagctggtgaggggagtaccacatgggaggttatgtgaggccttgggaagtgactgatagctgccattcactaagcatgggtcaggtgcttccagcacagaactaggcactctgacagatacggagcctctcctcttaccctcacttcatccctgttctctgtctgttctcatgcagaccttgtgttgcacctgccacatcctgtccctcacatcatagagttacacccagcccaaccccaatccactgcggatcgtcagggtcccaggaggaaacccactgcatactcaagataatcagaggagggtttaataaagggactatttacaaaggagtgggttaggtctaatttactaccttggattagtaacagtgggctgctactggccctagtaggcctgaggagacaaaagcagggagggttacctgagttaggaagctcatccactttctcctctgaaaccagaaaagagagggcttactagggccttccccacactgacaccctagggctctagttagttagcactgccagaagtgggagagatggggtcacaggctattcagctgagtctgggtgcaatctcggagaatagttttcctcaagttctcaaatgaggtgaaggctaaagtgcctgctaaatctaagatttgatggttcaaaagaactttagaggtcttctcagtccctactaaacataaaccacaactagtcaatgggttattgagctcttgtgactcagaccaccccggtcatgtccccagcaagaaggcaaattgggttattttgtcttttaggttcatgtattggtctgactggggggaccaggccaagattgagaaatctgggctcaacggtgtggaccggcaaacactggtgtcagacaatattgaatggcccaacggaatcaccctgggtgagccctgcctttcctgggttgggggcctattctagtgccttgtcctgatcactgtctggaactccatgagtcttgtttctgggtcctctcatggtgccagtgactttgtttcctaatggttgccgtaggctggcctcagtgtgaggcctagaaatgtgggcagggagaggtacaaaggaacagagctccagactggggtcccaggttcatgacctgatcctgcttccttcccaagatctgctgagccagcgcttgtactgggtagactccaagctacaccaactgtccagcmttgacttcagtggaggcaacagaaagacgctgatctcctccactgacttcctgagccacccttttgggatagctgtgtttgaggtgagtcctgtaaggagaggcaagggcccactaggaagctgaagcctagaaaatgcttgttcaaataggatgagtccctgagacttgttcaaatgaaaacaggaacagggaaaccaactgatttgtttgtaaacaatctgtgagctgcctgcacacaaaggctctgcagcccactctccacctggcagcctttcccacgctctcttcccaagacccctctcccagagcacttctcacaggtgagctgctaggcatgtatgtttcctctctgtgccctcagcacccagcactgtaacccatatacaaaaggcacccagtaaagggaggaaaggaagaaggaacatacatatccttagaatcatttamtggaggaaatggcctgagagatgctgttcaattctgcacacttttattgacctctgccagaccctggggtcatagaagtgaatcagacactatcctagtctcaagaagctcccagcaaagtgaggagcgaagaccctcctgtgccctgaccctaatgacttttcttctccgggaatgaagaagccagaaccaaccaaggtctcacaccttcacctcttcccgaaaactaactccaccaccaaggggagggaaagcaaagggatgatggtctgtggtgggcattggcaggatttgcttgcagcaaagttactcagcactgctctgaagttgtgggcaaagctccacctctaagtccagcccctgctttaaaggacaggtgtgttggtacacaagtgtttgtgcttgtttatatacatggcatgtacatgtaaagtatgtgtatgtgcatgggtaaatataaatgcatcagaataaaagtgtgcattcctctaagtgctggtgcttatgtgtgtacatacatataccaagatgtatatagactgcatatttaggggcaaatgtagctttttgtgtgtggatgaacatttgggtatgtgtttagatctgtgtatgaggatgcacagttgtacctgtacgtgtggatttgctgacagatgcacatctaggcttatatggactaaccatgtggactcgtgtggatacccagaggctacaggaagcccagcaaggcataaccctcatagctcacacattccttccaatcttggtcccaggccccagtaatgataatgctatagagatttaaccttgggtttctgctgggctctagcaagcaggcttagttcagcatgaatgagtaatgttgtggctgtcagttcaaagcacagaatcactgaataatcctctaagatagaagggaacaaggagacgtgcatcacagattagaggctgagagccccaccgtgaatccatagacaggacagatcaggggagatttcagggaagttcttgtgactatggtttggggccaacccctcagactgaggtcatggatttacactccaggcctcccatcctctgcatctataccccacaggacaaggtgttctggacagacctggagaacgaggccattttcastgcaaatcggctcaatggcctggaaatctccatcctggctgagaacctcaacaacccacatgacattgtcatcttccatgagctgaagcagccaagaggtgagctgtctctggtcctaggtcccaggtcccctgactgtgtcactgtgtcctctcctttcaccaggcaggctgtgttcacattcaggtcacaactcagcaaccccaggaataataacaacaatccctcttgttggtagagtactttttcatcatatattttgtctcattttacctcaagttctttgtgaaataaggctgggtataaatgaatacataactgtcctgtttttgccaatcctacaaagtgtgggtattactcttctaacagttgaggaaacggaagctcagagaggtaaaataatgttagcaggtggcagaactgaaacctaaacccaggtctatctggttccacagctgctttcaccatgacacactgcatctaacttgctatttgtagccattctgcagtagtataagctaatgtatccgagggccatataataagtcagcttattggttgggaatagaatctaggaatcctactactaggttgtcccctcctctatcactaggatacattaattctaactgtaactgaagtgttggctgccagggtgaaagagggagagcaagggagtgtaaggagctaagattggtgcctgattctagacctagaaatttaaatgagagacatagtatgtggcacagggaaaaataaaaaccgcgggcttatgggctttggagcccagccgacctcaatttaagttctatctctagtccagacatggtggctcatgcctgtaatcccaacactgagaggctgaggcaggaggatcccttgagcacaggagctccaggcagcagtgggctatgattgcattactgcactccagcctgggcgacagagcaagacccctacctcttaaaaaaaaaaaaaattcctagagtataggtttgacgaatttgttctctttgagcctaggtgtctttatttgtcagtctgggatgtaacgtccccacctctcagaattgttgcaaggattaaatgagagtgtagggataaaacactaggtatggtgctggaaagtacccaataaaagtagtagggaggccaggcatggtggcttatacctgcaattccagcactttgggaggccaacgcaggaggatcacttgagcccaggagtttgggaccagcctgggcaagaaggcaagactctatcactacaaaaactataaaaatgacccttgtatggtggcatgcgcctatagttccagctactcgggaggccgaggtgggaggatttcttaagcccaggagtttgaggctgcagtgagctatgattgcactgctgcacttagtctaggcaacagagtgagaccctgtctcaaaacataaaacataaaaaaaattgaaaaagtagaagggcttcacaattgcagagatgtggaaccaacctaagtgtccatcaactaatgagtgaataaagaaagtgtggcatatatacaccttggaatactactcagccataaaaaggaacaaaataatgtattttgcagcaacttggatggagctggaagccattattctaagtaaagtatgatagtagtggaaaaccaaaaactatatgctctcacttataagcaggagctaagctatgagtacacaggggcatacagagtatagctaagctatgagtacacaggggcatataatggactttagagactaaaaatggagaaggtaatagcggggctagagatttaaaaaaaaaaaaattacacattaggtacaatgtacactacacttgggttacaggtgcgctaaagtaccagaattcaccactatataattcatccatgtaacaaaaaacgtgtatcccaaaagctttgggggataaaaaaagaaagaaaaagaaaaaaaatgtgaaaaaaaaagtatagggcaagctttttgagcaagccaggtgggagaagcctcatcctcaggaggcaggaagacctggcatgtcctgtctgtgccccagctgtctccctctctgccattagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccraggtaagcagaccttccaggagggatgscccctggcagtgtcagaccctaccctgctgaaatcttcccttggcttctgggacacagtatgctgctggttttcttccatcttccctggttacttgttgccttttgggggtttctcttttttaccttccttgaatgctcatgcccccaggatccttccaaagctttttctcactcccaaggaaaaaatgcacatatacataaaacattttaaattcagtttcagggagtttctggaaygctttaaaaacctcaagttaagaacccttaatcgccgtggcttcaggtacatgcagataactatatatttgcctgtttctcacctagaacttaacaaacactacacagcagcccttttgcaatataattgggactaatagttaatacttcaaccgcatacacagattcatgtcctaatcttgatgtatagccaaggcctttcatttgagcctaagtctactgcattattaaygatttacaggttcaattgtttaaagtggaataagaatttcaatctattggtataacaatatatgagtgtaaaatccttctagatttatctgatttcccctccctacagtctttttattgctgatcttacaactaattccacagcartgttttaatgactcatctttattgaatcaaagtgaagtgcttagcattcagctaaagaaaagatcatagcccactggggagattaggaaaggcttcacagaagtggcatttgagctacgccatgaarataagttcctaagtatatctcagaggcaatamcttaggcaacaaaattatctgtccaagtgacctccatggtatttcccctccagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccrtctaccctaagccctgcaaccagcaaccactcccagcactgtaaggaaatgagttctgcattctttcatgacatgggagggctcctagggaagccaggaagggggtatgtgataagacagaacctaccagagctgaatactgcatatctttgaggaggttactgcatatctgagagggaggtagagtaccagcctgcgakttargactcataggtgcccctaccttacagagggtcttgtaggaagctgagaccctgtgagcctcagttgcttctcttacaaagtggaaataaccacccttccacaacctgcttcacaagattgccatgatagacaaaggtgtamccggtataactggaggtgctcacgcacacagccgttgctgactctgcgagggtgtgtgtgtctatgtttcacaaagttctgatgtgtatatgaggaggtgtcccttgtgtttggaaagctctgatctcagttcacagcaggtccccagatagtaatatctacaaccatggtctccttatacctctttccaaccctgggatgaaaataattaagttcaccacttattaaatcattgggagcagtaattgtcactgctagaaatgttctatctcattaatcagcaaatacctttttaattgagttacctgccagagggagttcatttaaaaggataaactatctttttaattttttcccctacatggacagcccagaaaccaagctgcttggcaacatcttcctaactggtcctatttgccagcagaagctggctttttggagtggagcacttactccgaagtttgcagaggcagatggagcatgtgtgaattccagttcctctcatctgagggcagagcctctcaccagcttctcctcactggcttcctcatgctctaggttttaatatcactgtccagtgttcgctgtggcccagagcagggaggacagcagggaggacacagttagctctggaagcaagcagtgcagctttttctccccttaactgttagattctcttggagtaacatggataaacagtcacattgagagaggatgggccttgggccattgccgggacagtsatctcacctgcagcaagtgtagatgatagctccttttcacaccacagggagctgtcaggaggatctaagggaaaaatgctttctgaactataaagtgcttcacaaatgttacaatgaagatggttataagagtgagaaagatggcatggcatagtttttcaaaaagacagtaaattttccaagcacttttcagtttaaaatgtgcttttacatatctttttaaaatttagaccctattcaacaaccccatcccactctccaccctcttagaactaggcaaagttgtgccaagcattttatattcattttagataaattatttcatttaatccttaccatatccctaggaggtaggtaatatcaccattttaaagatataaaagtataataccatgtgctgtatttataatatataataatttgcccaaggtcacatgggtagtgagtagtagagctgggacttgaacccagaagtctgacacagaagtctgcgcttttgattcctctacactatactatgtcccatttcaattacttatgaaaaataatctgataatgcagatggacagacagttcacaaaaaacaatactggcaaagcaacagatactgatggaaaaaggcaaatgacctagtccatcagcaacataaagacctaagtgctcactttgccatgcacagcccccagcttcctactaccatgatgctatggaaagrgtatgggacttgggacatgagtcctgggttcaagtcccagctctgccacttttctgaaacccctcagttaagactcagtttccttgcctgtaaaatggagataacctctgtcctgcttgcctcacaggagttgtgataggatctggaaagactgaattattaggcaacagccaggatcatcattttagaatgaggatgagcagcagttgggtagttcttaccacttgaggccagtaggggcttggacacacagtgatagagcatcattctgcaaatgtttgtgttttgcagatgcaaatgaagacagtaagatgggctcaacagtcactgccgctgttatcgggatcatcgtgcccataggtgagtgtggcccccagtcactgaagagaaaagagagaccctgcttaggcctagggaagagcgctrgcagggtagagaacttggcctgccctattgacttgttctgcccttgcagccttcctgcccacctcccagtcctgatttaatttggttttttagcctagcacacaaggctcttcaggacctggccccaggtgaccttccaggtacatcccccatctccccacccctcgattcacactctacactccagctatgtgaagtgcgactgtatgatccctaggaacagggctggtatctcttgctcaccattctccccagctcctggcaatgtctagcacatggtaggatatcaaggatttgttgaattaatgaatagagctgcttaccattcctttaataggtcatactgtcttgttttctttctgtttggttttcaacaagtatttattaagcagctactatgtgccaaactctgataaggggaggaaaggcagttaaagatgaataagacatggttctgtcctacaaaagtttatagtcttgttagagagacccacataacacagataagttcattacgacctggtaggtcctaaggttaagctgcatgcactgacttcagagacagtgctgaggaaacacttaacttgggctgggggagggggaagagggaagaggaggtttcctaacagaagtgatatttgagctgggtcagccaagtgagggaggatcaagaacagtccaagcagtgaagacagcatgagtaaagccaggagtaggaaatggcctggaagggtcagggtggggtgggtttagagctagaaggagatcagtatggccagagtataacactttgttaagacctcacagagaatcatgggggctgattcattctcttccaccctgatgaccacacggtatcctgtacacccctctcttagcagtctcatctcgtagcagtatctttgcattctgattgtccattcagagctttatctcccttacttggctatgagtacttcaaggacaggaactttgtccttttatcctgggaatcttcagtatgccgagttagtcagcaaatgttttaaaaacttctcccctgtgtaagacactgactgtgccaagtgccaaggatccagggaagaaaaaaataaagactttaagagctttcagtctttaatcaggcaaaaataaagtcctttaaggtagatgttaatacatgtcattatgtgctatgataggggcatgttggatatagatagagacagaggaacaatgtaatagtggcatgatactcttgtgaagggatggtagaaggaaaggtaattccagagtaaaagtggcgcttctggagaagacagcatttgaattggccttgaaaggcttcaccaggaaagatgatggtgaggtgattattccaggattattttgattggagtggagaaagataaatctacccctttcttgccatcctttgccctatagaaagaggcagatatatgctgttttgctgacataactcactctgaaatattcaatatttttaatttctgctaatctgaggagtgaaagatgagtattatttccctgacatttccctgtgaggtagagtatattttcgtaagcttatcagcccctttacttatattttatctgttatgaatcgcccactcacagtcttttcttatttttctattggctatctttttcttatttatagaaatatttatacatgacaaatattaaacctttaaaatatatgttacaaatattttcttccagtctgacatttggttttaaagtttgtttatggtatcttttgccatgcataaatatgaaacttttaagtatcagatttgtcaatcttttaagatttctgggttttgtgtcttgcttaagaaggccagcctcactctaacttattaaaatatctcctgatgtttttcttttctactttaaacttttttttagtattaggatattaatctatttggaatttaaattttagagtatcgtatgaggtagagatttaactgtttttttctctatatacctgtctagtttccccaaaaccatcattgaataatccatacttctctcctgacttgcacgtcatctttattataaactacctcccatacgtactttgatttgcgtctaagcagtttattttccttcactgatttatatattcctacatactattagcacaacttcatgatatgttatgctcacaacatcttctcagctatttttattcagtttctcttctaggtgaacttcagaataatcttatcaattctataaaaattttggtgaagtttttatcaagattgttttagatatatgagtttatgtgaggagaatatacctttttattatattaaagcttcccatccagaaatgtggcctatttatttcagtcttcttttacgtccctcagcagaattttatagattacacaggacttgcgtatttcttcttaggttttcctaggtattttatagcttttgatgggctattacgaatgtatttttattccattactttttctttttctttttctttttaagagacaagaagatcttgcactcttgcccaggctggagtgcagtggtgcgatcacagttcactgcatcctcgaactcctgggctcaagggattctcctgcctcagcatcccgagtagctgggactacaggcatgcaccaccacacctggctaattttttaaattaatttttttgtaaagaccagggctcaccatcttgcccgggctggtcttgaactccagggttcaagcaatcctcctgcctcagcctcccaaaatgttggtattacatatgtgagccactgtgcctggcctccgttaaattttctaattggttgttgctgattaaaaagacggctaatgatcttttatgttgattcttgattaactaaaattatttctgatagtttttcaccagcttctcttaagagtttctaaaaatacaaatagctgttaataacagtttggtttcctcctttctcatatgtatttatttatttacttttttttttttttttttgagacaaggtctcactctgttgcccaggctggagtgcagtggcatgattgtggctcaytgcagccttgacctcccaggctcaagcaatcctcccacctcagccttctgagtagctgggactacaggtgcccgccaccatgcccaactactttgtattttttgtagagatgggttttcgccatgttggccaggctggtctcgaactcctggcctcaagtaatctgcctgcctcagcctcccacagtgttgggattacaggcgtgagccaccgcacctgggctcctttcccatatttatacccttaaatttttttctggccttactgcatagctagatctctaagacaataaatattagcaatgataactgccttgttcctgtctttaatgcttatcaattattgtaatcttactaaaacagaaaccccttccatagcatcctagataggtgatcattcagcctccactgggatgctcagagtgactgctaatcaccttacaaagctacttgctccatttttacccagctgtgttggagagagcttcctcctttaatcattaacatagtcatttattctaaatcagagcttgtgttgccctctgtgtctccttctagagatgttcttcttcaggtggagcctcacctttggaaataaacactctgcctggccccatcccactctccaccccccagttttgggagagaatcgttttcttagagaaatctagggaagcagcagcattagggcaaaggtgtggtaaaattcactcattcattcagcacatgttactaggcacctagtcagtgctaggaactgggcgtagagagtttaaaaacaaaaaaaagacacagtccctgccttgaaagagctatctagttgggagtacagatacataaagtaagatactgtgtgtgatctgggagcacacatgagagagcaactgactctgcccacagttggggaagacttcacatttgaacaggatcttgaaggatgaatagttagtaaaggaaagaagggatgagagatgggctttcaaacagcagtaaaagaacatgcagaaacagagcctgaggagcaaagggtagtaaaagtggagtggtgacaagccttgtacagatgtctgagcagtgggttggagcctgctggaggtccagtgtcctgtgtccttcctccagtggtgatagccctcctgtgcatgagtggatacctgatctggagraactggaagcggaagaacaccaaaagcatgaattttgacaacccagtctacaggaaaacaacagaagaagaagaygaagatgagctccatatagggagamctgctcagattggccatgtctatcctgcagtaagtatttctcactgggagaattcctaccttcygaccatcttcccttccatcctttcttcccctcccatcctttcttccttcccatcctttcttccctcccttccttccttccgtccttccctccctcstttccttccgtccttccctccctccctgyctkttttctttccttctttccttcctttcctccctccttcccttcctccttctttccttcctcaaacatttatcaaaaacgcaccatgtatcaggcactgttctaggccctggggaacacagaaatgctggggtaggtggttaaggtaaaaaggtatcaggaccaccttgtacctagaggctcttcctggcagtaaaaaaagccaaatgtctctctttctgctcagtaaattttcagaacctttagcctggaagggtaactgtggccatttaattcaaatgtattcatttcaatactgtatgccagttatgtgccaagcaccacattagatatcaagtattcaaaagtcaataaggaacatgcttgctcccaagaagctggtagggagttagagatactaacatacagtggtataattgtgtgctgaatgccgtggtggaagctcaggagtcccctcttctagaaagctatctttggcttgctttgttctcccacagtactctgggcctctctacctcacagcccctgtcacactgtagtccacttgtcttttactcagtggtctcctcactaacccataagatccttgagggcagaactgtctgattaatctgttttcctgatgcctagcacggcatggctgactcccaacaaatatttgttgaacagatgccatggaaacatcaacaagggagctattaattctgtctggggaatcaggcaaggaatgcctcacagagaaggtgacagatggactatgtccttgaaagattaatagcagttttcccgggagagaaggagggaaatggcattccagatagaggcatgtgcaaaggcttgaaggtacaacacagcatggctttttgggggaatgaggaccacaaagtggcacagcaggtgtcactgttatacagcacagtcagggggctgagtgtgacctcagaggtcatccacagtgccatccccctgtcaggcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaaggtagggcagtgccactctaagtctgaggggctggtgagtgagggcatgaaccaaggcaggcgcagccaatcctagaaggctttctggtttgggaaggctgcaaattgtaagctgggtgttggggcaaagaagaaaaatgggttagtcacagaccaatgaatggcatgtggaagaaagcaatcargtttggggcagggcagacagaattgctgctgaggcaaactgttcatgaaggggagacatgggaaatgagatggagcaaatgaggagggttagcagatggccttgaggatccttaacctcggccagtccaaaaawatagttgcttgaccagtttttgaagatcagagggagcacagtggaagaagcactgaacttggaataagaaaactcccagttccatccttccactgccctgtgatctcagtcacttctttctgctcactgttatttgtaaaatgagaataacaacccccattctacctgcctcctgagtttataaagtacaagtgagatagcacgtgtgagagcactttgtgacttacaaagcactctgcacatgtaaagtgacattatttccagagaaagaaatgactcagggggagttactcccgatgagtgttaaggaccaagtaataagcttctgccagttgcagagaaataaggaaatcaacatttagtgagcacctactgtgtgtcagacactgttcccagtgttttacatatattttctcatttaatcttcataataaccttatcaagctgatattattcgccccattttgcagatgaggaaactgagactcatagaaattgaataacttgcctaaggtcatagccaggaagtggcagaaccagaattcaaactccagtctgtatatacacaaaagcccatgctctttcctttatatcrtgaggtaaatagccttgaagctctggaaatcaatattctcaacaacctgtctctcctctgtccatttctcggataactgtaccatcactactggggcctatctttggcctagagatctgtcttagagagagtgggagggtagctagactagaataagatagtcttaaatatctacactggtggaggatggccattgcattcataaaaaaactacagataacccaaagatgacttgaaaggcagtagagttactttttatcatatgtagaatgtccagagatgggagatactagtctgattctattttatgttggttacgttgacctaggatattctgggccctatgtgttgttaggtactatgttaaacactctctgtgcattatctcatttgattcctcaacaaccctgtgaggtaggtcctgttactattcccatttgatagatgataaaactaagtctcagagaagtaaagtggctggcccaaattcacataactatgaggaaaagtactgaagctggggagggtctttccaaaggagggtatctgggaaatggaaaagaggcaaacaagattacatcaggactagytggggaaagttagatgtgtaccctggagaagaaaacactcagaatgaacggaagggaattcaaacaccatctataaatttcaagggttgtcctatgtagaactgtctctgagtctgagatggaatcagggaatgtcagaagatataaacaaacaaatttcacattaatataggaaagaatttaaatctgttgtccacaatggaatagactggytcaggggttagtgggctcaccttcccatggtcagccatttttggcagacaggagtctagcatctacctaatgactggaaagcaggggtgagggagagagggatggaatttaattaacctgcattgcctcccaactgtgtttaatctgttgggaaggtgcagtatattacctttctaaatgtgattagcatgctagagacaagtaaccccatagcctgaaatttaacatttgccaaagctaacccactgaaattgaccaaacctaaaatcctataagggaggattaagaaaatttagatctgtgcaactcttctttacaaagatacaaaacagaatgatgaaaaaatctacagctttggattcatacagacctgggatcaaattttagttcagccacttgctatgtgatccagaacaaaccctacttaagctcattgagttttgtttctcatctgtaaaataaataggataaatcctgtctcttaggatagtttgaacattatgtgagctaatacctgttaaagtaacgtaagtctgtgatttgtcaatactaaataaatagtaactcttatggatctaatgatgaattctttggtttgtctccccagcragtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataacyaaatgggggccaatggcacagtaccttactcatcatttaaaaactatatttacagaagatgtttggttgctgggggggcttttttrggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagrgtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagraaatagataccatggtttgtgcaattatgtagtaaaaaaggcaaatcttttcacctctggctattcctgagaccccaggaagtcaggaaaagcctttcagctcacccatggctgctgtgmctcctaccagggctttcttggctttggcgaaggtcagtgtacagacattccatggtaccagagtgctcagaaastcaagataggatatgcctcaccctcagctactccttgttttaaagttcagctctytgagtaacttcttcaatttctttcaggacacttgggttgaattcagtaagtttcctctgaagcaccctgaagggtgccatccttacagwgctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccamaattgaagtcatatttgwggggggaaatggcatacgcaatattatattatattggatatttatgttcacacaggaatttggtttactgctttgtaaataaaaggraaaactccgggtatatgtatagatgttcttcattatagacatcttctttgcttttcttggccttgggggaggaagggagaagtgctcttttctacttgtggggtctcccattggaaacataatcctatagtcccagaaggattcagtccccagtggctttcccatccaaagagaaagagtttgagtttcttaactctgctgttctgccacttactcccactagacaaccagggacaaggtgcaacatggaagtgtttgacttaagtaggagcagaggagctgcatctaatctcatcatacctggaacttgacacacttaagcaaatgccttcccatccctacctgccagatgcccccaactcaatgaagttggatgtctcaccagcttgataccctttgaattttcagtcagacattctggagttctagcatcctgtacctaggaccttcctctgtgtcactcttggcctcctaaactctaagaaaataactatattctggagcttgggcagtgtgttttgcataatccagcaatctcctcatgacatgcatgtgttgatagtcctgaaacattcattgagagggtaaatgcagttgacctagaatgaccaataccaaacagaattttaagaacaggtggccaactcctatggagcttactcacatattactattcttttaagaacggaaagtaaaattatttttgactgaagaaaaatgatgacagtgaaaaacatggaaatgtactcaaaacaagtgactttttctgtaaccttccaaagaaactgaattttccaaggaattaaatgataacagtggctaaggcatagtttctaaactttcagtaagatcctggcattcacagaaaaaaatgatgaatggggtctggacatacagcctgagatctcaaaatgacaatgaaattcacaactttttctcagagacattcatgtttcctgcatatgctacaactgcagtttgaaagaggcagcaatgggagcaaccctttacaagaaacaaattgtgatatattcatgtgttggacggcagtaaataagatgaaacctgaggagtcagatccaccttcccccattcatagaggcttttcagcctcattttgaggtacagttacatatcttttgccttttgcccccgtgcatagctatctacagccaatcacagatcacagagtcactggactatagagctggaaggaagctcagagacaatgccaagggggcagaaaatttatcagaagccagtcccagtgcgtttcctccatttccttctgcaggaagactattttgggctgcctgaacattgtatcaaacctgctacctatactatggtctacctttcctccagtggaattacaaaggcactaactgaaatgccttctagaaacagagaaaacgaaactgtacttatttactcttgatacacagattatttataaaacagattgaagtaacctgttaactggcaaaaagagaatgagatcggatttaaatgtatggcagtaagtcctattgatccctccagttatctcagtatgactgcagtatattcattcactaaaaccactcactagataccaactacacacctggcactgcagatgtaaaggtcagtcacacatgttctgactttacagagttcacagtagcagtggaggatgatatatgtggaaacaaaaaaggcattgattctattcagagcactgttagggctcaaaggagagaggggtctttccacctaagaaatgaggaatagggtcatcatagaagtgaccttaagtcttaaaaattaagaaggggattccaagctgcttcagacagagacacatcgagctaaaacacagaggtatgaaagagcacagggactttaggaattgcacagttcattctaacaggaacaaaaggctcaaggggggcaagaaatgaggctgtatggaaagagattcaatgtaagcactttataaaatagattaatttctgattcaatgaagcatttcttgatcattgtgtacaaggcactacatgcatcatggaaaattcattaggatgcattgccagcactttgcagaactgatattattcagcctcaagctttccagtggccaaagggaaatgctgactgcttttcatatatttgagtcaaagattttttatatggtcaatgaagactaatataagggcagtgggattttcacagatgcatgccatgttgtcgagagcctcttagattttctcaactgtgagaaagaaaaacgaaaatgttgaagacgttgagtctggagaggggatactaatcactgtccagttgggcactggtgggaatggggaaatggcacaggaatgcaagcctctccaccctaccmccckaactccagccatacactcatcgtttcacaaaatataaatgagttagcattaaatgtttcagagtaaataattccttttcccgaaatgcatgaagatagagtaacagacttctcacactgtatttttagggtatggagaatttagaaggttaaagaattactgcttcaatttttcagttaaaaaaaaatcaggaagctctgttcattcaggctatgcaccatgtgcacagtcaagaattagcagaaaccctctgcatttacaaacactttgtgctataaaaaagtaatttttaaaaagccacgtgtgtgtgtgtgkatatatatatatatatatatatwtaaagccaaggttttgatacttttttacaaaaactacaagagaaaacaaatatacctgtccaaaccatatacttttaaaagagcatttttttttccatacaagctgttgttaatttgggggtaaagtgctgatttgcaaacttcatcaaattgttcccaagtggattctccttgtttgtctccccctaccaaccccaaagttaccatatttgatgtaagaatcaggcatgttagaatgttgtgtcacactaactgattctgctctttttgtcttgtcattcaagttccgttagcttctgtacgcggtgccctttgcagtctggtgtctcttccagaggcgagggggctgaggatggggtgctgcatctcactagctatactggcatcatcttggtaaactgaaaaccaaatgtggacatttgtaaaatcagtgcactgtttctagagagagattaaattcatttaaaaaaaatcttttaagttttgtttcattgtaatactttaatgagggggagtgaactattactgagtccctaatgtgtaccagtattctayataaattatcccaatctttgtcaacaattcggtgagataaatactatcaatactatccactcccattttatagatgagaaaatgggcaaagtaactgcccaaagtcacaaggttatttttagtgcccccaaagagcaattgtacatgtagcattctctgcctaaattttccttctctgcctccacatgactaactcctatttgtccttgagtactccacttaggtaatgcctcctccaggaagccttcccttttctctaagactaggttagataactcacctctgtacttcgataacaatttttgcctacttgcatcccaawacttctgccttaccattcattcccatgccattggggttgcttttgccaaggtcatccaggacctcctcgattataaatctggtaaacattttcagtcttgctcttccttgacctggaagcagtagttaacactgttagccrctcttttcttggcayattcttattttggcttccatgataacatttcatgttttttctcctatctctctggccacatcttagtatcctttgcctaccccttaaattatggtattccatctcaaatccatccacttttctatctccattacttttttttttttttttttttaagagacagggtcgtactctgttacccaggctggagtacagtggtaggatcatagctcattgcaacctccgcctcctgggctcaagcaattctcctgtctcagcctcccgagtagctggggctacaggtgcacgccaccctgcccagctaatagattacttaaactacttatctgaatgtcatacttctagtcttttcattttccaatctaacctacaagactgcagccaaagtgtctttctaaagtaccatagatgtatcaccaccacttctttccactttcctgcttaaagctcttcaactgctttgctggcacaaaaatccaatattcttgggtttgcccaaactcttttaatatggcttataaaacccttcatgatttggcttctgccctgtctccagcttcatcactcactactctatattctaatcacacagttctgggcctccgtctggaacatttccttcaggaacatttccctaaggaccctrcactggattaggagtcacctcatgtgcttccatagtcctctgtgcttcctttattggtaatcttatccttacattgtaattgcttgtatgctccttaactgcctcctctgcaagctctgtgaacaactgtcttgctcaacattgtatcctctctgcacatgacactcagtggatgctcaaataaatgatgctgaatgcaggcactgcagacacacagaccatgctctttcagttacaccatgtctcatatccagaaacctggattacttcacagcctgactggagttgtgtgtcctttaaatttctcaacacttttgttatttgccacatctgaagatccccagattcacttatgatttttataattttactcctggaaaataaccttgtagcaattgcttaatccctctacatacttaactctaattaccacctcaagattgttgtgatgattcaaagaacaagcacaggtaatcccattgaccctaggggctgacatttattaggtgcttgatacctggtcccttttctttttttctctttttttttttttttgagacagggtcttgctttgtcacccaggctggagtgtaatggtgtgatcatggttccctacagcctcgacctcccaggctcaaattatcctcctacctcagcctcccaagtagctaggactacaggtgtgcaccaccacacctacctattttttaaattttttgtagagacagtctcctatgttgcccaggctggtctcaaactcctgggctcaagtgatcctcctgcctcagcctcccaaagtgctgggactacaggtatgagccactgtgtctagcccccttctcgtttatacaattcccttgttaccacccatatccagtgttttgtaataaaaatgtcttatggttttacagcaatttagtttccgagacattgtttcttacaacagttctgctaggtgtacattattatgctcattttaaagagaaggaaactgaagtctaaaaagttgagtcggttcacctttggttacaatgagtcattgttacacagggattattttaacctgtgtccagtgatttttcccccaccacacctactctacactctgctgctaatgcttttgcagggagaaaaggactccgtgttaagactgagggccgggcgcggtggctcatgcctgtaatcccagcactttgggaggccgaggcagacggatcgcctgaggtcgggagttcgagaccagcctggccaacatggtgaaaccccgtctctactaaaaacagaaaattacaaaaattagctggacatggtggcgcatgcctgtaatcccagctacttgggaggctaaggcaggagaatcacttgaacccaggagtttgagaccagcgtgggcaacatagggagactttgcctctacaaaaagtttaaaaattaggtaggcgaggttgcggtgaactgagatcactccattgcactccagcctgggcaacaagagcgaaactccgtctcaaaaagaaaagactgggaataggaatcagagactgctgtcccaacttacagaatcgtatacagttctagccgccaggacccaagaatgatgtcatctcggcactgtctctagaaccattcattctttctaagcctggaacttagatgagtgaaagcaggttcctattacataattatgatcttgattgccctgggcctactcaactgtaaattttttccagagccagaaaggcttcacagaggacaactttaccctgaaaagaaaggacctctttggtcagtggtcctcaactctgactcacctgaaagctttacaaaaagtaccaatgcccaggtccagcgctggagattttaactggcttggggtagagccctggcatcagtatttttagaggcttcccaagtgattgcaatgtgcagccaggcagagaattactgctcggtaagtgggatgactggggagtgggagatcaaatactctaacgtctcccagcacctattctagagatcagtggggcagaaaggtagaaataaaaggtggaaagg

SEQ ID NO: 13333 - DNA, 28190 bp, Homo sapiens
cgataattttagaaaaaaagaggagcacattgactcaaaaaatatgttgaagctaaaatgattgttaaattgtagatgtggaaattgataaggacaaaagatgcaaggatgttgcttcgatattagcttgaataaataacaggcaaatgggaagtgaatgaggacaaacaggtctgggaaaatgatggaaacatgatgtgtccagcttcggaccatggacatgggtgcagccataatgaggggaggggtcatggctggagatagagttgcgggagtctttgttrtctctttctttttyccccacccaccactcacatccgattcacattctcatcttcctgcccatacactcagtgtattatgactaatcaacaggggaagaactgagcaataattttttctgcctcctcctcatttttctacaagtctaaataagggtgtcatgattagaaagcaacgcaaattatctggtccaaccctaagataaaatgcatgactaccacaaagttcctttagtttctccttgccatttccttcctagaaatcaagggattccccacattattttatataggatcaaatgaaatctgcctgcagggcatgcatatatgtattttagtagaaagtgtcaatctgtttctgctcttttagccacccttaataaaaaaaagatacaaaaagtcataagaagataaaacaaaaataattgacatctgaatttagaatgtatcttatttagttatttagttatttgtttgtcatctgagtacatacgtgctatggcaattaacactgaataggctacttcccctaggcctagaacactggctgagatgcactaggaacatgctagataagagagagactaaattaagacttgttaagtaatatgaataattcatttaatcataattaatccacaaggataatggagaggtgagtgatgcatggaatcaaggttatatgagtctaatattatatattaggccctccaaggaaacacaccattgtaagcccggagttttaccagtgtgtacaaggagtgaattcatgactcacagtgttctgaggctgctctggacatgcaatcttgcatgcttttgtcatgacaggtcttaagaagtttatcagctttctcaaatagctgaatgacagaacactggatttttgttcagatagcctatcaacttggcatctgtgttgcggttgtcacttggtaacaagataagtacttcgacagaggtrttacactccctaacaaagctgacttcatgtgcagactttctcacactcatagctggcccagggccacttcttaaaataggtgaggtttgttttctttgscctgtctctcgggaccttgcctcccggtggcctaagcctatgcttattcaaagccttctcattctcctatcctcgtcacacaccccgaaactccttcctggaccacccctttctctgtaaaacccgcttcacaggaatttagatacatgtaatatttctcccaaagccgttaacaaacaaagtgttgttgctaatttattctctgataaagagatttcaaaaagtgtatattggagaatgttttagccaagatgtcccaaattcacaccatggaggtgactgccttcacctccatttggttckgctcacagcaacaactacttaaatttctggaataaatcatgctatctaactactaaggctaattaatactaatgatctttgctataaattaacatagtttcaatatgtctaactggaagtcattaaaaataaggttattatatagaattttatattaaaataggactttcttttgacctacattcatatcatgtttgagataatttcagtggtgatattactgctgatacagaaatgatgcattttcctaatttgtacattccccatatatccacaaatcatgtaaaataggtaattwtggaagtatcactgtttgctcttcaaagtgaagaggatagaaatgcattacaatgtgccaaacatgagtaagtcattcagcaaacactaagtgarcacctaatatgagccaaatgcctgtcctagccactggggaaaaccattatagtcttggagttcatggttgttaccatccagcagggaagataggcactgaagagtaaactacacaggttatgcaatcacagttggttagatgtttcaaagaaaaagcacagtgtatgcaagtctcagattagatattagaactttattacttataaagttattgtcttcttttggaaattatttctcctttatatatgattcattgtagtgatagtcaggagagaaaaaacacctcaatacagaaactttggtaaattatttctgattttaaaagtaatgcatgcctattatggaaaatgtgggacttttttaaggtacaaagaaagacaatggtaaatctataaagttaccacttagacataaatcctgtttatgttttgaagaaatattatgttaagtaatatttcttctgcatgtattgtatttatataattaatatcatactgtccatataattttatttcctttcatttcccccttatgattatcttgtatacattttcctagaaaataagacactttctgtttcattaatctcatattccgtaggagtgacctgctctgcaattgttgcctgtaytatttcaggttatttgagaaagcttaatctgatgtattttctattggtaaggaacactctttagtgactgtgctttttttctagttgacctactggctgggtgactgctatagtctcctaatacatttctcaccctttagattctttctcttctgaattttcagatttttcttcataaaacaccactttttacaagtcacttcccttctccagagtttacagtagactgcctttagcttagatcccaactcagcctgagatcaaaggctcctctataagatctgttccttttctcctttcctcctctataagatctgttccttttctcctttcctcctctataacaccaactcggatccagacagacctcaggaagctattcgatgatctttgcttcccacttctataatattagtgccttcctctctctattgtctatttttcatttatctcagctctttgctcaagaccctaacacacattatcaatcgtttcccttctttctatgatacttactattagcaccactcaatttgggtttaagttacatrttatcttttacaagtctctctagttgtttgaggtgtgaaagtctagtcttcttatactagagctcataaattgctctaatctaggcagaaaggcagctcccaaaccggacactaagagtcaccctattatatatcagctaatattatgcggcactcactaccaacgagaatctgctaaggacttggcaggcatcatctcgttgattattcacagcagcctgtattatttagaatgcttttggctgcaaatgacagagaacccatagcgtcgaatgctgcttaaacaatacagacttgtttattataatatctcagcaacagcaagaacaaaaactagaggtaggtggtttctagcactggccaawgtcagagctcttgtttgggatcgctgcaaatttctcagtcttcctatatggttgaaatatgactgtgactgtggcatcttctggcatcacatcctcgcacaaccatgctcaaagttgggtaggaagggatggtatagatatggaggttctttcttcatgctttcttctgttaaggaaagaaaaccttttgccaaacattccccagtggatttctcccaaaacgctttgtccagaattgggtttatatgtccacccatttccaacccacccccaccctgcccaacacacacacaccccctacaagactggcagctaggctttcctttcctgagatcaagggctctctgaataatacccgaagaaaattaggaagaagggtagcagaaaggcattgattggggtaggcaatcaacagtaccagctgtatagaattattagaaaattagaagttagagtagttgagaaatacgtgcaagattatacaactagtaaayggcaaaaagaagattctgagtctgagacttttctgagtctctcagtattcatatccttgttcaccacagtatagggcctctctagagagttttagcatgttactccacccattaaaaatatttggtaagaatttgcttgatgctcaccactgttcttgctgctcaagggaaaccaagtatatatttgtggatagatcctaactcagatgatactgtcagaatatataagattcctataccacatcctgaactctgaaagttgcagttctacgtagaagttcactgagggttgtaagagtcagaatggactccatggaagttatggggtgtgaatcaaacctcacaggtgagtcagtggggagaaagaagcatgacattcctcttgagaataactggaatgaaaataatacggtgagaaagagtagcacctgaaaagtgagtgaaggaaagggtggtggaagttctaggtacattgatatctgtcccaacttgttgagctgtcaatgtgtggttaaaaaacagttaaacaggccaggcccggtggctcacacctgtaatcccagcactttgggaggccgaggtgggcggattgcctgaggtcaggagtttgagaccagcctggccaacatggtgaaaccccgtctctactaaaaataccaaaaattagccagtcgtagtggtgggcacctgtaatcccagctattcaggaggctgagrcaggaggatcacttgaacccaagaggcgggagttgcagtgagcagagatcacgccattgcaccccagcctgggcaacaagagtgaaactcgatctcaaaaaaacaaaaacaaaaacaaaaaacagttaaacagatggttggtcacatagacattaccagaggggtcttcttggacagaggctgaaaagaaagaagggacttagctcaccaccagactcctcagcactcacgggagaagagcactaaggacaaaggggcacttaacacgtgtaaaagggcaatggctcctaataaaggataagatctgttttctttttattttattttttgtttttgagatggagtctcactctgtcacccaggctggagtgcagtggcacagtctcagctcaatgcaacctccacctcccaggttcaagtgattcttctgcctcagcctctcaagtagctggaactggagatgtgygccaccacgtgcagctaatttttgtatttttagtagtgacagggtttcaccatgctggccaggctggtctcaaactcctgacctcaagtgatcctcccgcctcggcmtcccaaagtgctgggattacatgcatgagccaccacacccggccataagatctattttataatcaagagaagatgaaaaattcttcttgtgtcaggatattagggtagaatccgagttatttcgaaaattacagcttgagacaatgtaagacagattaaaatagagaatttctaagacagaaaatggattttttcttccctcccatgccctaagcatcgcttgggtctccctaggctcaaaagagagagtaaatctcattatatttatatattggaagaagcccacaggccatggttgtccaaagctagaagaagtattgtagaatttgatactatccttgagcacaagtatagtgggggaaatcttgaaactggggctgacagattttagctaactttcacaggcatgtgtagatattgacaaattcttaagtttcagagtgacctcatcctcccccaaaatttcttaaaccatgcctttacaaacaagtatttctattctaatgatgtcttcctgagtaaaatgttgaatcactcaaargacacagatcaaaagacagagggagaaaaaaaaatgccatgtgggaggggcaaagctgtataaaaccagtcattaccatgtctgaactgtaacaactctcagaggagcattgcccrtcagacagcaactcagagaataaccagagaacaaccaggtatttcaatgatttccatgccatgtctatgggaaatagggtttcatgttttctcttccctcatgctggtattaatagattgaaaatttggatgtggggtgtttgtagagggcgagtaaaatttaagtggtgttttcttgtttagttgttgaattgaaaatattttatttcaagatttgaattaaatttataaggtttaattttgaatctcagaagccaacaaatacctttgtagcattaaccaaaacaaaatgtacattcagattgtgatgccaattttattgaacagrttagattatatatgttctctactagctactgttttgacactaaatttgatggaaacaactagatacattaaaatattttcatttaagcaattgaatgtaatctctacattgtatataaataataggaaaagaagacttcatttgcaccttaaatgaaaaagcaggaactgcaaaaattaagtagcaatttgggctgggtcaatctagtacaacaatatgtttattgagtttagttcaataatgggtcaatttagtgaaagagaataatcagccaaagtagttgcagggttgactgaagtatggttcagtaaataacttaatatcccataaaaagatacttattcattatgaaagccatcaactaggagaaattgcttttaattctgttgggggagatgtagcagtatttgatgagatattcccttgaaactgttgttttctcttagttctcattaatttttgtggtcaatttcaaaatatttccactgtctaattgtaaacaaaatttgttttaaatgctacagcaaactccaatctaacatccagggccaacagggtgagagacaatggccgtgtgcctggtgactcctcccaaattcttccttccctgtgccaagtttcagtggtgcatttgtcaacttgtgttgcaggaaccaacacacacaccaccaggaagcccaaccctgcatattactcccattaattcatcccagtaatactattaaaccttaattaagagcatactatttggaagttaatgagatcatataaattactataatgttaaaaaattcacaacaggtatacctgttccaggaggctgtggtatttcacaataccccatgacttcaattttgccttgttttgaaagattttcattcaaacataaagtatggccttatctgagagtcaggaaacactgcatatgggtgccttcatagatttctaaaattatgaaactctcagaccttatttgaaaagtttgtaggaaagcattagacttggaatcagaagtctgtgatccagtctaggcttctgaaatggaccagctgtgcaatctctattttcatattttcattcatattacagaaattactaagccttactggacaggtaattatgcaaattgaaaagggagctgaaggaatttggtgactgccatacagacatcaaatattatttttacattaaatgtaattaattacaccttatttaaaaatataattgaaactatcttttttgaaagaagtaaatgcatccaggaaaatttgcttctgttcttattaatttttttctttatcaagttaccttaaattctaacttagtattaacagaactttctgttagtttgtctttagagttaaatatttttactatcaaagttactatgtggattgttacaaagaatccggtatgaattgttacaaagaatcacgtatttaggtatgggaraagtctaaatttatgtttgtggctctgatctcttatttacatttctcacatggggatcgagaaatattttatttgtgttattaatactcagtttgtttccaaaagatattgagataattaattttaaaaatctgtacaataaatctatttaattatgaagacaattttaagaggaagaggaacaaatttttgagccatccaatgtaatctagtatctatgatgaagcaagagaaaaaaaaaagtgactttttgtttttacttcctaataagccttctagtagrattacaggtttactacttttttcttttgacttcctctttctagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggaggtgagagagttttagggatacgttttatttaatttactatttttgtcttgataaaatagtctggttgtattccaaatgagacattttaatacaaataaattccaatcactttcttaaaaaaaaagagttcatgaatcaagggttcacgcaagaaagaagcgaccartggtccttgttggagagcaatgctgtgtgagaccacaggtgtacacagccaagaccagagccagaggacatgcttcctcctgggtacttccagcccctccccagttcggggaaggcactgtcataagaaggtttcctgagggatgatcagtatcagcattgtttggtatatttayatattttgataattatcgggtatgttgcaagctatgatgaaagcaaaacatacagctggaaagacgatcattggtcaggaccaaaaaacacacacaccttgggtgtgagcatgcattcagttgcctgcagagcctgaggtcagggaaggtctcagatggttcataccttggtgtatacatgagtttcataggcctgggattaaggattatccctgcaatcttgcctggcattgactttctacctggtggggtggcagaagaagggggtcttctagtcctcccagtaatgaacaccccagtataggaagtcttttttagtaaggctgtggtatgtgtggtgcatatagggaaggggttctgggataggggctgggtgaaactccaaaccttcaaacaatgagtcaaagtcactttagaagyaggaaagcagaaagaagattgaccgtcttaccagatgcaacaaggtatgtatgcaggtggcatatatttcaatatgtgtatatcttcctgtgtggcagtgtgtgtggtgtggatgtgtgcgttgtgcttgtgggggcagcataraagttgagagcatgatcctagggtctgcctatctggcttcaattcctactcctgtccctatatattgtcattgttattctatggaatgccacaaagtgtcgctgctcatcatacaaaacacttcatgtatctcaggactggctatgtaatttacagcgtctggtgcacaatgaaaatgtgggccttttgtttaaaattatcaagaatttcaagatggcgataggagggcatttggctaaacaaggggctttttacggctgcacaggtggtatgtccatgaagctgtccctgacctgcctcatgttgttccatgaggaagaacagacagggaatctgtccctacacagaatgcagcctgtcctactgttgctgacctcacccaaaatgttaccttatgtttcagagctgtttttttcttcctstctttgcttctagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgagtttgagctgaagctccacatttgggcygmgkagttcctgaatggaattggagaactgctcttgttttatgctaaagacattttaactcaggaggtcagcaatcatcacaggtaatgaagcactgatccttacaacacaaattccttagattcaaatctataagacagccaagccccmgaatccctcaactgtagctgttgaaggcatatgggagttgaatagcctgcaaggctggavacagttatgagtgaccacatcttatattttaataatataatattctyatttttcaaagttagtgttttgtacccattatctcattcagttttaagacagatatcattttacagatgagagccctggtggtgtcagagaagcccccactgtctcctaactcctagcctgggctccttcccattactgtgccactgtggtgtttgttccctattcctatgaagaattccttctaataatgttaagagagtatcacaaagggaaaaaaaaaaaaacataccagggtggtgctcactatacccacaggatgcatggatagtgttgtagctgcaraaratcatgcctgtgaggtcacggtagcaraatgagacctggcattattatggccagccctgaaaaccaaggtagatgggatgcacaacatcattgtgagggatttctgcaaggccactgcctgccttccttggtgaatggacgyggactcagtcaggaaactctttccacggagtctgggcccttgaaattatgccggactacttcaattatacactgcaatcgttactgtaatagtcactcagcacatacaaaattcttgtgatcatgttacttccaaggttagtgacctygatgtggccatgatatcattaaaattcctttgcattcacacatacaaacattaacattaaatgctttaaggacamgcatgcattgtgcatgcagtcacaccaagatgccgccggctggtttccagtttcccacgagaatgtacctgagtgtaaatacattctttccatgcacatggtgacccatgtaaggtgggcctcatttgaagtttgaagtttcacagagagagcattggccaatattgctgcaggaagacaagggatgggtgaatcaatctctgtgtttgtgacagtttaaacattgagacttacaacaaaactcaattgctcaactccctgacacaagtagtcttttgcaatattctttccccattattttttattttttgccttgaaagaataaagatagtaaattggcacaaaagctttagaaacatcaggtctyaggtttttttcttttttcctttcttttttttgagatggagtctcgccctatcacccaggctggagtgcagtggtgcgatcttggctcactacaacctccaactcccrggttcaagccattctcctgcctcagcctcccgagtagctgggattacaggcrcctgccacgatgcccatctaatttttgtattagtagagatggggtttcaccattttggccaggctggtctcaaactcctgaccttgtgatccacctgcctcggcctcccaaagtgctgggattataggcgtgagccagtgcacccggcctasgtttttttgttttttaaatgtaaaggaatcagtagcaatatattttgggagcaaatgctaaatgaagtgctstgggttgttaaagtaaaaatcttgattttggtactagaggaaaataaactgattgctctggacacaagacagcttttctgtgtctaagaagtgctttaagcctttgggactatgmgaggattctatatagtctttttttttttgagactctatatatatcgtcttttgacaactctgttgcatgtgtagattttgaaattcaaatgttaatatgattgcttcccagataaaaagaaaaagacatttattggctggagaaagcagcacagactttggggacagacgtatctgtgtttgagtcatggctttgttccttactacatgtgtgtgaggacattgaaaccatttgcatctcagttttctcatctacaaaatgggaataaaaatgtgtagcatgcaagaaagttgtgaagattagaggtactatgtaaggcacttagtagcagtygctataataacaaccaatacttattagtgccttagccaggcatctttctaagaacttcttataaatttactcayataagacaaaatattatgaggtaggtacgatgattaccgtactcattttacagatgagggaatcrgggcaagaagaggccacacagttgagaattgctgtagctgttagaagtggtacatttgtagtgaaagaaaagaatacataaaagatayaagctcctggatggcataggtctgtgggaattaggatataagctcttttccttacagtgaggcaacagacccatccaggccaaactgcctcactattttctctgtggcctttgtgtggactaggggcagctcacagtcccacttttgcagggacatctccctgagtgactttaacactgattcaggaaggctttagtgctagcccaaagaaccctgatttaagggtcaatttccttggaagagaggaaaaccagccaagctgtcgtaggaaatcttcttcttttacgtgagggtggagttgcaccacttmttttcagagagtactaggcaggacttacgatgtatgactcaaagagcagaaaaagacctcacaaaccctaacacctctccttctagcccagaaattcaccaacttgctggacaaggctgccttaattaacttcattagcagaaccccaaccatcaagccacttaccagatcagcttctcctcagggaccccatagggaggtgctgcaggaccaagggttcccaaggaggtgggatggggtgggtggctgggaggcagggccagcttgcaggtattaagactggcagaccaaggcgggcaggcagcagtgttgtgggaaggggatctgaggaagcttcagaggggacagtccttgctgccagcttccccgtgtcagccaaaactgcctacttactatacgaagagattcacagtgtcatcagaccaacttgtccctcacatggacataaatttctctgtgtatgaatatggtatgtgtaaatattttaggtgaaccctgttaatattgcatgacctgttttatgccttagctgactctggcttgtagtttttgacagattgaaagtattttgtgtataaggccactgaaaagagagagacacacaaggttctgagttaatcttgtgactttctttaaaatactggcatttttttttcaagaccatttattggttggatataatttagataatttggggaagaggttttaaatyatttcataataacaatttgttttccaaaatggccaggatataaattaatctaaaacacctcatgctgttttctataagggaaatttaggttggctgatacttttatattacacagaaagagtattgagtatctatggytgttccccatgtataagggmagggaaaagatctaggaccattttagagccacctgatagccatctgttttaaaagttcagtaaatccgtgggcaagtgtaaccgttttctctaattctgattgcaggtgcttcagtttaatgaagtgggagccaatgcagttacccccatgactccagagaactttaccagctgtgggttcatgcagcagatccagaagggtagttatcctgatgcvattttgcaggtatctgacttactggtccaaatttcttttgtggtttatttttgcaatcttcctgtcttaaagccacagtgtyagactgggaaggaagcgaatataccctcccccattcacagaaagaaaactaagactcagagtcattaagaaaaacatgtcctaagatgatacccataaygagagacragccaggacagaatccagacttcatgagttttaggccaagcctatttacttctaaattctctcatgcctctctgtcattggtgaggtatgtgtaatttatcataaatccacagtagagactcctagaatacacgtgtatggataaggatttccagaggagagagggtagggactgacaattgattgagaaatggcagaaggctgggcccaatgattgcatgagaaatcactgaccttcaggtawctttccttctatctatctaatctatcatctatcrttgatctctctcatctatcttacctatcatacatctatcaatcctatctatctatatattttatgaatcatctatttatcatctatcttctctgtcatctgtctatcttatctattwatcaatcagctatctcggggagtaacacctttcctcagtactccatttccttaaatgtcagctatccagttaaattataaaaactgagtatagactgctcctgttggcaaccaacttccacagtcatgcttatgaggtagattatgaagaggtatctcccaaagctctcttcctgggcactctgaagctccttctacccattgcccagggaattatgggctagaggaggtggacaggatcctgatcatgtggagattccgccaggtgttctgyggtacctggcagtccatcaggagggctctgtcccctgccctaggacaggctgctgctgtgaccaagccctgtgtctgacatggtgcttacaaacttcagtttgagaactgaaataaccattcacttttgtggttttctaaaacccatgttttccactgcatagtttgccccataaaataggtatctagagaagctatatgaactttgtaagatcattactaaggcaacatttcctccctgycarctttactgaggtataatggacaaataaaaattgtacatgttcaagatgtacagtgtgatgacttgctatacctatacattgtgaaatgattacagtcaaattaatgagcacatccatcactacaattaccyaccatttgtatgtatgtgtgtatgtatagtgaggacacttaaaaaatatattcttcacaaatttcaagtaaacagttttattaactataactattaatgaacacaatcttattaactatagtcattatactgtacattagatccccagaacttatccatcttataaatayaacaaaaattccttagagactttgaagtttaggaaactgagaaggggcctttcttctaggctgttggtcacctggttaaatccaatccatagacasagcaaaaytggaaagaaattaaaattcaccttattagttttaatgtacyacatccttatcgaaatgattttctcaaagattcctctaatgtaccaaaaataaagtatgtattaatatagcatttcatgattgtattcaaaaactattaccatggcttaagaactatcttgtttagtagttctgtgttatatataaagaattccttctttcttttcaaggcacaagctgcagataaaatccattcatccttccgctctctcagctctgcaatcaatgcatccacagggrattatttactggaaagtgtcaataagctgtttggtgagaagtctgcgagcttccgggaagtaagtgaaacctgtaattgaaatggctggatcccaaacaagtaatgaagtcactttcaragcagttctctacaattcwacagttcataaaagcagagttggaattccacaccagctccctagggctggccttgcrtaacagctgcccttcctgtaycctctggggcttcctcctcttcccattgcaaatgtcccaatctcagagtcataaatcaggaaaacaaatgcaactgttttccagagacactatcccccaagtcaaacctctttccttttattctgtctctataatgcaaggagtacaagagggtggatagagttggggwgtaagcgtggacaaaggggtctgcactctttcccccttcagcacctgccttccatagccaacctccactcccaccctaccccaggtctcctaatttcaatgggaagaccataattcaccattatgccatggcttgtttggtatgtattttatgtagcctttgtcattttcttgctttaaaggaatatattcgactctgtcagaaatattactcctcagaaccccaggcagtagayttcctagaatgtgcagaagaagctagaaaaaarattaattcctgggtsaagactcaaaccaaaggtaaatccaagaaaatattttatttacttctttccagttagaaaactctgatctatcttkttccatccatgaacttagttagccctcacccctttacaatttgtccaactgcagttactttggtggatgygaatttattcctgattagctcagtggtgttttaactgagaagaaataattgaggcctactaatagaagacatatgtttagtacttaaatatttgattttggatattgcttgaggatagaatatgaaaggaggcagaagctttcaaaataggaaatatcagcattgaaataattgtgagtctatgcccactgtggacaaaaagaaaacaaggcttgaccctgagcttagtaaatggtgtgagctataaagaatacaggcagtggaggagggaagaatcataaaattattttcactctttyttctctttcaccattcaaagccaatccatygtcaagtttttttggtctctgcttcatccctccttgattatctaagtcacgtctaccattttaactcatgcttttaattgtttcacaggctcctgcctccctctgtatattttacaatgaataaattatttaattgaatcatttattcattgtaatttagtttattaagtcatttattcattraattcattcattcattaagttcwattaasttcattcacttagtcaacaaatatttatccaccacacaccatattccagaaactatatgtrgagataaagataaaaatggtaaatcctgccaccatagagcctatagaggagggattcagtcatgttggcaattgctatagagtagtagtcagtgctttcattgagaagtacaggygytatgtgggagtacacaggaaaggcatctgactggatttaaaaatgattaaattgtaattgggaagacaggctggagctggccaggtggagggtgcatgcctggggggagatttccagacagagtgcacagaatatgcaaaggtccagaggtaaccctaaggagaagaatagagtctggtctgactgcagtgtggagggccaagggaaggaggtgaaattaaagaggtgatgcagtacacttattatgctattcccacactaaaaactgtcagtgacctcctactgtcctcaggagaaggtctcattctttaccttgacttctgagttctcagtaatccagttgactgtgcttggctaccactggcccttggagctccttaaacactcattgctgcctctagactttgtttctgaggatgcctcaactacaggatttaagttgcagtttaaattgcagccaaagtcttactctttcctggaagtgactcccaattacttcctgatcttttcttcttctcatctcctcatctgctttttcagcttcacaagtcacattagtgttagccatatatggccttaaacaattatggaactgatttttgttagtttgttttgcttttcctctcaggctctaattatttttgggtaggkccagtatgtcacacttatcctatgcccccacaaaaatttgcacagttttttgctgacagtgaaaatccttcattcttctgaatttccrggtagagttgtaggccttaagtaaacaattgctgaataataacatataaatgtatttctaagaaayagagatgattatgaattcagaattgtgtaagyatttcattcatttatgatctgttaggattgaaaatgtcctaagagagctcctatccatcttaccaatttgtggttggagcatcctgttcccaggggattagccggctcccctaagatcccactggtagcggtaaagccagggttgcttcttcttctgatccttagtctaactccagaattcctcaatcggatgtttaaaaattttataacttatttttttaaggattttcatttaactcttatgtttaagacattgtttcaagaaatagtttggtgtcttgctttattaattaccacaatggaaaatgcacataaactaagtkctatgggatttcaaaaaatatatatttatttgtttatctgaaaataattgatttccttttagttcttcattttcattgtggatttgtgaaatactgttctaaaatattgacagaccactgacacaaaggaagcagagaaagatgatttaaatcaaaagttcaagtaaaaatggagagcaaaattaaagagacacatggaagttttgccttctttaaagaatggcatgaattgtttttctctttagacattgtgctaaatggctgtaagtcaatcagttattttgccaaaatgccaagcagctattttggcagattgttttaccagcttttgtaagaattggagagaattgtctgtttcatcatgctatgatcraatactagttttatcatatayatcacaacattactataccccaatactaaccaaaaattttaatarcttgggaaatatattgaatgtatatattaaatgaatacattgaagatgaaactgatgcaaggcaggcaagctccaaagtggggcttagccttcaagggttcttggcttcacccaggaaagtattcaaggrtgagctggaggtagggtagaagaaaacagctttattgaagtggcagtattacagctccatgattcctcctgcagagaagggctaccccaggcactgtgctgagaggcacagctcagggcagtttkggggtcatatttatacctacttttaattacatgtagattaaggggcagtttacgcagaaatttctagggaacggggaataacttttgggtcatcaggtcattgccacagaaagaggtggtaactccaaggtgttgccatcacaatggtaaactgacatggtacactgcttccatcctgtccctggtccccrttttagctagccctcaatttggcctggtgtctaaaacctgcctccagagtcaggtcccacctcctacttcaaaaccacattgacctattaatttgttaagagtcttgtatttgtcagtagttttgactgtggaggcagaatttttacaagcttaccagcattgtaacgttgggaagactgctaacctggtggtgtccttttgcataaaatgacactaataaaacccacctaatagagtatcaaaataatatattttgatgcttggaatactgcagagcgagtactaactataaacaaactgcttcttaaaccaatttcatttttttaaatgaccacactcakttgtcattgtttctgtcaatcttctcgggcttactccttcactcccttctctgtatgatcatagtactcaatatattatttagctcaattacagaagttatcacacagggtttcacaactgattttgaatgtctcccccagtgttctaggctcatccaggataattcttcctttctcatctcttgtatctgcactactcttaatttaggtctagtatattttttacaaaacgtttttgaataaatgagtaagtcagatcctcagactatctagaccagatctagcagtacatgatatattttggaaaggcactattatattccctaagaacctctctttcacttccctctgatttgaataactttcaactgccaagctttgagaaaagaatataaaagggagtgaaaatctccattccaaacttgataggcggtctaaattttaaatgcattatttcttcattttttcttggattttgcaagcttttgggaaatttgtttcaattttaattttgctttaaataaacctaaaaaactttagcttgaagatkaacawctctgcaatttgaagaatttagtttgatggctactcagaagattcagtaagtaatttcacagttcttgattatgaaacctaaatatatgttatgttttctrtaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggtatgagacaacaaaatacatcttcctagcatatattttagggcttttgacaagatatagacagaaaaattagagaccgctcattatagacttgctagttagaagttatgcatgttggacagttgattgactctttagaaacagtataggtaaaggggaagactgtggctttttaattatacatgcccagactccaacgttggctctaccacttatttcaaagggctgtaaatattgagacatggcayggttcctggcccatagtamgaactaaacaagtgttttagaattatggttgtcattaccattgttgtccatcttactaaataatgggtataaagttgaayaagctaataacatcagagtacccactgtaaggatgtacaaataatttattttgttgatttaaaaaaatcacatttatccwacactaaagtagaaccaatcctcctttatgtctaattgtaaatctcttgatatcttataatcgacttccatattttaccttttaataatattaggctcagcrcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcattcaaagccttaactatgtcatacgtgttaccttcttgtaaaaatctgaccaatctgttaactttctatatcacccacaatatagtaaagtcactgatttttaatattagacttaaagttgttttccttctttctaatacttgctgtattttcttttgtttgttttgttttgttttgctttgcagctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacagsaggtgttatgacagggagaactggacatggaggcccacagtttgtggcagatcatccktttctttttcttattatgcataagataaccaastgcattttatttttcggcagattttsctcaccctaaaactaagcgtgytgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctrtaataaatatctggaaaaaacattaaacaataggcaaatatatgttatgtgcatttctagaaatacataacacatatatatgtctgtatcttatattcaattgcaagtatataataaataaacctgcttccaaacaacaatacatttgttgtcatttcattaggtctgcagatcatagaccttgactcctaggagttgagcattatgactcacttgygagaactcagaaaaaatagacaggatgaaggagccaaggacataacaaccttcattcaaaaagacccaatgttgagggtcagtgggatggggttgtatgaaaaatgggttagagctgctttctcacagcagcaaagacatagcaattcagaatagtctaggttagagtcctttggggaaaccactgtctaaacattaaggacaccaggattaatgaccaagtccagtggtccagacacagaagaaggcctcagtcattgagctcagagttgcaagcagtgaagatgggagatgggttgggtgcaagagcaggaggggaaacawaagatggctctttctaagtgtgtttgtttctaatagcagtaatgcttttgaatgagtcagaggyagaggagaacataattgaagacctgagaaataaggcaaattgtaggttgggggcctgaacaacagagtctggctgcagaagtgcggctggatcctggaaatgcagcacactccctttgatggcaggcagggatgcttgatgcactagaacatggtagctaaaaaagtggcctcaagacttagactctctgcctccaaatcccagttgtaacacttacaagtagcttcaacacaggccaaccatggtgcttctttgtgcttcagttttctctcagtgaaaactaaagaaaaaactgtttttatcatattgctataatgactaaatgagttcatatatatccagcaattaaaagaatacttggcatatataatatttaataaatattagtgattatgatctatcttatctttgtcagtaataaaactgtctcactctaagctggtcaaacacgaatcccagaaaattactcagttaactttttaaggcttgaataatggtgtatttcttctaatcagacattcctgaaaattaagagttgctgtttcttgcattcttctacttacttttaatttcatttctctatgtgctttaataactctgcaaggtggtaggtggtaactttgtgaattatcatgagtcttaaaatatccatatttcactctcattattgagttagagtatagatatacaattctgggttccaagtgcttttcagcactttgagggtatgattttattgtctttttggtacccaaaattgttgataggaaagttgatgttaagataattcttgccccttataattttcatttttttgtttttgatttttttgatatttcattacattaaggatattttttaaatcatattttaaaaagcttatcctgttcagcagaagaattttctatctggaaacttatatctcatttcagttctgggaaacctcagccctcactatgggctcaatatatcttcccaaaattaatatgttgaaactttaatcccaagtgtgatggtacttggaggtggttcctttggaagataattagggttagatgaggtcatgagggcagaatccatgatggaattactgccctcataaggagctctaggcamcagatctttttctatctgtcatgtgaggatataacaagaaagcagtcatctgtgaatcaggaagaggccctcactagaacctaaccatgtggaaacacccctctcagattaccagtctccagaaccatgagaaatacatgtttgtagtttatgccacacaatctatggtattctgtcatagcaacctgaaccgactaagacagcaattatctactcaattgcttggcgccagttgatctactctcttcttctggattcctactaagataatattgatgcatctgatgctcctctctctgtttccaaattttttgagtacctaataaattcacatggcccaaacatcaaatatcataaaaaagactagagtgaaaagtcttccttccactcctgttccctattcatttagctcctatttctctgtctttactagtaatatatgtgcatattgcagtatacacacagggtcataaataaaaacaacaaacaaacaaaattgttctaataatactgtattattaactttgtacatgattacccctttctctttcctagtcccccaacaggcaacaaaataatgtacagctatgattttactattgtaggcagtatacctatacgtagggtgatatagtttggatatttgtccctgaccaaatctcatgttgaactgtaatccccaatactggaagtagggcttggtgggaggtgtttggatcctagaggctgatcccttatggcttggtgctgccttcatgatagtgagttctcatgagatctggtcacttaaaggtgtgtggcaactcccccaaccctctctctctcttgttcctgcttctatcatatggtatgcctgcccccccctttgccttctgccatgattataagcttcctgaggcctccccagaagctgagcagatgccatcactatgcttcctatacagcctgcagaactgtgagccagttaaacctcttttctttacaaattacccagtcttgggcatttccttacagcaatgcaagaatggcctaatacatagggggtttaatcaagaagtgaggaagaaatctggagaasgttttgagggaaaaaatgaataaaacttaatctttgactttagggaagatgaaaccatttgttgcataaatccgcaaaatctacattgatgcctttactataacataagcaacacaagcaagttttcatgctgggtggtgttgcagcccaagtcactgtggtggactgctgtcagtcaaggcgagcagtccttctatctggaggctccatatgatgctttttctaatagcagtcctggaggcatccttggataatcatatctgctcagtgcaaagttgggcaggcatcatggaactttctagcacacatctcattccctagtgaaatccagagtaccactttgctctgggttccatatcaacattcaaatattaaagtctgagccatcttgccagaaaataagtatgcctctgtgaagagaaaaacaggaactacgtgagaaaaatatataaaatagtttataaatagagaggctccttctttgtcttaatccctcctggagatgtcttcctgttccaatccctctccccatgaccctccccgccttcctccatacacatgcaaatgaaacaaatggcctgttatttttcttttgtaataaataaggagtgaaaaagcattccttgggaaaaataaaagagaaccagaaaatgatgaactaacatccgacccaataatggtgtctaaaattttgatccaaaacccttgtccctgctagtggggaaaacagacatcccagtcattcaagtgatgctctgggttctacaccaatgctctaaatgagaacagaaaatcttccggggtgcctttcacatagtawctgagagccatttttaacaggcttacaataaaggccaggcatgatgggttgtgcctgaaatcccagcactttgagaggccagaggtgggaggatcacttgagcccaggagctagaagctgctgggaaatattattgcaccactgcccttcagtctgggtgacagagtgagaccctatttctagaaaaaacaaaacagacacaacacaaattaataattcagtaatattttcartttcattgatcattattattccactaatttgaagctttctatttgtgttttataaaaaaaatactacctgggaaaaccatgccaaatattctctgttggcagactagagaaaggattaagcaaaaaaaggatgagttacaatttgtcagaatccaggtctctcatgtgtacagagatggaaaatgtgagtaactaaacaactcaggcaaacccttaactgtctctttctgtctttttattgagacttctgacaaaaataagcctgaaagaaagagtatacatgcttktgaaactgaatcaaagggtggagctaagaacagggaggtgctaaaattttttttttttttttaatttcttcagttgaaagtttctcaactcttcagccacaatctcttactrcaggagcaaattgccaattctgctccagtgggagaaaacaaggtattgtaaatatttctttggttaatgattttatttatgtttttcttcttggttgaagtgcccagctaggtaacaaataatgaagyccccttcccccaaaaaagtccagaaataatagataaggcccaatcccttaagaatttgtctgtataagtcagasagtaacctgagctggtttgaagtttgtactagaaaaagggatatgggagaaagaacattcattcccaaaaaaagttagagaaattgtttttctaggaattgkggagtggaatttgctccttgttttactgggaattgwgaaatcatcagtggagtttcctccagtcacatttatgtatctgtcamcataggcagagataaataaaatattctctcaggacggttgagccaaaacccttcaactctttaggaaatgtgagcttggcaccctgaatttggatcctattcattaatatatggaattcatggtttgactctttaactgttacccccacaaacccaaaaccccactctcctctcctggccaccatttcatgggccattagctttcttctcttctgtggaataataaatgttcctaatcccccacatcatactaggtgctcttcataaaccaccccaaactattacctgtttctaaaaaaggccttaggtgaatagagaggtgctggggattggggaagctgtcattctctgatatgcacaactccatgaggaggtaatattatcagtrtcatcagaaaggcaagaggcccttgggagtgtctcatggaaaacgggacaagaatcctccccactctccagatcttctttctcctcctgatggttctcyatcatgtaatctctctctttagccactaaaatcttaaacacaatgagatacaatggcaagagcaactgtattcacagtcaagataacacagttgcagttttgactctgctgtgcatcctttgctcaatcaacctctctcagcttcagtttcttagcagacaaaatgggggagctgggttagggagattctaagggtctttccaacactgatgtgctaggggcatgcgatgatgaaatgtctatgatgagacattttgatgaatgacactatccttttcttgctttcttaattctctttggcttctcctctgagcctgtctacaggttaagctcatagatgatcagtttatagctcttgaaaactgcaaaagagcaattaattttgaaaataacctggtagacttctgacctacacatttgcagtcttctctgaaaatataattgtccaacatttgtatggaataattatttcctgtaaaatttcacctcacaattctacacycttcagaaagtatttttcattgttgggttaaatatcactaatggatggcttagtacttcattagatttctttaaaaaaagaaaataaagaattgtttctcttgtatgttctgggtaacatctgatatacaaataatgatattaataagggaattaatgaagatgagtacaactaaatattaagcttacatgagaaattagcttttataatagagaattattgttttcaggaacatgttacaagtaaataaacactggaataaccatacactgaggtagaaaaaccccagcctctgaaatggtactttctccccatttcatgaagagtgtggtttggccaaaaaccaaacattttccgtgtaaatttaattcatgagttttaaaaatacaaagcttgatatatactgtatgcaggtaacaaaatgttatttgaatgagtaagagccttaaaggaaatacagagttattttgaagatggcatttgatctgttgaggaagaaagtcacaggcaaatattcaa

SEQ ID NO: 13334 - DNA, 31657 bp, Homo sapiens
ccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttaraatctgtgctgtgtaagggcattcgtactcatgctgttactgtacttatgcaccattcaracttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttttaattgaracagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttattttaattttagtagagacaaggcctcgctatgttgcacaggctggcctcaaactcctggccccaagggatccttctgccttggcttcccaacgtgttgggattgcaggagtgagctacagctcctggccctttttgagttttaattgaaaagcagsgttggttttttgtgacctgatttcaagtagagtatctttgtagtyagtgatgtttgttttaaaacgctggccagcactactgatttttactaacaacatatctggtaatattatatgagtaaggggtgttagaatgtaggtaggagaaaatgtttttaaggtggaagaatgtcaaaatttgctccattttctcagaggtaattaagtataaaagtatgatattgaatggccttcaaatgtgtagctttcatatatggttgaaatgaaattccatttctgttaaaagcaaagtattgttttagacataacttgtaatacaatcaaggaaccttgggagtggagttataatactcgaaaactgaggtacaacttatttgaaagtaattgctgcttttgcttgtttagctgatacaggtatatccggtcttcagcagtatgttaaatactgcactgtctcttgattaaccttttcttttttttctttttctcttttttttttttgccgagagtctcgctctgccacccaggctggagtgcagtggcaccatcgtggctcactgcaacctccacctcccggattcaagtaattctcctgcctcagactcctgagtagctgggattacaggygtgcgccaccatgcccggcttatttttgtatttttagaagagatgaggtttcactgtgttggccaggctggtctcraactcctgaccttgtgatccrcccacctcggcctcccaaagtgctgggattacaggtgtgagccaccgcgcccaaccttgattaaccttttctacagtctgctcaagtgagtaaaaaatcctatacgatttttaatttgcatgtgattaaacattttggtgtttgatatatcagatactgtgtttggcttttgttatgtacatccttcaacttgaccaatttaaacaaaaatgtaatttctctgtcctgttggtgtaatgtaatcaagagtttgtgataggaaattaatttttcaaccagtgatacaattttatgactgaatttaatatggacctgttaatgtgacattttcatgtttctgttgagtctgccttgatgaataactcagagcacttattctgtggtacacagagtcagtatttctcatttctggaattggatgctttattttctggtatgcctgtgataagagaggtgatagagtggcttytgcatctaattggtttgaatcctggtattacacttaactgatttgggcaaatgtatcctcgaggctcgatattttgttttgtttttctcccctgtaagagcactcactgctgtcttagcttgggctgctgtgaaaaaaaaaaaaaaccacagactgggtggctttacacgcgcattcctcactgtttttggaggctgggaagtctaaagatcacagtgccccctgattggtgccccagtttggttcctggtagtcctcatacagagagcgcaatagatgtcagtttccttggctcctcaggtgtattggatacaactgactactccagtttttgagacacttttgcaaaacaatgtaaagccattccttctgacaacttwctttctcagatgttccctctttcatgagtagttatgccctgtactcaaatcattgcctgctgctctacgtcactgtcttgggagttcacctatccctgtggttatagtgaacactttcataatcccaggtaatgtcattaactgatctggacccatcatggggtggctgtgctgagggagtgttgagctagcccctagtggtaaggagtacactgctgaccttcatcctatgrcaattccactttggtgattcactgttcccctcatggagaccaaggaggaatttgctgcatggtaggttggtgaatccagcctgtagcaaagacctggcttggactcctgcaactctttatgaaacttaaccaagaatgattgcatcttccagcgggggaagatgctgagaaggccccttcaggataaactggctccatagcactgctgtaatgatggctcctcatgagtaagcacttggagatttttgtggcttcctgcccactcaccctgctcaccagtccaggtagtttatgatttgagatctagatgtaattttattttatttctttttttttttttgagatggagtttcgctcttgttgcccaggctggagtacaatggtgcaatctcggcccaccacaacctccgcctcccaggttcaagcaattctcctgcctcagcctccctagtagctgggatttacaggcatgtggcaccacgcccagctaattttgtatttttagtagagacagagtttctgcatgttggtcaggcaggtcttgaactcccgacctcaggtgatctgcccgcctcggcctcccaaagtgctgggattacaggcatgagccaccgcggccggccaagacataattttaaaaattatcttccagctggccgggcgcggtggctcacgcctgtaatcccagcactttgggaggccgaggtgggcggatcacaaggtcaggagttcgagatcagcctgactaacatggtgaaaccccgtctttactaaaaatataaaaattagctgggcatgatggcacgggcctgtaatcccagctactcaggactctgaggcagaagaatcgcttgaacccgggaggtggaggttgtggtgagccgagatagcgccactgcactccagcctgggtgacagagcgagctccgtctcaaaaaaaaaaaaaaaattcctcttctttccttcattcattattcttagtctctgtctgtctcatatgagtagataatcatatgagtagctataatgaggactcctcaggggacagattctgtttggccactcagcagaagcatgcaattaccttctcaagattggctcctaaacttactctagatagagccttcaggcaggaaactctatatcccttggctccagaagaatatattcatactcattcaaatgtgctaggcactggccataaagaatattggtgttcattcataactgcctataatgtgctaggagctgtgcataaagcagtgtaacaggatcatcttggaaagcttatgtagtcagtagaggagacagataaactaggaattacatggtaarttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctrggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctsgtgcaaagtaggagccttggggaacatgttaaggggatgwgagagtaagcccacaaagactcagaagtggccagggagtaaggggaaaatgggatagaatagagcaaaagccacgggaggcattccttgaattccttggaytcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcrtatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgcygcgggccgggctcgcactcgagattctcgcccgtgggattccagtcctgagctgaacgagagataagtctttgtcaccccccagtctttactgtttcgagaaaccctaagattttttaaaaaaaagcccaaracgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcgsctcccgcgttccctgacctggtgctacagccccaccctctcctctcccgatgtgcgyactcsgtccctcgtgcttggattggctcccggggtagagccatcgcgtggcctgcctctcccrttggktggcgtagggaggtgttctcctscggggcccctgattggccggctccgggaggcgccatcggtaatgcctgcrgcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacwctctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggrgtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactytgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagmagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatgggrcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtasagagrgggggtttcaccatattgtccaggctggtctcaaactcctgacctcaagtaatgcgcccccccccccggcctcccaaagtgctgggattacaggtgtgagccactgctcacagcctgaggcaccgcactgggcctgtctttttaatatgtatatgatcctgcatatsttttcagtctcaagtaaccttacccgtttttagtttccagcctaatcccagaytgataacattgtgatgaatataatctctaagtttttatcagcgacttmtttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgayactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagacmatatactaatctgcttcttaggtgctttcgtccktatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcatawaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaaygcaggcagatcacctgaggtcgggagtttgagacccacatgaccaacatggagaaactccatctctactaaaaatacaaaattagccaggctggtggcrcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggktaacatagtgacacaacaacaacaacaacaacaaaagaatagcttccagccgggcgcggtggctcacgcctgtaatcctagcactttgggaggccgaggcgggcggatcatgaggtcaggmgattgagaccatcctggctaacacggtgaaaccccatctctactaaaactacaaaaaattagccaggtgttgcagcaggygcctgtagtcccagctactctggaggccaagggaggagacttgcttgaacctaagaggcggaggttgcagtaagctgagatattgcaccattgcactccagcctgggcaamaagaatgaaactccatctctaaataaataaataaatagtgtaaataaatactgtataaaatgcaaagcactcagaatagccaaaacaattttgaagtcagaaaatagcacttacatgctctgattttaacattacctwtaaagctgttgtaaacaagacaatgtggttttggcataaggacagagaaagagaacagagttcagaaatagacccagacttatgctygttttcaacaaaggcatcaatggaatgaaatggagaaattaaagtcttttcaacaaatggtgctggaataacagattactcacatgggaaagatgaacctagatccctacctcacaccctatataaaagctaatttgagataaatcrtggatttaaaaataaaagcaaaaaatgtaaagcttctagaagtatatataagagaatagcttttacagggtgcagtggcaggtgcctatagtcccagctacyagggaggctgtggtgggaggatcacttgaggccagcagtttgaggttgtatagtatactatggttgattttgcctgttagtakctgctgcactccagcctggtcaacatagtgagacatcatccaacaaaaaaaaaaaraaagaaagaaaaacagcttgataagtaaagacaagacatagaaagcaaagcaataacttttttktgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgaragtaatgagttataacttattcaataaaatgaaaatgtatgagtccatcctgatataaataactgaataaatgggagaaaaggaaaaggttttctttrtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcasaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaartttgaatgtggaccaaggattagataatagtgtttgattcatgttaaatttcctgatttttgttttgttttgtgagacagggtcacccaggctggagtgcagaggcacaatcatggctcactgcagccttgaactcytaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaraggtgagtatatcatagtggtttaaacatcaacctatttataggtaagagtaacatctaaaagagtaatacataggaatctttagaaattatatcttagttatgtttttcaggttgcaartatatgtcctggatacatgaatgtggggagggggtatgctgggtttacrggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcmtgccagcagtgcacgattggctytgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattatycttaaaacagttkaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcycctccccaactgctgtaatccttttttttyctttttgagacggagcctcactctgtcgcccaggctggagtgcagtggtgcratcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtygttcttatgaagaagtcagaagctgataaacgtggrcttacacctttagcacggatagtttcctggtcccaagtgggtgtggagccttccattatgggaataggaccaattccagccataaagcaagctgtgagtataaccytattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccamgccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacrtaasagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaastagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtytytgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgytaggtcaatattgaaggaggggctatagccttgggccaccctcttggagcatctggctgtcgaattcttgtgaccctgttacacacactggagagaatgggcagaartcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcamggtacaagacaattgcatytaacattgttataaataaaaggaacatcagatcaatcawwaagggctccagagtgaacagcatcttcataacttccatgtttatcatctttactttctggatgtaatttaataagatcatcaattcgaagaatggkgattgcagcttctgttgcaaatttcaaactcttaactttaactatggttggttcaaacacccctgcttgtttgttgtctcgaggtttaccattgctcaaatcaagaccaatcctgcaattaagaaagaattatttaacggccgcttacaatttcattaggtggcctattaactccagcatttcattcaagtattaaggttgatttttaaatcagactagagatcttgtaggtagtctttctaccaaaagaagcagggagagattagcaatcacagttaacgaagacacaccagtgctaataattagtcattatcccttgaattacagtgactgaacaacaaatgcttgctgtgaagtttttcatgttaagtatttgacaagtctgttacttatgtttgctgacatgtaattgactactatcctttttaatgcaacctgttctgcagaggttaacaaagagcgggaaaccatgcttaccattttagatttttacgttctgggttaacctgggcctcattatgaaaagctcttaattttgcaaccagatctgtggagtcctgggcagcattaactgctagtgtattgggaataacaagaagtgatcttgcaaactctgcaatcgcaagctgttcccgagacccctaggaaaagaagaaaattaggtgacttcacaaaagggaaaaaaaaaattgaagtccacagctactgctctcaggcctctaagacaagaaatgactgttcttaccatgctggttgcatagttttcaaggtatatggaaagggctgcttctacagcacccccaccgggaaccacagattttgactccaaaactctcttcactacacaaagtgcatcatgtaaagagcgctccatctcatcacacatgaaatcatttgccccacgtaagataatcgatgcagacgtacgagccttagtactgttcaaaacaaaagtacaattcttgtaatagcatttttaaaaatttttttttgccaagaccatcaatttctcaaaaaaaatggcattttaataaaataagtctacataaagttcccttaagtcctgcctacacaggatatttagatatactatacagaaacaatgtctagtccmtgcagaagagatgaaaatggttacttcatctcaatttacagtggcccaatgttattttatcccatgcstataactgctcgtatcactgtgagactacaagcagcaaataaatgggaagaaaacctacttttacttaacaaaatcggtataactttacaattttagaaagtggctcttactttttgattaagatcagctcatcatcacaaattctctcctgtaccacttcttctgcctgtcccaacattgcagcttcaaaagtttcttcaccttccaaattggccagggttgacagaatagttgctaataagagagttacaaaggatctgtgaatattgctctttcatgattttaatatccttggactcagtagcatttgtgrtaaaagtgctatattacaagtttagaatttagttaggcagcacacggtaactccttttatcctaagatggaactgtcattttagaaatgaacaaattcagttcacaaatttccaacaaaatttctccagttacatgaaaaatggctctataaatgtgttggtagcacaaagcattaagagaatataaatgtttttgagctgttttctgtcaatattcyaatgtaaaaagacctttgataggatcagggataataaaagtattttatgtgacagccagcacaagacatacctccagaagctttggcaatgcgtttaaggtccctttttaaaactcttctaactgccatagcaccagcctccacaaaatacttcagacacatatcatcaattccaccagtggttagaataacattggcaccagttgccaggatcttctgaattctctccttggtgatatctgattctctgcaaagtatttttgtaacctgarttaccttctgtgatttttaaaaataatttaacttccattaagtatttatcacaagataatcayagatcaaattgtattatcctttgttatctctgaccagaatttaaattagtcsaattcatggaaaatttgaaggaattaaaaattaccacttagctctccccaacccaaatttgaattactaattgagaactatggttaaacagggaacacaggtcctgccttcaaggatctagtggggagagggattaccaatcacactccagggcaagtgtcaytaaagtggtatgcagagattacaagcacataaaagacataaatttagcctaggaggtggacaatgaagatgagtccaggccaagtgcagtggctcacgcctgtaatcccagcactttgggaggctgaggcgggcagatcacctgaggtcaggagttcgagaccaacctggccaacacggtgaaaccgcctctactaaaaatasaaaaaattagytgggcctggtggtgggcgcctgtaatcccagatactcaggagactgaggcaggagtatcacttaaacccggaaggcggaggtcgcagtgagccgagaccgtgccactgcactccagcctgggcaacaagagcaaaactccgtctcaaaaacaaacaaacaaacaaaaacaggagtccagagttgaaagcacaaaagaaggyagaaccagaaaagtgaaaaaccttgcaggttacaccaaacaatctagatactaagcttaatatctctaagcaagactagtatatcatctgtgttttcaaaaggattccctgattatcaatgtggaaactgcactgaatggctgaagacaagaagataataacatgagatataagctgaaagacaacctaaacagaaaagtcaaattttatggcttgggtgactcctggagtaaaataaataacaagagttttgggggcaggatgggaaatgagagtttagttgaggacaagattaagtttgaagtctctgctgttactcaggtgaagctcccaggaggcagtcacttacatcatggaaaccataaactatgggagatccagatttgaagagtcaatatgagtgaagccatgtgaatagatcattcgaagaatttttaaagtaaaatgaattacagatcaacctcaaaagcagcttgtctactaaacaagtactgtgtgctacacactgttatataaactcatggtaaaaactgtaataagccccaggaagaaaaaatacaggaagttacaacagaatataatttagattgaagaagaaagaaaagcttctctaagagactagcttgggtgtgtttctacaacagtctaggcaagaaaatgaaaagtaggtaaatttaatttggaggtagaaatcaagcggtcttggtgacagattaggagaaaaagtgttggtaaaaaggaggagttaaggacatttcctagttttctgcctgtgtgaaggactccccatcactaaaatggtcaaaagcagatttgcggtattatcacaagttcagttttagacatgttcactttgagatgcttgaaaagcattctactagatagaggtatgtgtgtttggagcttagagaaacagctgaaagagtctctggcatagagagataatacatgaagtcatgggaacaaagrggctatcctggagagtattatgacatggtccagacaaagcagcatcacaaagccttccatccccgaaagcatttcaagaaggacataatcaaagggttgctaaaggtcaagtaagaggaaggctgaaaatgtcttccgaatttcacgctagagaccttaacatgcagtccctcaaatggagaacagggctgaaaagggatgagaagaaaagcaccagagaagttttgtgtagtaaaccactcatgacatctgcctgtaaagatgtacgatagggagtacctatagcacaaggatgtaygaagaagcttgaaggacaaaagagccacaggaagaatccaggaaagagcataattagttgaagatgcaagtatgaaacaagaatcaaagaaaaggctctagagcagaaggaaacagactctagaacacttactgtagagggactggctttgatggaagaaaggacactttgttgtatgaggaaggaaggaaaaaagaayacccgtgcagactgatttaaaagatgacarcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattagctcttctggcatgccaaccactaatatcacctgcacctccagtatctagcaaacagtaggttacagtcaatactatactgctgagttctgtactgctttgaggaaattagattcctgtcttttacatctttaatattaatagactcatacaatcaaaattccacaaaaaggccgattttcatataggttgtataaccccaaatccctctaaaaacaccaccaggctaatttttctggaagtaaaatagtttgacttggctaaaaatgttaaagtcctccaagacactcacacttaaaaggccaaaaataatctctcaacatacctctgtctaatttggtccagtttttcagggtctgtaatgaccacctgtacaccaagcttcatttttgttttttgcaggctgaagtcaaggcaagcaatttttgcatttacgattctcttgggcatgcctacaattgaacataagattaagttaatacgtctatccttaaaagcataataaagagtacctataatcgattgtatgtaaacacacaaatttagactaattcattgcattttatcttagaaaaattttatggcattaaatgcaygtaatttcttttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctcagcctcccaagtagctgggactacaggcaggtgccaccatgcccagctaatttttgtattttttagtagagatgaggtttcaccatattggacaggctgctctcaaactcctgccctcgtgatccacctgactcagcctcccaaagtgctgggattacaggcatgagccaccgcgcccagccaaaagaaaagctagttttaatctgtagcaatctcattctataaaccaaatcccaaaccttaccctgggatcccaccacacagttgagtgcatagccactgatgagcatactctccatttgacttctcccatgggctttcaaaatattaacagagttgactggatagcgtggctggcctcttatgtctgtgtatttaatagcaagtacagcatctactaccatgttagcaaagaaatcaccatttctacgccaaaagttaaggacagtaacaggtttggaatggacaaagggtacacacgtgaaaaatcaagggtaatttcaagggacttccttttagtaatctaatctattaaagmagcaagcattacttgtcaccaaaatgttacaacattatcactatctgcaattcatatcacttttagacatgctttttattaccttttcaccctaaaaaagcagggaaggcaacargtaatttcmatacagcattactcctcyctattgatatcaatttgcataaaattggttattcaaaattttattgcacaaaattgatactgctgctactacgcacgcgtgcgcgcaacacatgcgcacacacgcacccactcccgagacagggtcttgctatgttgcccacattggactrgcactcctgggttcaattaatactcctacctcagcctccttagtagctgggactacaggcacataccaccatgcccatctcaaagtcttatgctttaaaaagtctaaattttatctgacaaccacaaggatacattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcayagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttacttgcaagcaagtcgatagccactaataactgatgtgggatgaattttctgtttgactaattcatctgcattttttaggagttctgctgcaataataacctgttgagaaaacattcacyggtctgagtgtgccggatattcaacatgtgcaatacatatggaatgacactaaaatggccatatattattaaccaaaatggtagtgatgaaatgaattaactggttattagaaacctgggcgtgaagggagaagaacgctacaaaacactccaagtcctccacgttactcataaattcttggaaactgccactttaagcaaaacaatggacagcaatttctcaaatacagttgtttattgtaacgctgatggggggaggaaaacttgtttttttatacatcatctttcctcttaaagtcagtttccatgaagccactgtggatgttcagtgaggtcttattgtattataaatgcaaatggccaaaactgggtaggagccagaaaaatgttctaagaaactagttcagcaataagaaactagttcatcaatacaaccgtaaaagacaacacatctattacctttagaaaaaatgctcaacagaagctaaaccgagtgtgactattcatatgacctatattargctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccrgcatgctggatgatctatgaagagtttatactgtgtatcacatttactgactcggtaagatcacactgtcatatcatgatgtatttattaatttctcacactcccattttgaattcctgagattacctgtcaggatttaaaaaatagaacaggctgagtgcagctcatgcgtgtaatcccagcactacagaggccgagaagggaggatcacttgaggccaggagttcaagaccagcctgggcaacatagcgagaccctgtctcttaaaaaaaaaaaaaagagg

SEQ ID NO: 13335 - DNA, 22471 bp, Homo sapiens
  misc_feature (1)...(22471): n = A,T,C or G, or insertion/deletion polymorphism (see Tables 1-2)
caccaatcggcactctgtatctagctcaaggtttgtaaacacaccaatcagcaccctgtgtgtagctcagggtttgtgaatgcaccaatccacactctgtatctagctactctggtggagacttggagaacttttatgtctagctaagggattgtaaatacaccaataggcactctgtatctagctcaaggtttgtaaacacgccaatcagcaccctgtgtctagctcaaggtttgtgaatgcaccaatcgacactctgtrtacagctactctggtggggacttgcagaacctttggtccacactctgtatctaactaatctagtgggcaggtggagaacctttgtgtctagctcagggattgtaagcgcaccaatcagcaccctgtcaaaacagaccactcagctctctgtaaaatggaccaatcagcaggatgcgggcggggccagataagagaataaaagcaggctgccccagccagcagtggcaacccactcaggtccccttctgtgcggtggaaggtttgttctttctctctttgcagtaaatcttgctgctgctcactctttgggtccacactgcctttatgagctgtaacacttaccgcgaaggtctgcagcttcactcctgaagccagcgagaacacgaacccaccgggagcaacgaacaactccagatgcgccgccttaagagctagctgtaacactcaccgcraaagtccgcagcttcgctcctgagccggcsagaccatgaacccaccagaaggaagaaactcccaacacatccgaacatcagaaggaacaaactctggacacgcctttaagaactgtaacactcaccscgagggtccgcggcttcattcttgaagtcagtgagaccaagaacccaccaattccagacatacctccccactgaagttyttcatgctacaaccagagtaatatttaaaaatttggctgagcccagtggctcacgcctgtaatcccgacactttgggaggccgaggtgggtggatcacttgaggttaggatttcgagaccagcctggccaacatggtgaaactctgcctctactaaaatacaaaaattagctgggcatggtggtgggcacctgtaatcccagctactcgggaggctgaaacaggagaactgcttgaacccaggaggcggaggttgcagtgagccgagattgtgccactgcactcccgcctgggtgacagagtgagactccgtctaaaaacaaaaataaaataaaataaaaaataataaaaattcccaacccttagctggtctgatggtattgggttctcagaacttactaacattagtatcactacactttgtattaatatataacaccccattgctaaatttgattgtctttaaaaaatcccaattctgattctatctttcctctacttaaaactctagcggtaccattattgttaagataaaatacaaaaccctggacatgccccatgagttctgcatcatttggactcctttcctctattgtctagtaatttggacaccaggtcaggcttaataatttactgttccctcaccagacacacatacccttgataagccaatatctttaaatgttagtcaaacacttatttaggggaggtagaaataattttcttttcyttttttttttgagagagtcttgctctgtcgcctaagctggggtgcagtggtgcagtctcagctcactgcaacctctgcctcccaagttmaagtgattcttctgcctcagcctcccgagtagctgagattacaggcatgcaccaccatgtccagctaaattttttttttgtatttttagtagagacggggtttcaccatgtatgtcatgccggtctggaacacctgacckcaaatgatccgcctgcctcggcctcccaaagtgctggaattacaggcttgagccaccgcacccagccagaattttttttttctcttgtcttctcttttttccgttttttgggacagagtctcactttgttgccaaggctagagtgcagtaacctgatcacagctcactgcagcctccacctatgacgctcaagcaattctcccatctcagtgctgctgggactgtaggtgcacaccacgcccagctcatttttaaaattatttgtagagacggggtttcgccgtgttgcccagggtggtcttgaactcctgggctcaatcagccagcctcggcctcccaaccaaagtgctgggattacaggtgtgagccactgcacctcaccagagttttcttttagaaacaaattaatttaccaattcatttcttttagcctaagtggagtcaaggttctaaatagtttggcaaaagatttctcacttcctgtgattcttattttctcttcagtaatgagtgtatgtgtgagagacattttcttatgacagagaaacatattgagaacataattgttttttaaattaaaaaatatccggcctgggcgacagagtgagaccctgtctcaaattaataaataaacaaataaaaataaaaataaagcacttgttcctgaaaattatatgccactatatgcactattctttgaaattctgaagaactctgattgactagaactgcatatcatgtaagccaaatattgccctcagtagactccagaggagttatttcccctggcagctatagttctttctggcaggagagggactagtttacatttcaatcaaagttaactggcatacagcagggcgcagtggctcacgcctgtaatctcagcactttcagaggctgaggtgggtggatcatttgaggtcaggagtttgagaccagcctggtcaacacggtaaaaccccgcctctactaaaaatacaaaaattagcccggcgtggtggcgggtgtctgtaatctcagctacgcagtagtctgaggcagaagaatcatctgaacccgggaggcggaggctgcagtgagctgagatcacgcactccagcatgggcgacagagggagactccatctcaaaacaaaacccacaaagttaactgccttattttctgttgtactttttgtgcttagtagattcatgttctagacaattctcaggtcatttgttctttaacctggctctgctccagcctctttcctgcctttctccttgttctctattacctgacaatcatagtctttagacttacacaaaataccaggtccccacctgtctgcaggccattgtattaggttggtgcaaaagtaattgctgtttttgtcaaacagcaaaaacgcaattgcttttgtaccaacctactacatgctgtacactcagccaggaaagctcatcctcctcttcccttcatcttcccagtatgtacctgggacatagctacatcctttggtcctcatcttaaaggtcccttcctcaaatgatctcatagtttctataattttctttctggcagttcttggaatgtgcatgcacatacacacatttgtgtagatatttaatatttatgtaccgcaaactgcatgctccatgaagttaatacctaccttaaaaatttgatatagggccgggggcagtggctcacgcctgtaatcccagcactttgggaggccgaggatggtggatcccctgaggtcagaagttcaagaccagcctaacatggagaaaccccatctctactaaaaatacaaaattagctaggtatggtggcgcatgcctgtagtcccagctactcgggaggctgaggcaggagaatcgcttgaacctgggaggcagaggttgtgctgagccgaaaatgcaccattgcactccatccaaaaaaawttttttttatatagttgtacatatttatggggtacatgtggtggtatttttatacaggtatacaatatgtaatgaccaaatcagggtaagtgggatatccatcaactcaaatatttatctattctttgtattgggaacattacaattcttttcttttaaaatatacaatgtttctgttaactatattttcctaccgtattactgactacagaacttactctttttatgtatctgtatttttgtacccattaacaaacttctcttcatctttcctcccatcttcccttcccagcctctggtaaccacctctacttccatgagatccactagtctcagctacttggaaggctgaggtgggggatcactagagcccaggagatggagattgcagtgagctgagatcgtgccactgcactcaagcctgggtgacagagtaagaccctgtctcaaaaaaaaaaaaaaaaaaaaaaagagagatgggatcttgccatgttgcccagtctggtctggaacttctgggctcatgtgatccccctgcctcagcctcccaaagtgctgggattacaggagtagatatcttagatatacttatttcctttcttttgtacatatccagcagtgggaatactggatcatatggcagttctatttttagtttttgagaaactctgtgctgctttcctttatttttttatagagacaagagtcttgctacgttgcccaggctgatctcgaactcctgggctcaagccatctgcctgcctcagcctcccaaggtgctgggactacaggtgtgagcctccatgccctgccaatactgttttccataatggctgtactaatctacattctcaccaacaggctattagcattcccttttcttcttatctttgtcaccattttgtatttttttttcttttgataacagtcattctaactggggctaagatgatctcttattgtggtttggatttgcatttccctgatgattagtgatagtgagcattttttcatataccatttctatgttggccatttgtatgtcatcttttgagatatgtctattcagcaggtcctttgcccatgtttttcttttttctttttctttttttgagatggttgcctaggctggagtgcagtgataagattttggctaactcactgcaacctccacctcccaggctcaagtaatccttccatcctcagccttctgagtagctgggattacatgcacaggccaccatgactggctaattttttgtatttttggtagacatggggtttcaccatgttgccccggctggtgcccatttaattatattttttccttgagtttattatatattctagttattaatcccttgtcggatggatagtttgcgaatagtttctcccattatgtaggttgtttcttcactgtttcctttgctgtgcagaagctttttaacttgatgtaatctcatataagacctatcatttcttaaatcactgtctccaaagcaccaagcctggcaatcgttgataaagtgatttcaaacatttaatgtataaacataacagtaactgtaaacggtgagatacaaaaccacttacctgattatcccaatatggggagaaaataaatatgcatagaggaaaagagaaatacactaattaagaagggaaagagtccttttttttttttttaacaaaactaaatggaaacataataaactaatgtaagcggtaacctgtggaggagtaggaagacttttctaaagtctgtttactttaaaatccggttttcatttctgaaacattataatgtattatctattcaaaaacatcaaatgtttagagggcagacaatacactaaaacattaatagtgattatcccggaagggtaggagtcaggctttgttttctgcttctgtatcagaaaaaggatgcactttttggaaaagatgtttggcgacctggaaggacaccgtctccgtggagtcgggaaggaggagggccaggatgcgaaggcaacgctttgcaggtgatcggatggatttattcccacatgggagagaccagagcacagcacgtttgtgtacggccaggagggaaccacgaaaaaagcagargatagaaacgcaagcacacgatggtggtggccaagaggagcctgcccctagtgacctcacttccgcggccagtgcgagaggcgagggagctccagctctgmctgtaaggtctcggaagtamgaggcggaggggacgaaaaacggggggccagactgttgtggctgtggtggagacgagaaaccaggaagaagaggctcgcytcccactcggcgacmgtaagcgaagcagccgaagscgagcgccgacatcagcagctgccccctaaaycccgcccttcgtcttggckgcagcgggagactgagagacgcgcgcagcaggggcgggactggagaggggccccgcgcgcggatctcgcgagagcattagagggcggaagcgctatccgagcaggatgcggttcgtggttgcmttggtcctcctgaacgtcgcagcggcgggtaagaccctccatcccgcatcccactcttgcccccagatcccccattctcacctgggcaggtcacctctaggctcgcttcttccctacccgacccacctctccgctcgccatcgtctcccgccccaccccccaatccccattcccccgctgctcccgatctcttccagttctgaggagttccttcttcccgcctgcccttctccggtgctaactcgtttttctatttcaggagccgtgccgctcttggccaccgaaagcgtcaagcaagaagaagctggagtacggccttctgcaggaaacgtctccacccaccccagcttgagccaacggcctggaggstctaccaagtcgcatccsgagccgcagactccaaaagacagccctagcaagtcgagtgcggaggcgcagaccccagaagacacccccaacaagtcgggtgsggaggcaaagacccwaaaagacagctccaacaagtcgggtgcggaggcamagacccmmaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttccyggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggrgcccaaagaggctgaagatgatgatacaggacccgaggagggctcaccgcccaaagaagagaaagaaaagatgtccggttctgcctccagtgagaaccgtgaaggracactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaaggtaagtcgayagcggccttccggaggggagtggggtttccagcaccctggaagcttgggtgtgggtgggtatcccgtcactagatgcccgtgagcactggggactttaaaacaaacttcagttttttcctcaggccctattaggcctctttactcttgttttgttaatcgtgttttcatcctgtcacctgtttactctgagtgtcctctgctactgcattaggagccaagttaggacattattaggatctgacctgacttggaatctcctcccataactttgcacttaggtccttcacagcctcagaggacctgagtacttgacagttaaagcacgtaccttccatcctatttcccttcttgagacgatatgtcatttctagcttcctttcccaacattctctcttccatcagcagtggcacaaagaatggtttcaattactgcgtcttcgataccaggaccaaagagcccagggacttctgcaattaataataattagaagaaagcccagaaattgcacagacacgtacacctgttactttttcatcagggtttggtctgtttattagcaaccactctaatgacaaaatgattgcatttcatattgagcccccaacatttagaagctagtttctgtaacctgcttaaaattggagagtccaattctggccataaggcctatggctataaagaataaaggggaagacctttagtaaaaatgtgcattcctggcccggtgcagtggctcctgcctctaatcccagcactttgggaggccgaggcaggaggatcgcttgagcccaggagtccragaccagcctggccaacatagcaagacctcgtctctacatataataaaaaaattagccagatgtggtggtggacgtgtgtggtcccagctactcaggaggctgaagtgggrggatggcttgactgtgggaggtcgaggcttcagtgagccatgatcacgccattgcactccagcccgggtgacagagtgagaccttgcctctaagaaaaaaaaaaagtgtatttcttattctatgtccaagtgtccattatgcagggtaaccttagtcatgaaatgagattgataaagaatgtagttgatgtagcatcgtggggtgaaaaagtacatttgtagataggaaattctgattatgactttttttaaaggaatgtcctatatcctagatatctctaggaaggagwtgatagatctttgactgtgtacctttgaataaatcaaacagacttcctcccacacgctagagctcagacagccttctatttgttatttcctattaagcaatacaaaggattctgatgtaattaggctctgtctttcttaaaatggttatagtttaaayagacctctgtgagtgtactgctctttctacagtcagggtcattaacaaatatgctaccaggtgactgcctctgakttcagagactgaactatgtcattacagagccacctgttaatcattttctttttcctttcctcagatcattgcttttgtcctggaaggaaaaagatctaaagtcacccggcggccaaaggccagtgactaccaacgtttggaccagaaggtaaggaaggaggagccaggtccatgggagggataggagggataggcaacgtcagatggacccagtagtgggcttgcatttgccatgaagcagcagtggctgattctggggatgcggttgctgttgctgttgcattcgccctttttagacaacaaactagaaacatctagatacacatatctgtgacgttagagctagcagagaccttggaatactctacagcagctacctcccttcacagatgaggaaataggcccaygcagaaacactcttttttttttttttccgctaagtttctactgcaagttagtggcaaactcaggacctgatagcaactccctmgtctcccagtcctgagctttctgcattctgccagcgctccataaactttaataggcatttgaatcaccttggggaattttgataaaaagcattatctgattcattagatgtggggtggagcctatatttctacattcttttttttttttttggagatggagttttgctcttgttgcccaggctggagtacaatggtgcaatctcggctcactacaacctctgctgcctgggttcaagcgattcttctgcctcagcctcccgagtagctaggattacaggcgccaccaccacgtccagctaattttgtatttttagtagagatgggtttctccatgttggtcaggctggtctcgaactcccaacctcaggtgatccgcccgcctcgacctcccaaagtgctgagattacaggcataagccaccgtgcctggcctgtgtctacattcttaggaagttcccaggtgaaaccaaatgccactggatccacactttgtgtggtaaagtgctagactrtgctccctggaaacacgagcctggaagcacataggcctccaactccccacatcagcctggcttaagcaccgtaggctggagttcctgagtacagccaatccattcctctgtcagacagataagccctccttccaccccatggcagcagagctaagcaagggtctctctaaagacaacctgtctaagcaggaagactgtactctcactgcgttgctaccagcatgcacccttccttctgctttcagcatagcaacagccaggacattggcaaagaaccattggtggcccaactatgaattgttcccagacttcctgcagggaacacgattctcttgcacaactcaatattagctacagaacgagccactgagctcagaatatctttgctaactagtccagtaggctagctttacaatttagctctggactactgccttttcagataattgactttaagggttttcccccttttatgatttttgtttgtttgtttttgagacggagtcttgctgtgtcgtccaggctggagtgcagtggcacaatcttggctcactgcaacctccaccacccgggttcaagcagttctccctcttcagcctcccgagtaggtgggattacaggcgcccaccaccacgcccagctaatttttagatttttagtagagatggggtttcacccttttggccaggctggtcttgaactgctgacctcaaatgatccacccacctcagcctcccagagtgctgggattacaggcgtgagccccacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggcatggtaatcccagctactactgaggaagccgaggtgggagaatcgcttgaacttcggaggcagaggttgcagtgagccaagatcatgccactgcactccagcctgggcaacagagcaagactccgtctcaaaaaagaagaaaaccaccaccaacaaaaaacacatgtaaataattcacaacagtacagaacagtatgaagcagaagccaggattcctctctctccatcaagtgtatatctttctagtgttaggtttcatttcaaactttaaaaatcattttgtgtgctattttaattaattgctgtttctgtggtggtgggtcagtatgtcttaattctgaatgttttccctgcacctcctaaaagatcttttytccccyaagtcctaacagaatggtatattcctctggaaaaagatgaacgtcaycaatggattgtgctgctctcgtttcagctttgatttttttgtccttgagaaccttgtcctccctgctgatttgtttytaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggagrggtatatggaaacacggctrtgaccaaagggagatcccagcctgggcagsctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccwaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatctyttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgactttactaactcacttcggtctctgtctgtcaactaaacttttctaaaggttaccagttatccaatcaccaaatccatggctttttctcaaagcttagtcttgtccttgrcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcamtcttggaaagactgatctttccaaaatattttccctggtctgaagctttggtstgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgakcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttaraaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatrcaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtgratgagggtgagctggctgaggcatcgctcaagctggggggtggtgtgtaagaagcacgtggagccacaagaggcacctcctatagtcagctaagggcttccctttctgcgcccagcttttgggtgaagggtgatttctaytagacacatctgtgcttcagtcatagatgttaatagaggaagcagttttcctgctgcagattcctgaatagagttgctgaaagagtctacttctggactyaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttmtgcaagtcagatgtacacttagagtctctctgtgaagggtttgggtctgagctgtrtagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttytgagcttctgtaaatgccatcccaatgtggtttggttttgttgaacagaaaccaaaataaatttcaaaatgttaaagcaatggatttaatacatttatttatttatttattttattttatttttgagacagagtcttgctctgtcaccaggctggagtgcagtggtatgatcttggctcactgcaacctccgcctcccaggttcaagcgattctcctgcctcagcctcccgagtagctgggactacaggtgcgtgccaccacgcccagctaatttttgcatttttagtggagacggggtttcaccatgttggccaggatggtctcaatctcttcttcgtgatccgcccactttggcctcccaaagtgctgggattacaggtgtaagccaccacgctcggccaataaatttattaatattatattaagatgaactccaataagacctttggcatgtcagtttaacataagtgaaaggtcctttttatgccttttgagccttccttcaccttccatccaacacacacatgtaccagtaaattgcagatgccatttctgggctttgcacactttctctggctttccatgttctgctcctgaccaactctcttgccacctgactcctcccagcctggctgcctgtgttgctttcagtagctgggccattgctgggaacactctgttgcctccctgtgctgtcctctgctgtgccattgtgtggaatgccctgcagcctgcctcaacacaatgaagtaatcttaccagtcgatgccctgactcctgacgtcacccttccctgccctgtgtcacctttccctgcatatttggaggataaggcttgattgaggctcgggtaccgagctccctgaaggtgccttgatgctggcacatcgagaaccagatgccaccccgatgataaggaagacagacccgggacttccatatgaattgggtatgatcgtctgacatgcaccctactaactgatggatcctgctgttaccccaaagctccagaaccacactggccagacacaggcatttcctgtcccctgaagagccactgaacccagcacaaaagagatctagagctctccaaacctatggaatggcaaccaaaaccatgcccaggttttgagttaagcctcattagtctcccttttcccttgacagtgtagaactgtgcagcgtagcactaagtgaatgagagcagaagcctcaggacagaactgaacccaccagcttgagctgacaacactgccaggggttctgtccacagatggaatattcgctttgatcactgagttaggaggcatgggtgagggatgcagacgccgctcgtcatgagacatcaagctatccaagtcaatatcctattagtagggatggcatattatagaaggtgggaaagatctcacctgccccagctggaaaacagtgattccattgccccagattcgggaattgtgatttaaactaggcctctcttcaggcatcagacccaaattagactgcttcatacgtgaaagcaactaatgcagaaagacattatgggtaagtcaagggagatgccccagccattgggcaaattcctctgactcctccctgatggaactaattctttttcttctgtgcccggatcctagaatcaagattcttaaggtctgagtacaagttccgcttcaggatggcgctgctgcacagcagggcaccttgcagggccccgaccagtccacaggtgaagatatcctggcctaggaggcaagagcagaggcccctgagcgtgcacccaggcaggcccaggggagggtggggccttggtgctcttccctccacatgagggccacccagagctggctccaatcagacaggggccacagcctgcccaggcagccctgctcaggggatgggaggctgcaggggacagcagggcctgagggcaggaacagaggacgttgggcgacaggggcccagggtctcaggtcctgacaacatggggcagtgagtatacctgtcagaggttggtgatggggctctgggccttcaaggccatcacacragggtgcaggcggcccaggtcatggtcagcccygtagcagrcacctcggggagcagccagatagaactggttggtgagtggggatcctgcagtcacactctccacctgagggcagaaagggtggggcaggcatgtgagatcctggctcccctccctcttccrctctttcccattcactgactccggggttgggtgccctgtccttccctggggctcatgtcttggggcccaattcccctgtctcaaggaaagggcagaaatagcaccatgaggtccgtcaccaccccaaatactttaccccctaccttcccctccagctgtgggaacagtttcaggaccactgacatagaggcttccacaaagaagtttttgaaggtctcatagtcactgccctactttcccttcagttccacctgccactcctcaaaccactcgtaggtgctgggtatgagcatgatcatggtggaccggcctggggatcagagctgatattactactgcccggcctctccctccaccccctcacccaggacgtgcagccccccgtgggaatcggtcctcccaggtcggatccttggctgatgggaaagcgaagaagagaagagggatgtgttccgcagcctcttccctgggcatggagatgtagcgctccatcctgcgtgtgacaagagtgtggtgcgatctccaggcttttgtcctcaaaaccccagaaccactgcaaggactgctcgtccctagggactccccacaggggtgaagctgagccacagccttggtgtgacaaacttccaggtgcaaattggaaattgcctacttcctcccattccataacttctgctcgttctctgagtcaagcagggaggcacgggccacacacacacgtgcaccttacgcctggtccatgtccgtgtcatagtaaacatagtagttggtggacggcagatgcaggtcctccttggtgcctcgcaggcagatgaaaacagaggtcatgcctaagccgggctgaactgtccccagctgctgcttcacacctgcaaaggggagtggttggtgcctttgtggaccatggccggagacagccactccctgctcccaggagagcctcagggtgaccgctcgctgtgtcctgagccttatcttcagttgccagctttgtgcccaggccacttttacagctgtttcaacttgatgttggcaggggcctgctcttctgtgtcctcctgcctgggaaggacactgccccaggttcctattcttycacctcccctgcctctgctccaagccccttcagaggcaggtaaagcccagccctggtcctcagcccccatgagctggctcagcacctgcaggaaggtcaagcttactgcctcccatcttccccttcgtgtcttgaagtgtggagcacatgactgggttccccccatgaagacyacacatgaacagcagctcattaccagcctgatttcaggatgaacttttatgcagtcacggagtgagtgaacatgcatgattcttagtgtgacatcagaacacaaggcctccagagggatgccaatgcatgtgagcaaaggcaggcagcctgactggtacttggcatctcaggactcagctggagggaggagggaagaactacactatggcagaggccacagccactgtggggcacctgatgttccccagacctaaacagctgggcttccccactcctcagcagatgacctgagacyggtgttccggaaactgcccccacagattcttctgctgtcttcccattcccgtgccagagggatgccgggtccctggctcctctgctttttccattttttaaaaaatttatttatttttagatggagtcttgctccgtcgcccaggctggcatgcagttgcgcgatctctgttcactgcaaccgcctcccgtgctcaagcgattctcctgcctcagcctcccaagtagctgggattacaggcatgtaccaccacacccactaatgtttgtattttcggtagagatggggtttcaccacgttggccaggctattttcaaactcctgacctcaagtgatctgcctgcctcgtcctcccaaagtgctgggattgaaggcgtgagtcaccgtgcccggcctgcttcgttcatgtaactaartatttgtgaggccctcaggttgtgttcaggaggaagagacacaggaacacagatggagggcaagagggacagatggctctagctgggctgcctgggtgagatgctggggcctggccaggacagtgtcagttcccagaggtcctgggacaggggagaagggaggtcagggtcacagagagagaggcaggaagtagcaaaggcagagtctgyctgtgcaccaagcccgacccccctgctctgcccctgggccgtctctacctcaccccctcagctcccccggtctgagagaggggaggccgagcmggctgcagacccarccacatggggcaggggaaggagaggctggcattggtggagccacccactgcactgccagtcatacaaagaagtctatcacacagaattatgtgcagtattttttttttttgagacagttttgatcttgtctctcaggctgggttgcaatggcacaatctcggctcactgcaacctccacctcctggcttcaagcgattctctggcctcagcctcccgagtagctgggactacaggcggccgccaccatgcccgggtaagttttgtatttttagtagagaggtttcaccatgttggccaggctggtctcgaactcctgacctcaggtgatctgcccgtctcggcctcccaatgtgttgggattacaggcgtgaaccaccgcgcctggcctatagtactttttaatgaacgaaatgactatgttactggtttatgtatttgctatatttttatwgttttaaacaaaaaagtttaagaagtaaaaaaaaaaatgtttttgtttttgttttctttgagagggagtctcgcattgctgcccaggctggagtacagtggcatgatctcagctcactgcaacctccgcctcccgggttcaagarattctcctgcctcaacctccctagtagctgggattacaggcgcccgccaccgtgtccggctaatttttatatttttagtagagttggggttttgaggtcatggtctcaaactcttgatctcaagtgatctgcccaccttggcctcccaaaatgctgagattagcaggcataagctactgcacccagccccaaaaaagactttaattagaaaaaagctcatagaataaggatataaagaaaatatctttgtgcagctgtacagtgtatttgcgttttaagctaagtgttattacaagagtcaaaaagtgtttaagttgataaagtaaaaaagttaaactaaggttaatttattcttgaagaaagaagaatatttctttataaacctagtgttgcctaagtgtacagcrtcatggttactcaccactcactgacgcacccagagcagctgccagtcctgcaagctccatgcctgggaaatgccctatacagctatgccatcttttatcttgttttttgttttttttttcccaagacagaattttgatcttgttgcccaggctggagtgcaacggtgcgatctcggctcaccgcawcctctgcctcctgggttcaagcaattctcctgcctcagccacctgagtagctgggattacaggcgcccaccaccacgcccagttactttttgtatttttagtagagacggggtttcatcatgttggccaggctggtcgctaactcctgacctcaggtgatccaccctgctcggcctcccaaagtgctgggattacaggcttgagccactgcacccggcccatcttttatcttttacaccagattttactgcaccttttctatgttttgtttctgtttttttttgagaaagagtctcactctgtcgcccagggtggagtgcagtggtgcgctttcggcttactgcaaactctgcctcccgggttcaagtgattcttgtgcctcagcctcctaagtagctgggatkacaggcatgtgccacacacctggctaatttttgtatttttagtagagatggggtttcaacatgttggccaggttggtctcgaactcctgacctcaagtgatccacctgcctgacctcaagtgatccacctgcctcggcctcccaaagtgctgggattacaggcgtgagccaccatgcccagccaccttttctatgtttagatacataaacactcaccactgtgtcacagtcaccta

SEQ ID NO: 13336 - DNA, 23555 bp, Homo sapiens
ctatccacctgttctggtccccaaactttgtgcttatagatacagtctcccttatacctgtccattcatgaaaaatgacatctgggcatgggtgtggttcaggggtagagaataaaacaggtctgcccatagcagaggcggactctgccttccgctaaacacaaacaagcatgcagggaagcaagtacccttcttaaatatctgacaacatggctttgatgaaatctatcccgacttagccataacctagaaaactgtatagcctttctagaaaaatgtttttgaaatgctcagcatcactaatcatcagagaaatgcaaattaaaccacaatgagatgtcacctcgtaccagtcagaatagctattactaaaaagtaaaaaaataacagatgctggcaaggctgcagagaaaagggaatgcttttacactgttggtggaaatataaattaatttagcccctgtggaaagcactttggagatttcttaaataactaaaaatagaaccatcatttgacccagcaatcccactgctggatgcatacacaaaggaaaataaagtattctaccataaagagacctgcacttgtacatttattgccgcactattcacaatagcaaaggtgtggaaacaaccttggtgcccaasaacagcagattagataaagacagtgtgctacgtatacaccttggaatattacacagccataacaaaggatgaaatcatgtcctttacagcaagatggatacagctggaggccattatgctaagcaaattaatgcggaaacagaaaaccaaatatcacatgttctcacttctaagtgggagctaatccccgggtagacacagacataaagacaggaataatagatactggggactccaaaaggaaggagggagtggggcaaaggctgaaaatcttctttttgggtactatgttcactctatcagtgatgggatcaatagaagctcaaacgtcagcawcacgcattacaccctcacaacaaacctgcacgtgtatcccccgaatctataattaaaattcaagaaagaaaagtgttttatgtacaactgtgaaactataatatatcartttaaagaagaaaaatgtttcatggcatgggaaaatgattataatattctgttatgtaaaaaagcgagagattttttttcccgaaaaccaaagcacgatgacaacaaaaccgcaagatctttgtttattcctcctggcgctagagatgcggcagtgaataagaacggttccagtccctgattttagagagcttacccttgrgttaggagacatgttaatggaggatgcacatgaataaatgttaaattacaggcggaggaagtgttctgcagaagaggcatgcggtgctcccagcatgcggaascagagcttccgcctggcccaggaggcgcggagagtggctaaggggctgggggcgagggaaggccccagcggggagtcctgtggaagaggaagagctggccaggaggcaaggacagaggagacatgtgccatggaaggagagggcacatgcttcctttatgtgtgttgaaaaggccaccaccactcttacagcaactctctctgagcagtgaggctaacactgtacctcatcttctccctgcacttccacatcatgccactttcccacagagctgggatgatttgcactaaggaaaaagcatttttttaaaaaaaccaaccttaccacacagacagacagcagggctgtttatttatttatgctcctctttgtctcaaagaggattttcaaggtgcttacaattatgttaacagcatggcaggataaaggaagaaaaatcaggccaagggaaaatatggtgaaaagagtcagaggaaaaaggagtgagtatcaccctacacagcakggaacaactttaccatgttttttgtcgtgtcttgttgtgtgaccatttaattgtaatatyggcatttacttttgctgttgttatactttgtcatctcaactctactaaaaaacctcccaccgttatttcctctgccttttattactgtctctcatttaaaacacatctttcactttctgttctgtatttttgtagttgaggaaatctggcatcgcttttctgcagtgaagggaccgtgtctgagtcrcctcggcacagtggtgtatccagagcctctgcatagcaagtgctgggatgtctgtgaacgcacagcttcgctaggactgagagtgactaacacccatccctgcagcactcagagaggcacacacaggggctcaagactcagttgccaatttgatttatgggacttattatcccaagtgtcagcagagaggagatattgattcagaaagacttaaataaacaagcaggtgcataatccagagaggggtacagactgagctgagggtgtctggaaagcagtggaagcagacatcatgaagaaacctggggtctcttgaaaactgctcccaagggagtcatggggtgacagaggggcagggacgggctgtggagtcagcgggcacaggtgcactccaggctccatcacatcacacgctaggggcgtgaccttgggaaaatcactttgccttgtgcttttacagaaagaacaaggccttttgtgggggattgtggagaggaatgtccatgtgtatgtgtatgtrtatgtattgcatatctatgtggtcattccctggtacatagtaggtgcttcataaacaaaaataccctcccatatcactgcccttctattccatttgtgccatagtgtgtgacctaagagtagataaagcactttttttgtttgtttgttttggtttagatggagtctcactctgtcgcccaggctggagtacagtggctcaatctcagctcactgcgacctccgcctcctggattcaagtgattttcatgcctcggcttcccagaatagctgggattataggcacctgccatcgtgcccagctaatttttgtatttttagtagaaacggggtttcgccatgttggccaggctggtctcgaactactggcctcaaatgaaccgcctgccttggtctcgaaaagtgctaggattacaggcatgagccaccatgccctacctagataaagcatttctaaactctcctgtaacactccatatagcaatctcaggtgttttaattctcactggtttaatcctaccactatcaccagcaactgtaacagtccccctttgaaatcacttgcaagtgtgttccagttactatgactgcataacaaattaccccaaaacgcaggggcatgaaacattagtttttttcttctcgtggattttgtggctctggaattcagagagagcacagagcaggtgggctgtctctgctccacattctctgaggcctcagctgggaggctggcaggctgggggctggaactgtctgcaggcttgttctctcccatgcccggtgagakwtgctagctgttggctgagatctgagctgaggctgtcagctggagcacggggcctcggcttcctacaacatggtggctggttcccaggtacatgtcccgagagcgtgtggggggaactcgagcccccgtctatgacttagccttgaacatcgtgctgtgtccttctaccatattctactattgagrcmcttacgaagctccacccagggtgaaggggaagagacatcaatgcccctcttgatggtggagtgttgatgccacactgtgaaaagggcacatggaatgggaagtatttggtgtgaccatctttggaaaggacaatctccatactatgtgtcaggtagcttaggtgatctctcattcctcaaaaacactgaggggctaggtataattatctctattttagagacagacaaactgaagcttagagaggcaaagtaacttgcttgggcaatttatttcacctctctgaggctcagttactccctctatcaaatgggtagaaaaatctccacctcagtggtctattgtgagcctattgtgctagtaccttaagaagctgttggaagagtcagagaagatattttgtgatctctgacaccccgtactaatgcaaaccgtcaayatttattgttgcagcattgttattttcttgccctccacctgtagccatctgtcacacacaaccccgcagccagcaaaggacctgggttttcacccacaaaccctcgaggacagggcttgtcaatgccttttggttgtggctcatttagggggagcagaagaccccacggccccccttccctgtttgttcccaccttcccttgggaagaatgctaaagtttgtttatgatttccaaataatatgtrgcccttaataacttattcagagtatcacgagcaaggagcccttcggttatactcataaatggcagcctgttgcactgtgtatctctcccccagggaagcaggaggggggcctggcatttctggattagccccaggaggacttttcctgcttctgagtggacagaggatcatccttggaaaattgctcttctgagattgaattccagrtcctacatccctctgtcaatctgcctgcaaggtctgaagctggtcttagaccctctggtgctatggtgcccattaaacagacactgtagtctcctgttaataagattcaattaggaaaggggtggagaagggcactcaccgcctgagagtgtgtcagggaggcctgagtggctgccttcatttcgcgcctgctggaggcaggagggaggaaggtggtgagctcgctcagcagggaaggccaggctgcacccacctccctgggggctggggaaactcagggtgacctccagagcctcaggtggcagcttactgtatgatcgaggtgatttttaatgtctcagagcagccccagggtcakcagagacagaccaagctgtgccatctggaagggccagcttcraatctagttctggcccctagggttgcaccagtgacttcaagcctccaagtctcagtttcaggttctttgattcttgggtcaagtgaagggtggagataagctgccttctaccaccacgcctgatacttaggaaagccccaatatctgggattgtttttgttgttttgttgaaaatatatatatatatatatattwkttttttttttttgagacggggtctcgctctgttcaggctagagtgcagtggcacaatcttgactcactgcaacctccgcctcccaggttcaagcgattctcctgcctcagcctcccaagtagctgrgaccacaggcatgcaccactatgcccgrctaatttttgtatttttagtagagatggggtttcrccatgttgcccaggatggtctcaaactcctgggcttgagcaatccatctaccttggcatsccaaagtgctgggattatgggcgtgggccactgtgcctgccctttgttgctgatttttaatccttacttccactttacagatgaagaagcagagatctaaaagcatgttttttgcctgcaaatgctgacattcacttgtcttattgctaggaagaaatctctgtactttcgcggtctctgggagggcccctggtgagcagactgtccctggacctggttggaagcagtyktggagctctcactactcccagcttcagctcagttggtccttaaaaagtcagttctctcccctygccataaatccccaccgtctctaactcccatcactaccctaaagcaaagtaggttttaaaaatgccagtaacacaagtgagaaaactgaggtcatttaacgataagtttgggagtaaaaccaaaaacaaaaaaggaaactgaggcccagagaggtgccataacttgctcagggtcacacagcacgtaagtgccaaaggcagggagctgtagctgctccagcgtggatatgccagggactagtgamaagcccaacccctccagcccaactccacccttcctcatgccaacaaaaggagaatcatttcctatttctggcatctttgccagcccacagagacagagagaagaagaaatatttccaaatataccaggctgatctttcgtagtttctcagtcttgctgtctgttgtygtttgaaatctgtttcccacgagactctgggaagatggaggtgcagggcttgggtaacagctgccttcctcagggctgggtacctgctctccgagtctgtgtctccaggctgtgtgctcagacttgaccatgtttgggcatggaggcttgccccagatggggaccaaaagctgcttccctggagacgggcrgggaggccaaacttcctgctgaagctctgtggcctcttttggggtgggggcgggggtccaggcagaaagaaacygtctgctgctmaagacccacaggacgccsggaagactgtgagtaccgggcctgaaagcacttgggaagtgatttctctgaagaccgggctggagggagacwggggaaagcagcctgccacggggcagggagggaggcaggcaggaggactcccttcctctcggggctgtccttctggatggagggcccgtggtctggtggccagtggggagggtggcacagtggccaggttactctggtagtaagcgccctggccctctaggtcccagttctcagagtggccagaaggctgcagcctggagattarcaccaatgctggcacttgtcaccggtagagaggtgggacaaaaatagattcatcaagaggggtccagacttctgctccaaactttcagggtttccttcgttagtagtaatagctaatatttactgrgggctgatttggggctaggtgctatgatacatgtctgatactcaatatggcatttgatctttagctgaactctctgaggcaggtaccatggttctcgtttcacagtcatgtggttgctaagtgtaagtggcagagccaggatttgattccatgtctgaggacctcagaatygccctgtccacaccccaccaaactgttcaacaatgtactctattccttgtccttctaaggaaaaggatgtcgacccagctatcaggtcacccaggacactccaaagtcctgccttcctttgtccttctccatcttctctgaatctatcccagatctcaagtgacctttctaaatgggaagatatatcctggaacttcagagatatttagaaayrctcaaaactgggaagttcttcttacagtctaactgaaatccctcctatgatagctgaaacccacttcttccttttctttctgtcccttgggggatattgacagttcccatccttcctcccgccaaaggttctccctttggatgctgaatactaacttcttgctgaagtcatatctacactgaaccccacgcatggtcttaggaggatttatcatgactctataaactcactcagtgcaggcaacaatctcatcagaccattagagacgggtcagacctgaataagccaagtttccagacttctctgtgacagggaagcctctcctttcctttccttctgagctcctaaaactggtaaaaccaggttcctgccttcaccagcctcaggagtrcccaggggcctgagagggcactagaagccaaatascagaggaggccatggccctgggcgckggggggggctgattagccaggaaggagccacaggaagcccccacaggtgcgatccagttcccccaggagakaaatggctttgttgtgggcactcagccctaggcttccaagatgggatttcccattggcttcaaatgatttatgtctcacagtatctggggtggggccaagtgccagtgacccttgcaggtcctggggaagcaggctgttggggcttttagcttacctccaggtgattctgttgctttacctgtgaatacatggagagtcttgttcaactgacgccaggtagaaaaaggcatgggctctcccattcccacaagatcacagaacaggaggaaaaggattgaataaaaagagttgaataaaacatctctctttgtcgggggcaatttctgcttgcttgtgcttttataatgtctccattagaatgcaggagaaactcacctcctggtgccaaataaaggagaaaaagttgtcattggatgtcacctctgccgatcgataggggaggtggaccagctcactgggaaggtgtgatgggtatcygtggtgcctgaccctggtctcttccctttagcggagatgcccgggtatgrgggcagcctggctaaggggagggagtcaagaatctctgaatatttgaaacagtctagtagttaagagaygcctgagcagaaaatagagcactttgcagaaaatctctttggactaaggcctgtcacccggacactggctaattaaacaaacaaaaaccataatatgtttattactttagggacctggcaaggagaataaagtccccctgatatctggctaaaatttcccctaaattcccctaaaatttcccctaaaatggaggattacattgatagcttcctggtatttttggtagaaatggactctggttactttaaacaaataaaaacaacagcaaataaatttaccagaggctctaggacagcttgcggaaccatgggaaatcacgcggggaccatggctgggcatctctgtggctccaggcggcatagattgaggggctgtttcttgaagtctttgtcaagactcacactcctgggggagcgatcaggagcctagcaggggagggtggaatctttgcttgcattggggtggagtcaatgtccaggggaaaaacaaggagttgctgcctaaagaaagaggagagraggaaagcaaccaccagcagaatgtgcccattctgctttgtcccaggtggcttcaagccctgaaataagaaagcagtcgctgaggccaccatgatgccttctttsttctttctttgcttgaagtaggggaatgttccttacaaaaaaaaaaaacaccggaatatggtaaacctcctgcctctcctgacaacctgcagctgccttctggggccctcctctcctttccctgcctgtgcccggcccagctarccctgccacagaactgtttctgggcagaaatactccaagtatccctgtgagataagtgccgtggaaggaggtgcatggatgatgcacatgtactgctcgctcaccgcatgggacctatgactgttgtagcaaatgatcataaacctgacggcctcaaacgacagaaatttcaccagaagtccaaaatcaccaaggtgtctgcaggctgcactccctgcagtggccgtgggggatgagccattgttccttgcccccgccagcttctgacgcactccttggcctgtggtcacatcactctmattgctgtctccctggtcatatcaccttagctttctcatctgtttaatctcccttcacttccctcttattaggacccttgggattacatttaggakctacatggataatccaatattgtctccccatttcaagagcctttatctttttttgttttttgtttttttttttgacrgagtcttgctttgttgcccaggctggagtgcagtggcgcatctctgctcactgcaagctccgcctcctgggttcatgccattctcctgcctcagmctcccctgtagctgggactactggctcccacgaccacacccggctaattttttgtattttttttttttagtagagatggggtttcaccatgttagccaggatggtcttgatctcctgacctcatgatccgcccacctcggtctccgaaagtgctgggatttcaggcatgagccaccgcacctggccttcaagagcctttatcttaatcatttctgcaaagtcattgccacataaagtaacattgatagcttccagagactagaacatagacatcttggggggccattactgagcctattacatactgtgtgacctagggcaagtcactttacctctctgagccgtaggtcttttatctgcaattgcctctcaattgcacagggaaggcttacatggggtccaaaaagcaagacttctggaagttgcaaagctccaaatataaacaagagtgatattaatagttgagtaccttcccctctcacctgtcctctctttctgtggatcacctgtgaactgggctgatctcacttctgtttgcttctgtggacctagaaatgatcactgcccccagtgaatatggtgaagaagctggtgatggcccagaagcggggagaracacgagccctttgcctgggtgtaaccatggtggtgtgtgccgtcatcacctactacatcctggtcacgactgtgctgcccctctaccagaaaaggtactgagctctccyggcctgcccaccccccaaccctctcctaagggtctggcatctgtaaggaaccctggccttctactcacccctctccttgaccctcattcaaggcagcagggtcaagacratgctcattcttaggttctagggttcaagtgcagggaaggtaggatgaactgagccccactggtctgagattctaggacctggtggtaacagacacatgatctaggacgtggtggtaacagacacatgatgcccttctcagaagaaatagcaaagaatcagagcaaaggttccagtgcaagtttgatcccaggaggaatcagagaattgcagatgtttacagctcagctgcataattctctcccytctgaagcctccctgtcaggtgggcatccagcctcctgatgaatacctcaagagacggggagctccttgcctcactgaacatacatttcatgtttgaggttttctgatgtgtctgcattgagccagcatctgcttccctgaagttctgctcaggaatctcagagaatggtccatgcccttgctccatgacatatcaaccacttgagattttaaggaaaagctgtgaattcctaattcgtgttctatttggaacaaagacactcagttcccccagcctgtcyttaggataagtctcagacctgtgctctgggcacgttccagcagctgacagcccccttctgactggcaatgggtctcccacaggatacttgggagttgaagcacaactgatttactaatatgttgatgarcctgttagcctctcccgggcctgctgcagcctcactcttcacaacgctgaagcgattccaggctggactcttaatctggtgaagcaccatctagagactgtccccaccatctttcccatcctggctcaamtcaaaccccttctacatctgctccttttaggggaaagaacacagctctccaacccactcagacctagcttcaggtcctgcaaggtctcagcaaagtcacttgacctttctgagtttctcttctgcctctgcaaaatgaagacgatatggataagaaagtctcaggtttggctgctcgtcagaatcacatcagggagctttgaaaaaacacccagggcctgggccraaccacccaagaagttctgattcacttgctctggggtgtagcttggacacgggaatctttttagaagctccccaggttgttgcaagagtagccaaggttgagaaccagtcatatagataatgtctaagaccccatccagcttctacaattcctccctgtgtccggggacygtggggtcatgtgcctttattgctggatgctgaagacaagatgaggabsccagtcctggatccctctagaggmtcccmggggataatgggttcaaatgggtgttctgtgtgtcacccagttctgagatgtgtatgtgtgcatgtgtgtggtctcctcagcgtgtggacccaggaatccaagtgccacctgattgagaccaacatcagggaccaggagragctgaagggcaagaaggtgccccagtacccatgcctgtgggtcaacgtgtcagctgccggcaggtgggctgtgctgtaccacacggaggacactcgggaccagaaccagcaggtactgaactggagggatggggacacatccctttatccctgtcaggtgtgtgagcctgttcctaactgtccctgtccccgaggctgagaaagatcaacccacttgaccaggtctcacagctggaatgagactgagccagccctagctcttctgtgttggagtcacacagacctgggtttgaatctgccgctaactggctgtgtaaacataggcaggccacttagcctctcacytcctcagtttccacccttgtaaagtggaatgctaatgctgcaccttgaagagctgttatcaagtcagagacgctgtatataaagtgccacgcttgatgctgrgtggatagtgggcactcaaacaaaagcagtgattagtgttagtactttcattctacaacctcagtcaaatgagggaccaggcccagggccagatcctcaaagtggaatcccggtgactccccaggaaaccagggactcagggctggagtaacctccataaacaaacatttagatggtttttccatccttgcatcccaacatcccaccctccccctccaaaacacaaaactcaccaccatatcctttcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactcaagaggagagagctcatgcatgaacagtgcctagcagggaagaattggcaccggggagaagaacagaggaagttacaggggttagaggagggggatgttttccagctgacaatgatgggggtatcagaaaggctcttggtgagattgcaccattgcactccagcctggcaacaagagtgaaactccatctcaaaaaaaaaaaaaaaaaaaagaaaggctcttggattaggcttttaacatcaggcaggcgcaggatgcaaggcatagagaatgaggtgatataggaagcgggtatgcctataggacgaggcatggcggagggaagggctaggtggagacagggatcagagggctgactacagaaaatgacccatgatggggtgtatgcagctggaaaaggctgtcagggcagactaaggtctgttcccagaggcctttgatcaccacaatatggaattaaaatgtgagygtgtatgtstcaagatatgtcaactttggctatgcattagaaccctgtaagagtcttaaaaaacaaaactagggtccaacactagacatatcaaggtggaatctctggtcagagatccattcatggagctcccaaggtgattctaaggttggaaattattgctgttggcaatgggaatctttagggcatgatcagagtttcagagttgggctgggaagatggagcctacaggtgtgtgggtccagttactagacagaggagccaaggmcgcagcaagcactcasgacyaagatgyggcctgcagcaggggagatgctgacagtccggacttgayggctgatgggacrggaaggggcagggtgcctgggatggggcgtggaggctgggggatcttgagagtgctgaaggtcaakgagaagtgggtctgggcartgcaggatggtcaggtgttctgtcatcgctagtatgactcggccccamccggtggagagaggtctcagggcccastggrggcagctcctacccatgacccctgcctctgcgttggcattcagtagcccttgatttatcccaatgcaagaaacaaattttcaataactggtaacattctccgggagtgatatgggccagagcaggctggttttcaggctgcctccctggtcctgagattgccagctcagaggagcatcccctgaatgaactgtcagcaggatgtgaaggaaggacatgctggagccactgctgtcctctcccctgcygcccaggcttgaccaggtgtggtgctgatagcaggctgcaggagctgggaggaagcagtggaaatgcccttcgtgtttttgccaagcagctgggttgtgggctagctgctccttccgcctatgtccatcataggggttcaagtrgctggggctccaggctagctgggtgtcctctggaatcactgtgaagggccaagaagactctcatcccaccctccaactctgaaggtaggggccatagtctgccctcagcttttcctgtgagtcttagcctggagcaggtgagttctaaattccctcccattgtctgtcctggggaccttacactgcagggcttgggaaaaagctggttggtttcagatcattcagataactcaggcttagctggacccaggacaggagagaaaggatgcattcaggccccggcttctgggkttggccatgaagagtgaattcctgcccagtgtcttgccaaacaggcccagcataaaagatccagaggaaccctgagcaggcagaggatacactaggcccaggatggacagaagcctctacttcagagctcatccatagacctctttttaagaaggtaaagaaggagctgttgttgcaatttcatagataagtcaaaacatattattattaataatagcatcttccacttttttgagttcttatcgtgtgctgggcttctgtgctcagtgctttacatgcatcatctcatttaatccccatgacagttctcctaggcaggtagcctcacaaacccattttacaaggcccagtgaggttgtggcrrttgccaaggtcacacagctcagaactcaggcctgtctgactccatagccacactgctatttaaggagctaggttagccaaggtcacagtcagaggcattggagagactcaggccaggccccctcaccgtcagctcaggatgctggattatatgctactgaggacctggcagtgtccaacagctctgaatgccagattcctgaggagccagcgtctccccagcctcagctactccctggctggctggggccctagatctgagtgcagcatctgcatttcccaggctgtgagaactacagtgcaaccctcctctgtgttgctggagtgaatgccctcagggcaggcagcttccagggtggcrcctcatataaatccagggagtggccgaggcctgcarggaatctggctcaacacctgccatttgggtctcagttttacacattttgatcttgcacatgatttcactagggcaaaattaagtgcatgaaggaatcacacattcctgggtctcgccctcagtgatgcagagtgggtagggacctgggctatgggggccctgtaggtattctgctgcagatgggggcaccacacttgcagctcagaacagagataaaaccagataaaactccgctttatgactgctttgcatcactttccagctggcctcatctgaacagggcagaaagttcctaataacaataatcaacgtcagaattaaatgtgtgtcatgctctgctggcayaaaactcttttcaatgcattctttctttcctttggatcccagtgtcaaatacccrcttgccaacatagtttgtttgctgtacacaggttgaaactgcaaaggttttcaattttaaatttagctaatattttactttttttttttttttgaaatgggatctcgctttgttgccttacctggagtgtagttgcgagatcatagctcactgcagcctccaactcctgggctcaggtgatcctcccacctcagtctcctgtgtagctgggactacaggtacaccaccatgcccacctggataatttttaactttttttgtagagataaagtcttgctatgttgcctaggctagtctcgaactcctgggctcaagggatccttccccttcggcttcccaaagtgttaggattacaggtgtgatctggtttctaacttctcttaaagtgttggaggtctggctattatagatcttctggmtggcctgacatccattgcctggagggagtggtgactgcctgtctggaggcagctggctctctccctattgacaggccctgccacaccctggcaattcttcctggcaccaaggcaagagtcagtgggcacctgtcatctcattgctttgcctgcttcaccctctgacaataccttcatgagccctgtaggcaattgagcacatgatctcgatttcaaatacacagcccacttggcctgtgtccctcmctggtttccttagatagctctgtgtgaagtccttctttcataatatcytttgaaacygatattcacccatttaagtgatgaagcttcagggctcagaaagagtgagaaatttgccaaaaattctacagccaatccaagcagagccaggactccaaggtaggacctgcrcccaggtgtgtagcctgtaccccgagcagctccagcaccgccatccacacacaagacacaaatgagagcrtgctctccagacctgtacagcgcatggcctgccaagctttagaccaaagccccgactccaatccaggggcccgactacaaagctggtatttttctttactccatatcaagcccttggctaagaaatggggatttccaagcccacrgctgctcttgtttctccccacagtgctcctacatcccaggcagcstggacaattaccagacggcccgggccgacgtggagaaggtcagagccaaattccaagagcagcaggtcttctactgcttctccgcacctcgggggaacgaaaccagcgtcctattccagcgcctctacgggccccaggccctcctcttctccctcttctggcccaccttcctgctgaccggtggcctcctcattatcgccatggtgaagagcaaccagtacctgtccatcctggcggcccagaagtagagccatccatccatgccataccacttgtcagggcacaggggactggctgggcccccagggctgctccccacttgcagmmcaatgccttctccacctgccctcccactcttccagtccaatccacgctgtcttctgttgcaggactaacctttgagaaatccttttgtgaagtcattgcctgctcaagaatgtacagtggctccccaatgccttggaggccataaggccagccagttctagctctctattacctgtccccactcaactgactcatacctktttycggctgcatcactrtgtgccccacagagaacgatgatcgtcacctctgtgcctgagttctccctgttgtctcaaagcggtacccatcctcccccagaagctgtccccagcgagcctcccttctttgtttgaattctctaataagagcaacagcagctcccatttctagaacacatttacagtattactattttctaggatataaagtgccatatatatttttaattccaatattaataaatgtatgccaaacaacaatcagctgcaaggaaacacatgagaactcatcaaaattttagcggygggatggtggttaatttctgttttcttccttatcccctttttatttttgctgcttttctaaatttttgattataggaagggtgtgtttcgtttgcttttaatcagaaaagccatggtagatgccattttggaaaagttgaaagagtgtgtccccctcacagaaaaagatggaagtgggtctggggacggagttgggttccagtcagagacaggccattcagaacacacaatcttaaaaacccctctgggccgggcgcggtggctcactcctgtaatcccagcactttgggaggccgaggctggtggatcacgaggtcaggagatcaagaccatcctggctaacatggtgaaaccccgtctctactaaaaatacaaaaaattagccaggcgtggtggtgggcacctgtggtcccagctactcaggaggctgaggcaggagaatggcgtgaacccggggttcggagcttkcagtgagccgagattgtgccactgcactccagcctggtgatagaacaagactccgtctcaaaaaaaaaacaaaaaacaaaaaatgaaaaacaaccctctggaggaaaggtcatgatatagaggaggatttgttatttaaattgagggtatggactctggcactgagcctgctggggaagcctatctcagatttgaaaagggcaaaatgggaagaagccatcacctttaccattcccactccaggaagttttcctagaacgatgactgtccaagtgtggtccctgggscagcagcatcaggatcctgtggcagcttgtgagaaatgcacactctcaggcccctgtcccagccccaccacgccagaagccctgcacggggtgggggtagcaatgttctgtgttctaacaatgcgtaggggattctgtggcacacctcgagccagagaactaccggtgtaggaagtgagcgtcctgtcgcgaggattttcagagcaggtgagtgaccattcggcagggccagtcctgagctgggtgtgaagttaggctggtgtctgaagtttcttccagtgttgtgagtccaagatgcagatcttgggtttgaatcctgtctctactctgcccgatttcatctctttgattcttagttttttcatctataaaagaaggactctttctggatagttgggagggctgaaggaatgtttgacacatcataggtgtttaaaatggcaactatagttttktttgtttgttttgtgtgtgtgtttttttcttaactttcattttaagttgcagggtacacgttcaggtttgttacataggtacacttgtgtcaagggagtttgttgtgcagattatttcatcacccaggtattaagtctagtacccattattaaagaaaatgtggtacgtatacgtcatggaatattatgcagccataaaaaggaaggagatcatgtcctttgcagggacatggatggagctggaggccaaatattatccttagcaaactaacacagggacacaaaactaaatactgtatattctcacttataagtgggagctaaatgatgaaaacacatggacacaaagaggggaacaacacacactgaggcctattggagggcgggaggtaggaggagggagaggatcagggaaaaagagctattgttagtaacaagaaaaagtcggccgggcgtggtggctcacacctgtaatcccagcactttgggaggccgaggtgggcagatcacgaggtcaggagatcgagaccatcctggctaacacggkgaaaccctgtctctactaaaaaatagaaaaaatcatagccgggcgtggtggtagccgcctgtagtcccagctgctcaggaggctgaggcagaagaatggcgtgaacccgggaggcggagcttgcagtgagccgagatcgcgccacggcactccagcctgggtaacagagcaagactctgtctcaaaaaaaaaaaaaaaaaaaaaaaaaaaagawtaagtcatgaatactcagaaacttccagaagttatactgacaatgttatctggcatgtatgggtgcttatttattctgtgccaggcactgtactaattagtttgccttggaaaaaaaaatgagatactcctgaacctgcctcacagatgatgagaagcaacagaggacagtggctaagtatgtggacttgggatgtgcactgtttgggttcaaattccagctgtgctgttcacaagctgggtgactttggacgaataacctttctgtgcctgtttcctcrtttgcaaaaygaaactgataatagtatctttccatagagttttggcatgaaacaaatttttatgtaaatttcctaggatagtgacatatggtaagtgctatctaagttactatgaaaaactgaggctgtaagaggtaactggccaaggccatctgtaaagtgaggggctaggactcaagcctggagctgtgtgttccagtacctggcatctcaaccacagaactcagcagagccagctgtgaagggctgagggrcagagccagctgtgaagggctgaggggcagagccagctgtgaagggctgaggggcagagccagctgtgaagggctgagggacacagccactcaaagccacaggggccaggcagggagctgcgttgcatccctggaacccaggtgccctcatgcaggttggagttctgaggggaggccctggcatctgcaccagcatctgccaattccagccagggagcccagaggtatccctgtggcctccagtttcttacctggtggaccttccttccaaaggcaggcagctcatcattccctggaattttttccttctggggtcagggaagtctcaaaggtcctcatgtgagtcttttaagaaagtcttaattgtaatattgtactatagttttgcaaaatattaaatattaccattggggacattaggtagagggggcacggaatgtctctgtattatttcgtaaagcttcatgtgaatctacaattatctcaaaaatttaagttaaaaaaggaagaaaaataagaaaggaagtcccaacttggagtctgatttaaagggtctattttgtcaatggtttccatgcacctgaatttgggactaaaatacacagaaactcagaatacccaaacaatccctgcaggggaaaaggccatgttcctctagaaaaattagtatgtgaggatgcctaacccccactgtcccataaattattaatgatgaccttcatttgcttgagayagatgttctcctcctgtcaataaagactggccttctagcaaatgccacaactgtctgctgctcacagaactttatgcacgggataagcatgaaataatgggaatttaggcatgatggagttagaccctgtgcctacgtgtttttttgcaataatatctgcctgggagcagagaaccttcatcagttcttaataaaccactctgctaatgagtgtctagtgcttccatcatttattattgtcctctcatggactagtgactcatacctggagaggtgcacctggatggttctcccatgtgccgtcctccagaactcagacaaagcggtggaattcagaggcaaggggccacctgagctccagaactggggtggaaagaaccctgggggacatcctaacagtgccaggtctcagacagagctkcagctcatcagtccaagctgcaaccagaggaggaaagaaatgagggtttcttctatttatgaagatctcagaggactggaatttcacttcacttttatgatgtatctatttgcttgcctgcaaggaacttggtgtcttcttgccattctccctccctacccctcactaatcattgtgaggggcttccttcttcacagtgaagactcagcattatgcasatttaaaataatgcaatataaatattaatataatcttattttctgtgacttactgaagtgataccagctcctcctctaaatcaacaactcatccaaaatttatcttaaactccttgggtcagggcattgcaaactgcatttattttattgttcattggcagcacaggctgttatgtgagaatatccagtattctttgaattggtcttgtgtttgggggagtttgaattctatgaaatatttaagaagacactgtttgarcaaagtgccaccttcctgtacctcaccagccattgccctgtcacatggaagggaaagaaaatgaccaaagaaagatcagagagacatggagaaattcactacagtccagtgtagcagttctcaaagtggaggcttgcaaagtcaaaactctgttcataataatactaagacattatttgcctttttcattttcattctcttatgagagtgcaatggaatgttccagaggtcatgtaacatgcattgttaaaacagtctgaatgccgaggtagcaatgagattctaggtgcctttctaaagctggacattagagatttgtgaaaaatgtaaaacaataccacttctcccaatatactttttgccacgcataattgtttttcaaaaaaatatgttatttttgttagcaactaatggatgtattattattttaaaataagtaaattcaaattaaatatttttaccattcttagttctaatctctaaaatggtaactgttaatagatataacccatatacaccaaagctcttaggatccttratattttttaagcatgtaaaagggtcctgatgatgaaaagcttcagaactgccagcctagtgcatccagagacaaggcctccaggcccctcccacaccgtgccctgtagaaatgtgaggctctccaccaggctccatcagattcccactgggggccaggaggagggctttagttttctccatcacctctggctcccagatcctgtcccccagatgagtcagttgatgggtcatcctcctctccacagtgctttcctggttctttctcatgtcacctctgatgcagaactcagcttcttcctagctttgcacaactctccctccccacttacataagtacattttcaccagccaacttcctcaaaggatttgggagatgagaaagggaggtatatggaagcaaagccaacaactctaaactgagtactggaccacgtttgtgattccttcccaggccagctgcatctcccccagttgcagagtcaaaagtggcttagatggactctgttctcccataatctccatcattccataccaacctcccctatccccagtacacataaaacaaaagcaggggcttgagaggcacatgaagctttgggatgtgtcttctgtccccacgccccatgagattgctgcactgagtcctcctcctgtgtcaattctggagccccttttactcaactcccctttgattccrcatgttcaaatacaaacacttgttctccragtgccagtaagactttagagatcatctagtgcttctccactttayatttggtgcttgaactctctgttgtctcacagaaagatatttggtctttggtacagaggtcctttaggggcgataggagtgtcttttttccagtgagataactcttggtgggcctgtaaatagcttcggcatgggagctgcttgccagaaggaccaagccatgattagagrgttagaaccttcagctctacccggcaacctctgcagagggaagaggggctggaggttgagtttaatcaccaatggccagtggtttaacaatcatgcctatgtagtgaaatcttcataaaaccccctaaataatarggtttggggggcttctgggttggtgaacacgtcaaggtgctgggagagggcccggaaactctgcacctccaccctgcatccctcataccttgccctgtgtgtctcttccgtctgcctgtttctgagttatatcctctgtaatcaacatgtaatagtaagtgtcaatagtaagtaaaatgttcttttgagttctgtggatcactctagtaaattattatatcctatctggaggtgtaggggaggttgtaggaatgttctgtcagtcaggtggaag

SEQ ID NO: 13337 - DNA, 43985 bp, Homo sapiens
tataggcatgatacttttccaggaattgggacaggcatctctctcaaaatgataatgcaaacttctcttcttacagtgcaagtctaatagttcaaaatgtcttttatatgtgtttttacagtagtcactggttaccataaacagaaagaaaagtaaagaaggaaggtaaaaaggagtgaggagagagtgagaagaaacataataatgctaacagttcaagaaacatttttagaactgagaattgtcccaagggtcttaagtacacacaactaaagttttcaacacaggtttaatttctctaatctgaaaatccaaaatccaaaatgctccaaaatccgaaaccttttaagcacagacaggctgcttaaagaaaatgctcatgaagcattctggatttcaaatttttgaattagggatgctgaactggtaaatataatgagaatattttaaaatatgaaaaaatctgaaagctgaaacacttctggtcctgagcattttggataagggatactcaatctgtaatggaaaatgtgatataaatgacattccagtttaggaagaaaaggatagcaatataataaacgatgctggagaaaatggttatttatttggaaaataactaaattaaacttctgtcatccatgacagatgctaataaattccaggtgtacaacatgctgactatagttaataagaatgattgcgtgcttgaaaatggctgagagtacttttttacctttttttttgtttgtttttgtttttgtttctgagacagagtttcactcttgttgcccaggctggagtacaatgacgcgacctcggctcactgcaacctccgcctcctgggttgagcgattctcctaactcagagtccagagtagctgggactacaggcgtgtgccatcatgcccggctaattttttgtatttttagtagagacagggtttcaccatgttagcaaggctggtctcgaactcctgacctcaggtgatccacccgccttggcctccaaaagtgctgcgattacaggcatgagccactgcgcacggcaagagtacattttaaatattcttaccacaaaataaaatgatagatatggaggtaatacacatgttaattggtttgatttagccattctacaatgtatacatatttcaaaacaacatgaacataataagtatatacaatttttgttaattagaatacataaataaaaattcaattttacttttagatcaaagatctaaataaaatttaaaagatattatttttaaaaatgtaaaatattcatgctcttgagataggaacctcggaagtcataaaagacagattcgactacagaacatttaaaaatacatcataagtaatattaaaaagtaataaaagagtacaaatcgggaaaatatgtacaacattcataatagttaatatctgttttacaatgagtccttaaagacaaaccatccaacagaaataaattaaggtgtagaaaggcaattcaaaagaaatgtaaatggccaacacatatttgaaaatatgctaaacttcattaatgctcattaaaatgcaacttaaatatatgatatgatatcctctttcatgtagttgagtaacacaaattaaagagactactaacacactgcaatagaagtggaggagacatggccaccttcattcattgctggggaaatgtgacatctgtaactatwagggaaaaaaaatctgccagtatccatcaaaaattaatccactaatcacatttttgggaatctagtttatatatgaaaaaaaccaaaaaggctctagtatgacaggatttgcaagaatgtttattatagcattcccgatagagacaaaagttgcaaaaacctccaagtgcatcaatagtagaataaacaccatgaaatatcatgcctttctaaaaagaatgcatgtgatctgtatgcactggcctcgagggatggccatgatatactgcgcataaaagcaaattgtactttgattagtgagtctcattccttgaaaagagaaaaaaaatagacagtgtttatgtatctgtwtacatttgggcgtagaaactgcttttaatactgttcctttagaaatggtaagagatcggggttaactattatttatctttatataacttagtactgtctaagctgttttaaaaaaggggtatttttccattcttattaccttatttcaaaaatcagatactctaaactatgattcagagtcaagtagagagaagcagagagagaatgtcatagtctggtgtgctatttctgattctacataaggaatgtgatagrtaataggataaatctttataggtctttatgggaagagcgaactctagataaactaaactctattagataaaagtgaaatttctggcttggcttaaaaatatactgtacttgcaaataatttaggtatttgttcagtccagacattcacactttgataacaaacagctatgggaaacctagtagtaaacctagtactaaaaccctgtaaaaccttcagagagaatggagaaatactgtaactcacatgcctgcagcacttgataaaacctcctaagaaatcttaaacagcaggaaattgttccttcaagaacaagaacacaaaaatggggtccatttatcaaagaaaagcctatctggtggcaamtgactccaagtaaatgaaattctgctttttcaggttattgagacagatcagaagtaaaggaacttaaaaggaaactgcacccatggggaaataaagccacatatagttcatgcttttaccttatagaaagggcattccaggactgaggctaagaaaagttgggtcagttgtgcccgactcaatgtgtccaaatgagattctttacctgaaacagwaagcatcccagtcatagttacgtctgaattgakgtatgtatgagagaacatcatgaacattcaacatcaatttacacactccagacagaagtattctatttttaaatgacactatgaaatgaacttgttagaattaattatgccctcctcttgccaccaatgaaattgacttccaagaacccaagctcctagctacagaatacaattaaaagagataaaatatgttcacagaattagtggaaatttcctttaactatggagttccggaaatttgacatatttgggtggccttgaattaagatgaataataccatcctctcaaaaaaaaaaaaaaagatacagttgctcactcatcaaaagttctaacatgttaatgtggctatttccactgccattaccatatctcctaagaatgctgcaatttctcagataaggcaaaagtcagtttatctgagacagctttcttccctctacatgatttcctagcatgctttaactgtgtttatgccagcatctgttaacttcaggtctcatcttcggatcactatggaagaaaaactaaaggcaacatattgcctttatatgtgacttgaaaccactgccagttcaaaggttacttttttccaactgtcagaatttataaccaactcaccttgcagccgttgaaggaaaagaggcttgaatatttttgccagaaagttgactggatggcatycattaagtgaacatgaatgaagaagtttcaataatgatttgggtggaaaataattgaaatgagtgaatagcacgttttccagctktctaaataaagcagaggcatttggtggcaaataattgagtttcccaaatggttccattaasgcagaaatctgacgaggtgaaaatttttctgtttggcaaacaaaagtttctgccactgcattgaggatgggttttgaaagaatcagttctctactgcagtactccatgaccctgcagacaacttcaggatccaacgtgaggcacaccgcagctacacgatgctctagggcttttgtaaaaaatgtgtcatggtgcccaaaatatatgaacgcctccaagactctcctaagctcctcgttagtgaaatgtgggacatgcctcacgacrtatttgcccaattttataatcagaggaaatgcttgactttgatcaagaaccaccagggcagtgagcatttggctaatcaatttaggactcaggttggaaactattgatagggaaaagtygtttatcttatttaaaaatgtttggtgttcatccactttttcagtacatgcctgcaagattctataaagggccacaatatcctccggggtaaatgtttccaatttttcaccttgaagttgatttataatgagttctagtgtcacacaacctgaactgtgcagtgtaatcagactttccccaagaatacaaagattgcgaacttccatgccaccttttctgagacgattttggcattctgccaccaggttcagcaacaggctactttgaggatccacatgcaacagaatcagagcttgcaaagcagtcactaaactagtgtttgacagctgtgagggctccttttcaaactgaaagcataaagcttgaaagatgctattctccagtatttcttttggcagcccttgatcaccatcctttttttccacttcacaaattcgttgtaaagctcctgctgccatagtgtcaggcagggtttccatcgtgcttataaaacttagcacttcttctgatgaagtcaagttgctcagtctcctgtaaaacatctgactctcctcatttttaacattttgttcaagcctgtcgcagtcagatacttgagagaacactggtccaccgagtggatgaaggtcatttccatttttcgaatgaaactttttacaatgggcatgatggaatytgaccccgaaaggctcaggttgtcgtgaacacaaccaagggcacagacgctccttgactaccttgtgaacatgatttagaggtttattttttaaagcagccagagctctatgcatctgaaaatcagataaacgataaaggttcttcctcaaggtgatwaatgccataccatcagattctcaatttgataactaaattaaaaaatttaaaaacacatggttaaatacattgagaacatgrttgrcccaacatcaatgtttatgaaactacaaacgagtatctggaaaaaaaaaaaaaaaaaaaaggatggttaacatataaacaccagaggggcaaagtctctgcatcctagagttagaagagtggctgacattgaacaataacaatcgctattacttgctaaacactgttgtaggtattctattaacttacacagattcagtacttttactatcattttacacgaggaagaagttgaagcacaaagttactttgcccagtttatgcaggkggttaagtggcagagctagggttcaaactcaggcaatgtagctcttaagggtggcccttaaatgttggttgaaggaagaaattgcatttggatagaaatcaaagaacaggtaaagtgggcaaaattaggcgaggttagagcaaggcaagggtaaaaacgcgctggaaaggccctaagctgttggtttcccctcggtgtcgggagaaggttagtgttgaaggaaagggtctactttgtcaatggaaacaaggtaggaaaagaaaaagcaaaacatagatcaatgaagggagaaggtggggcggccagtccagatctaaagacgstgcggggggatttggcaacacgtgtgtgcaagacagacagacgggaggccccgcggcgcgttttcctaggaatgaaagggacccgcggggcgagcacccccaaactcggcgccccggggacctgcgctgagacacgggccgggcggcgcagcctgaggagaaagccggccaggtctttgacacccagccggaccaactgcgcggagaccccgcgttgacacctaccgcgctctgccgggcaatcactccgggtggtcgcggaagcgcctgggcgtcgtgggcctccgtagcaaacgcggggcgggagcacgactcagggcggcgcaatgtgattggcccaggtccccttcggagctttctattggtccygggtaccgagcatgggcgctgcgtcagtgcgcgctggcgcaaggttggtggaagtcgcgttgtgcaggttcgtgcccggctggcgcggcgtgggtaagctgcctgtcggctacggttcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggcctagggaaaccgcactcggggacgcggggaactggggaacatgccgggttggggcggcgcgctccggggaacccgggacgttccgagcgcccacccggcgggacgcggccgtgagttctgcccgcggccgtgagctctgcccaccgcctccgcgccgcttccggggctgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagmttttggtttggrtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaataagaaccaagaatcctatcattttaatatagtttttacttttatctttttttaaaaagaggaaaccaaaagctatttaagactgttgtgaatgatactgtggctcaagttttgttcaggttcttggcttgtgccacatcgtttttcaggtaggtggtaatactctcatttttaggataaaggagctgtggtacggatcatttggggagcttgtctacagggttgcacttaggaaacacagattcaagcccaagtagtttcgagcsgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatygcagaagaaatrtgtgagcaagctgtggtacatggattttctgcagatcttcactgtattagtgaatccgataaggttagagccrttacagtggattttaccgttttgtgctttgaagaattttggttgggaagtgatatttatgaaacaaaaggacactaataccaccacatagtctttgttttttaacagaaatgtgtttgttcaatggtatagtaagatatcascagcatttttttaatatagaagtgtgtagttgaattagactaaatggtctcaaaaattgaaacaagtaacaactcaactgtaaatgacagaagtagcatatgctgtgtctgtttcacagggtggctgtgagaacaagtgagatgtgtgtttgcctgctcaggtgtgctttccacctcttgaatctcagtgtcccacttttttccccaaaagaaaggccttgccgtgcgtgttagagttcctcctgatgaaggaccgcctagattcttttgtgaaatagaatttaaagtagtagtgtaargatctggaaaaaactcggctgcttcttcagggactagttgtttatgttcagtctctgcagaagttcctaccttagggtatatgcaactttaccatcttgtgttcttttatttagtttgctgcctccagatyatactatttcagacaattcaggcgataacagttggcargggctttataccacaagatgatttgccagccgctaagcagttaaaattcacttcaacatttcagagactgtcctgccagtgctctctcacccaagtgcacaaccctctctggcctttcctaaaactccagttcagaacactagactgtgtgcagctcaagtgaattataaacccagctcacggaaggagactcacctagttcctttatgcagccctgccacggtaactctggacaccagagaaaagggagcttcctggaggagactgccagtcagcagactctgtcattctacagtaacttaagttcagattgcagtgccacatgatgaagtatctgratctgttactttggacaaaaccaaagccatcagtatcataaaactagtcctgatttggccccttgtggttgacctcagtaagttgatcagcaggtgttttggcagtcagatgaatggtgaattttttttttaacaccaagatagtcatgctrtttatcctccctggctgatggtttcgtctagctgttcataatctaatatccttcctatttcacatagtccttttcaaggtactgacattacttatacaaactctgtatgtagagtttaacacacaacttacatagagtcttggaagcattaaatacttcggtaaaaagttaagttgttacctcttttatcagtgtgaaaaataaggtgaattatttggagccaaattcgatggtgttcatgggcagtaaagcttgtggagtcttacaagtaagacaaggaagtgttctatttgaaatacttaaatttacacgagagtaagaataaagaaacttgatttgtaagagtttatagctcagcttatagctaatgatattctcagagttaagacagtgaaatgctctatatgaaatatttaaacttacatgagaataagaataaacttgatttgtaagagtttgtagctcgcttatagctaatgatattctcagctctctggaaacctgagggaatgagcggttcttgatagccaggtccctgatttagaaggggtaacacttttaatttcccagttttaaaatgccctgttatccctctgccttagtgtcacatgcagtacacatggctggttttatattttgctgaagatttcagagctgttgtgtttttattgctgtttttctttaccacagtattctacttgttgcttccttgtcttggcattctaatcctgagtgcttatgtatcagttctctttatttctgagtctccccatccccattttaacacctctttccttgcttttttttactttcttatgaaaagacgtttccacccagttagctgctgttcctccttggcagctcatcacagtgcctaggtgcctcatcttggctcttagcagtgctgatttgccttgcagatttgagctcatgttaatgtttggcccatgactcagtggcaaagagttgactatatcctatttcctctgatttttctaaaaatgaaagactgggactagatggaaacctgggatgggtactgtctgtgcctgtccctgcctttcgtacacaacatgaagagaaagacgtgttaatcccccccaacctcttgatgagcatcaacaaaacagacgcatggtttccttgaatgacatcctgcattaggcaaattgattaagctgagagcgcctagtcactggactggtcgtctcaaaaaaactggcaaggaagaagattgaaatacaagacaggaaactaagctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacckactgaaacagtccttgaagaagcaacccctcatgccattcctccatttagaaaagcagaacaaaacaaaacactcccaatgattttgataacttctctaagaacgattctcccagaatgaatgattttcatttcccagctacacatcaggattagctaggggagtttttactaaattatatgacttaggcccacctccagtgattctgatgtaattattccaaggtagggccctggcatcgttatttttaaaagctcccaggtgattctaacatatgtatcccaggttaagaaaaactgacttaggactctgtgaaccatagtttaaaaatgttaaaggatcaaaagaaccagatcagcacaatatgataccagaggggaattgagggtctgcattcctgacttgtgacctatgttgttttatctttgaggattattttttggagagggtatctagcaaggatgggttgagtataataaataactgatyagaaatttgagattgtaaccctggcaatgatctgtcatatataacatgttcaagagagtatttcacagtatttataattttttttttaccttaagtttttatactttctgtattttcaaagagagaacacatacttgtttgaaaatccagaaaagacagaaacagaagcctgtcccactgttcgagtcaatgttaggcctaagcgtggaaccactcatttctcacccttttgtagagaaagaacatggagatgcctgcacaactgagggatttaagctttttttttttttttttttttacaccatgagacatagaagcaattcttgatttccccaacacagaaacataccacattgttaattgtggttatttatatggctggtgtacctttctttctatatcaggagtcagtaaactctatraaggtccagatagtaaatattttaggctttgcaggcctactcaacgctgctgttatgaataatatgtacacaagtggacttgactgtcttttaataaaactttatttacaaagaaaggcagtgcatggtatttgtcccaraagctatggttggctgacccctgctcagtatcagaaaaaatgtacagatgacagatattgtggttttgcaacctgtctgatccttgttttaagatttctatatttttacacatagtcatggagatgaaaatgtgaagtcttttctttcaacagcggccaataagtattttgtttcattatatctgctacttttatattgtaaaatagaagaaaactgcctacatgcatagaattactcaaggaaaataaaatgtgaagctctgcattattactccatccataagagcatgaaatagtattattttagatattttatttasctagtctttgtgtccttaaatttaaactttattgtgcattaattatgtatttgggttctctaggtctyggtgattcagaatacacctacttttgcaatggggggaagataattgataaaygacttcaagagcttggagcccggcatttctatgacactggacatrcagatgactgtgtagggtaagggcagtgttctctgtttactccaataagccctctatacatgatggaagttgatttgtaaaacatgtcagcttttcacttaacactgaaattttcctcatgttttacttttgttcgcttttttagctttaggatccaagagggtcagccagagattgatttacctattttgctgattttcttttgtgtccatctcatccttgtcagtatatgctaacggcaagagttagaaaaggtgctccagtacagttatctttattttaaacagtgtaggtatttgcagaaatcagcttgttctttaggaactttaatcgtgcatgtgcttctctctgccatgcacgtggagcctttggattgggctctttacatggagggagcctggtgagccacacttcgctgttagagaacacaggtctgtgggccttcgctgcaggctgcaktgcttggcgtgctcttaccgtctgaacggccrtttgccaccatgccaatcagacgtttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgcygaactcacccctgtgcccacttcttccrtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattraaatgcttgactgtatatttcagtagactatagtgcttagattttcaacctaactaccttacttgaatttttcctttttctgaaatgaagatattttcaagacattcttgcttgatgtgccaccacactaaatggggttrcgaatgcacacttgagtccaatacctgggttcaaatccttgatcccccacttactgactgagatcttggttgaattagttaagctttttgttccttggtttttgcctctrtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacarcctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaartaaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaggtgcwtttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttytacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctygaggacagacctygtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagwctcttggccaggtaaggaagtttttctttatgctatagatgctatttaatcatggatgtttgctttgggcttttaaattattattacattagaagagaggtcaacaaactatggcttactggcccaatgtggcccagagcctttcttttgtaaatagattttactggaacacagccatgcctattcatttaggtagtgtctatgacagcttttgagctgcaatagcagagttagtggttaccacaggggcctgcaatgcctaaggcatttggccccttccagtaaaagttttcccacccaggtattacaaaaggtcttgtattattacttctgtatttgaagaagtagataagaactcagtttcatcattattttggagaactaacaacttggtttctcattttagatgagtcaaacagagatgagttgtgtgggcagtgagttgagtatcacattgcataatagctaatttctccccacaggcagtgtatggtaccctgaagtttttctaacctgcttaaaataagtttccagagcaggcagtctttgaaygcagggctaagccctctwtctgttgagtggctgtttggagttccacatggacttttcttacaaaaaccacacccttactgcagctattaccagttttaatttcttgttttttttaatgaagacagatttagacatttaagaaataatttggatgcagcatctttcttgtatattagcactgtttgtaaacacctggtatgatagcaattttttttagcatcttttataatgtctttctaaagctttcatgtaagtatgattttgtgtataaacaactatgggctattgtttttgcacttgtacttcattattttgtgaattgtttaagtgagataattgcagtaagtgtatctcagtctggtttgggaacagacacaacttatgcctggactggtgggagcagagtgcagtgttgcaccacagacaggatcagttcatggcagcggggatagagattaatcattaatctgactaggagttttaaattagccggaagatctgttaagagtttatgggttttttccgggaggcggaggttgcagtgagccaagattgcgccactgcactccagcctgagcgacagagtaagactccgtctcaaaaaaaaaaaaaaaaaaaaaaaagtttctgggttttttcttaatagaaagtgtcattaaataggcttgagttgttaataatgtagttaaaagatttaacaaatctgaagtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcrgcaggacctgttaacgagcactgtcacttggayctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttyacttgggaggggatgtcctgacgtgcaccaaactgttagaaccctaaaaattgtgctggcactgcaggccctttaattgcatagggcatgggtcttaccaaagaccgcactgtcctggcyactcctcgttgctcattcagtctgatagcacgatgcccctgatagagtaggctagtgtggtgctttgcaggtgttccacatttattcagactcttataacagcaggcaggacttatgatagccctggggcataattgtaaatttatacattgttccagcgcaaagtgaactgtttctgatcctctttagtgatagggttgggaaggagcactttgactaaatcattgtccgtgtacctgaggccatgctagtctactttgttaaggaaaaccagcttgcacggaggttacagtggacctgtttcttgtttgagtttccagtagttcagtgtcatcccccaggatttrtgtggtttttgcagtggtcaaactggtgaattaaatggagatacgatagagaccatcccctgtgtcctccagctttttaaggatgtcatttctctcaggatgctattttgtttctcttgttctatcttggtgtttagggaggaggatggcgtcaaattcagagacttcttcttggcyctccccatgatgatagatcttaaygtcataggccaataattcggtgttgccctgtgccagctgctgagtggccactggaggtcctgggccaggacgccatttaccgcctggcccccatgtgccttgctgtcatagatgagctatgctgatgctttgggtccctgggtaacaacattcatttgaaccccctcttaacagaccctggaatgtttgcayattccccttagcccagtgtacatttcccctttgggagaaggactgcagaagccattgtcaagtacagtttctatagtgtctcacagtccctcctcctagggacctcttctctcctacagtcagtgggttgcaggtctggaaacagggcaaaggatcgtttttattggagcagcggcctacagctccttttacatgcctccttgatttcttttcattgtaaggattgatccagtgcctttgtgggctgcccattttttacatctgtgttctgccctcctcaatttaggacctcagctgtgttgtgtgcattctctcctagctcctgtgggggcatagtgctctgtcgtatactttcttaggggttagtcccttaccttccttagctagcccagtgctttagtggccgagtgtgtcgcaacaaccccagttattggtctagcaaccagaagaggggatggggtgtggtagtgggggtacaggcatgtgctgtgggcagaggtccttacaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttasttcttaattggtgatttgtcctttaagctttttgcattttttttcaagtgcgagtgaattttagcagtagccccccaagtcccaccagtcttctcttctgctgtttctctctagttctcaagcacctgatggatcttgcaaggtgatgcatttgcttccactggcactccctgctacttacggttgcattgttgctgtgtgccagtgccgtctgtctgctctctcactggtgtggtgttctcattgtcaaacaggcagatgatccagctctagactccattttagcatctttcccaggctaccctggcactgactgtcacaggctggttcccaggagtcaaacaatgagatgtttttagggcatcctcttgacagcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggyaaggtgtgacctaagaatgctgaagtgtttctttcaggtggcagaggtagtcattgtcagcactgccatagcctttgcagraggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtccagtacaggagctgctggccacatatagctactcaaatttaaattaatgaacatttgttaagattaataattagtttcttagtgacactacctgtatttcaccagccatatttcagcagccatatgaacagcattgccccacactagggggttcctgtgaccatctacacacatgttgcattcttaaacrtctgtcacattcttcaagatctctccttcctgaaacatttgcagacattctgtttcccttkaygtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctrtggatcttgcgtagtcactaattgaaagaagggtataattgaaaattgcacttacgttttgtcacrtttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgcttggttacatatgctgagttgtgtgcggcttggttacatrtgctgagttgtgtggtgcttggttacatatgctgagttgtgtggtgcttggttacatatgctgagttgtgtggtgcttggttacatatgctgagttgtgtggtgcttggttacatatgctgagttgtgtggtgcttggttatgtatgctgagttgtgtggtgcttggttatacatgctcagaagaatgagaggtctctgacaggacatcttgccattttattcctgacccatcatttttttctctcttctattttcacacctattttctttccacttcagggaaggactagggaagaatggctggaggagattcagcctgagaggaagatgctggcttactcaataagccatgaaagaataatgggatcagaacagcattttatatataagaggcccaggaaaggaagctgtccactaaggtcagccaggaagttagaaatagagcctaaggtcaaacgaggtggctctcgcctataatcccagcactttgggaggctgaaggcggtcacttgaacccaggagttcctgggtaacatggcaagaccttgtctctacaaaaaaatacaataagtagctgggcatggtggtgtgtaccgatggtcccagctacttgggaggctgaggtgggaggactgcttgagcctgggaggttgagactacagtgggctgtaattgtgccactgcactccagcctgggtgacagagtgagaccctgcctcaatttttttaaaaaaagaaaagaaatagaacccagacaggcaggttagggttaattcctcagagcagtggttttgatttcttgagaatctggaaaaaattatggactctcccraaaaatgattacacttgtcccttagtatcttcgaaggatttgtcccaggacccctttcagatacccaaatcctcaaagctcaagtcccttatgtaaaatgttacagtatttgtatataatctatgcacatcctcccctacactttaagtcatctgtagattacttacagtatctaacaccacgtaagtagttgctatactgtatttttaagtttacattatttttattgttattttttattgtttttttccgtcccaaatattttccattcaggtttggttgattctgagggtggagaacctgaggatatggagggccaactgtatatagaaacatttacgtacagttttagtctgagatgtgcctcgatgcaccccctccatgggcccccttcctaccctccacaccctgctggaatccattgaccttaggttaagaaactgactgataatcctaaaataagtgtttgagtacctcttcaaagtcatttagctcaaccgtttattttatgaaagtcttgagaggttaagtgggttattctttcagaaaagcaagggcacattaaggctgttggtgtagatttaatcaaacttcctaacagaaaaaaatacaatgtgtcaaaactagatggttttgcatccataaatattaatactatgtacaccaaaatattttttattctggtattttacatttttgtcataaagaggcaagggttggtctgtgcttagtccagtctctctcccttgctggcaagaaatgtgagcttgtgtcattgtgagaggctcctccccagagccctggcctgcatctgtatcactctggggcttagaggcartgggcytagtaatagacttgacttgggaagtggtgactttttcagcccatgtttgctcacaaccagtatcgagccagatagtgtaatgttttatacttaaggaaataaagtaccctttcctgtcccctamaggaaaagagtaaagtaaggagaagaaaattgaaaaccaatgcatttgaccataattagtttcttttggtcataatgtatgttttcgtgtgtgtgtgcatgtatgtttttgtaagagggatttttatatttacatgggttattgaaaacaccataggaccttactttgtagagaacaaggaaggtctgacttccattctttaagtatgataaaaggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaargaagaaaggtaacagccctgatgctgtgacgttggggtgttgtgggccagtggactggagctgatggtgagagtgtggctctaaggttcagggtcctgtgtgttggccgcacagatgcctggggctcagctgcgcatcaaggtcygggaacacaggcatacgctggtattgstagtttcttaactttcatgttaattgcactgaataagaagataatggatgttctaattattggacatttgtggacatgaaaactgagtgtaaatgtagtttttgagaagcattggcctaggttatttttaaaaattcttttcctattatgtttacttctcatagtatgtttgtttttgctcatttattatataaaataattgctttttccataattaagagaagttatttatttttcaaaatataaatatattatttacttagaatcttgaagtagtcctaaattgattttttgagaagaataatgctaatggagtactgctgtctttttagctttcatttccttaattttaaataattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactamagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcscaagggtrtgtrctatcatcgtaactatcatctatgaatctttttatgttgtatttgcatktaaatttttgttttctattgaaatgagggcttaaatagggctttttcttagtctaaatagggctttttcttwgtcttacttttactagttattractacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactmcataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctccyggaagtggccattaatggatamaatttttcaratgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaatawatatatgtatatttatatawatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatacatatatatatatatatatatatatatatatatatatatatatatatatatgggtttttttcaaaaatagtatgctcattggaaaaattctggatacagaaataacccrggaaaccaaagtattttataatcaaaccctctgagttaacacttgaattttgttttcctgaggaaaatatgggtatccatattatatgtgctgttccataacttgcctttttaacttaaatcaagaatctgtatatttcaggatggaaagagttttaatggatactatggatacaccattatttgttgatgtaattatgggcaattgagtcattttygctttttcactattaaaaaaggcaaacttycttgtactgtattaatttttgaacacttacttgaagtatatttgtaaaacaaattccttggagtagaattgctgttttaaaaatatttacattttaaattgtagtaatgtttgtcaggtttgtcatcttgttctccaaaaacagtgcagtatttcctgttgtagtaccataaagtttttgtagttctaaagtgaaaaaagtatgttaaaggaaaaattgtcactgttttagcttttaatttaggagattgtattggctttagaatttacaaactgttattggtagatgtttttattatcttgccaaagtctttgcagagatttggggcgtccattcagcagtgtttcctgagtcgttgtttttggtcaatgctgagtttggcacttggaggaacacgtgtaatttgttagtgtccaggtattttagacagagattcttcagccaaacytttggaaacctgtgactcctttgggaacagtgattttgtcctccctgttaaggaagtccaggacacaatcatcttgagccatggaatttaaagtagcagtacccattagcatttcacataacatttgatgcagataattactgaagtgctttgttcctaaagagcccttgagaaataagctatgtctgcctgtaattaataacttgtaattgcattgaaataaaaaattcttactagcaagtttgatgttttgttcaggaatttagactttgagaattgagattcagaattttattagttttatttatttatttatattgtggaatttttctaacaggtcaacattaaagcaaatggtaaattaaattccctcctcctgacaatagctcctagtggctttctcattttttcttgggtaattgggtgcatccctaggcagacatttaactgaatattctaatagctctacccacaaattgtgtcacaatttaaggcggrctcctttttgtaggcatttttrcgagcccttgtggactataccagtgacagtgctgaaaagcgcaggctacaggagctgygcagtaaacaaggggcagccgattatagcygctttgtacgagatgcctgtgcctgcttgttggatctcctcctcgctttcccttcttgccagccaccactcagtctcctgctcggtgagtagtcgctttcacaagcaycttggtggctgttcgtgcactggtaggcgggccacctttctgtagtaaagaaaatttgctgctcttgtcttaccctttgtatcctatgcctaaagaatatatctaaatgaatggtggtgattggtaagtaaacrtcttatatcttgtcttcagggtgctgtgacatctgtgtgcccttccagaagtcacagaattccccttccagacttttggttttcttttttttccttccagcagtgtcactatcattttctctcttaatagagtcagttgttactctctttttggctcagaattgagcatcttttctaatttaacttttttcagaaaggttgtttagctaaatgtctaaaaatgagcttcctataaaattttctttttcaaagctaacgaacatcatatttaattgaaagaggctgatgcagtctgtgctgtgtgcrgaatgcagaaatgcccccatctgagcaagtccagatcgagggtccttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcarcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatstcctttcccatagtggtaagtagttatgcctttaacatttgcatttttctttggtgacaccaaaatgtatattgtcctttttactcttgggccagcaagatccttttcgatgcccagtacaattaaagrcacccttctttgcaagtcagggcctgatttctcctcctttttcttagtgttttttccacttaggacctccccaaaatgstaagaccgtgttgctgaatgaggctgctcttctcaccatcctgtcctcaggctggccctctcaccctcttcagtgaagtcttcgagaaccatcagcaggaataggatgacagaacacagggtggggagttctaagtagtattagaaagttctcttatcgyatactaatttatttcaattcttttcgtagattttttgttaccttttagaatgttagaatgtttgtaacaataccacattacgtagttatataaaaaaattaaagtcattgggacttataaaaaattatattattttctaattaagaacaattaaaatatctaaagcttgatattaagttgaacaccctactaaaccttattttgatgtttaaaactctacgccattatacatagaccttttcatattttcaattaagtaactgctaaaaataaaacataccaaaacataaaacatttcaaagtttattagtggatagttcaatatttaaatacagattatttaacctgcttttgaaagaatacctacgtattttgaaatcactgattttttttgataaatttttaaaaaccaaacactttaattattttaaatgtaagatggaaaatatttcaagcctaagcattttcagtaattcttgaaagagtagcctttaatctttttgggatcatgactttattttaaatctgaaamctgsgcacctccctgcagaaaactgcacatatacctagtaagggtttgctgagctcctcacctctgaagccaacttatggacccattcctagaagcctttgcttttaaaattcgcctttgggtagaaatactgatttaagagtaagaaaatgcatcttatctggtttttaactttaggagttgaaagaaaaaatagtaatattttacttgaacacaaagttcaagtgcttaactatgatttaaaactagaacatgatttgagtattctaaataagacatggaatttttttttttttttttttttaggtaaggttattttcagtagtagtgaattaataattgcttgtttttatttttttctagaacatcttcctaaacttcaacccagaccatattcgtgtgcaaggtactactatttattcacgtaatatatagcattgtttctccaaaatcttagactcaggcttccagatcattagagtttactartttattcagtgaaaacttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcctccacatgcttcctgtgtccgtgtgcccagccaccttcactgagtggcagccggaggcaggggagacagaaaagttccactataaaacatttgatgagtccgggcgtggtgactcactcctgtaatcccagcactttgggaggccgaggygggcggatcatgaggtcaggagatcaagaccatcctggctaacacggtgaaaccccgtctctactaaaaatacaaaaaattagccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaayatttgatgagcactggcttataggattctccctgtggccttcattccattgcacagcctctaccgttttcccgtctggctctctgttttgcctttcagtaataatacaagaaggtgcaccattcttttggttgaaargggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagtgcaagcaaataaaattggaaactttcttgaatawcaaaatgtagggtgtgagagtgtgaaggttgggggcagtttttaattacgtaataatggctttcctctgtgmggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagrgagtrtgtacaggctggctggccttgttggttgcttcagttcttcagccaaacatacatgcatcccatgaagacagygggaaagccctggctcctaaggtaagaaattagtaccttaacctcagcattgttaactcatactcttkgtttcaytagaaaaaacagtgttgtctcacccacatcattcattactrtcataagaaaatttatgctgttcttgaattttaaaatctctattgcaagagcagaaaactgtttacttccatgtactctttaactagtgtgtgtattttctgaatgtataaagcatgaattttatatagtayggtctttgcttgtcctattcatggaaaagaagaccttttatgttgatattcttggtacattggcctggggaggggtggagaactgtctaggaagtatttaaggggggtgatgagagacagtctcattttatgtttaagatgtatactgcctctcaaataagtagttttacattgggagtctgagggcaactaaagattaattttatattgtccarttttggctagtagggtccccgcatccctgtttttctgcttttgttatctgtggtgtctgacatctgaacttgtgccattattgagaagacatatggctgtaaatacttttacaacacctaggagtaaaaggttatgtgattttctcaacagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaagtcctctttcttcatagtaatgaagaaatcagtgattsacktggagtgttgtcttaggagaagtttggtttctttattagagttgaaaggttcatagacctcaatagtggggattaggacttcttgggatatacttgagaggataagggatgattgctgcttgaaattgccgtttaacttgatgtttttccagtctgctgcctggaacagagagatgctttattgtgttctctatacatcatgtattcattatacatcaaaatattaggaaccttacagaaactttcttttttgagaagaaatattatagtactgatatacaagtatatgtcacttggtgattgtataaagatagcagatgatctccagaacattaaaaacaatgtgtgtccatcatgtatcgtaaacactaaacatgggtgcctttcacctactcctcctttcctccctccctctcttcgtccttccttccccattttaacagatttttattaactatccaatctatatgcagtagaagtgcagatatgaaggatataatttaaaactatctgaaattacctgtgcttgtgttgtgttttattacaaattatacagaatgttgacttttgcaagacctatcacmcaccctgccctactatggcggatagtacagttattcacagattaaccctgccactgatgttcagcctggctgtgtgaacagaaggacatctgccacatctaagcaggagcactaagcctgtgrgcgtggtgtagcttggctctcttcttcctatctgccatgatattctctccacatagaccctcaagtgaagcagtcccacagccttcgaggaagagagccccagaacgtagaaagtgtgctgttgtcacaggatctttgtacatgtgtttttcttttctgccaggaatatgctctggcatggctaactcccttgattcagatcgtggtcaaaggtctcattgtagacatgggccttctttgacattggtgtttgaattagcagctcactgccacacccatcatttccttatcctgtgtaattttgcttcctaagacattgggamgtcattacccatcattctgtggatatatgtgataatgtgtatgtttattttcttttccttccactagaatgtaagttccgtaaagacaggggcgttgttttgttcatttctgtatccttaatgcctgtcatggtgaatactttcagtaaatctgttaaatgaatgaagcaaagaaggctaatgtaatgttaactagtttcattcccaagtaagagcagtaatgagacacagctttgccattccttcatttaaaaggtatggtgttcaggctcgtcattacttcctacagtcgtccttgagttaaaagttaaaatgtatacagttacaccaccatgcaaggtggaggggaatcctgtcattcttaaatcttgrtatcagtatgacttttgcatatgacagtgaaactggaagtgaaacatactcagattgattcagaaatatcttttgaaattttaacaaaaagattttgataattatatgatttgtttagttataacaaaaataattctgggtaatattggacccagaatagcaaatacagcaccattatctggaatatttggagcagcccctcaatttctttttaaggtgcctgacttttatttaaaatttttcaacctcatcrtgatgctaatctttattgtcttcatatttagggtacatttctccataatatatrctattgtctgcccaccagaaagcagatcttatccatagaccaagaaacatgatttgattatctatttagagttctacctcaaagacaccatgcctatcattttttacaacattttttatttgaatagaaaagaaaaatttgcaagacaaacttctttctgtagtgacaaatgtgctcatggtttcaataaaatctgatgccactatttagtgatgtttctttgatgggaattttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattrggttcctacaacataggtatgttctttttttggctratgggaaaatgtattcctgagtaaccgtttttgtttytttagtcattttgaggataattggacttygtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttyggacagttattttatttcgttttaattttttccttaagcaaaagcataatcacagatgtctctstctcatcagtgtgttcaccatttcgtagrcrctttacacattctgsctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattayctattcaggtattgtacaattccagtattgtactcaaccactgagtgtacaattctaattctcagactttttcascttgacaaccttttagtgatccattatatattatatttcagaaaagagctcagayatttccttaagcatgggatcttaactcatctaaaggtttccttctcaagagatgctcctgttggggaggaggaagccccagcaaagtatgtrcaagacaacatccarcttcatggccagcaggtggcragaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgtacattcttggtaccatttacttacctgtttttagcctctgaaaattacactcatgttactacattaatcatgtgacttgaaatctccagattgattttgttatatataagaataggtgatttgtgctgttgtgaactattgataagtaagaaagaaaaagtatgatttttgatgctgagaatgtggatactaggattctttttctgctaggcataattcttggtgataaagttgaaacgttctgtgttactgaatttgatctactttctgaggcaagatctgttacaggaacccataattgccatagaaaaattgtttaacgcttatttgcttattttgataagactcaaaaaatttctgctagttaaaaaggagttttgaagtaagaaattcactttttcatccaaacacattcctaggatttaacacattctctaagtcaggttcttttttttttcaactgtaatrtagaagacaaaatactggcatcgtgacccagaacatatggatraagataattgaaacaagtttcatgaaacaaagcaacgttttctgtttagtttttataacacattctgatcatttctcttccattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggctggagttttagagatgcacctctaaatagtagaggcagagttcattgtacagatcacagatatctggtcattgagaacttgragaatatcttaaatgtccagactcctaaaacattattccagaaatagctcctcccaatcactggtgctttacttgtcacatttgtgaaatgcacttggaagcattaatagcagtggtcagagggctcagaaggaaaccctggggcacttgaacattgatcgtcygtcagggaagcaggaacaaagtagacagaaggaacagccactgaagaagcaaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagtgctggctaagtgcttggggcatattcagatgtcgatagatacgaggatatrttagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaactcactcattacagcgagcatarcatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttaytccctggtgagaaagctacatataaacagacgtttctaacgtcggaagtgttccagagaggactgcaagagcacccaggaggggtaccgcccccttcttgtaaattgaagagttaagatgtagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacrgtcactgtaggcaaaggcctggcctgggcatgagtgaggctgggagatctgtgtgagatgttctsagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactraaagtcagctttacyagtgccaaacctttaaattttcaaaakaaaattttctttcaacatttcttgaaggacatggagtggagattggatcatttaacaatrtaacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttrcagtgccaacatttaaaaaagtatgaaaatgatttatttttatatgaygtatacccataaagaatgctcatattaatgtacytaaattacacatgtagakcatatctgttatatgtttatgtaactatcaaatggttatttgttactaaagctatatttctrataaaaaatattttaggataattgcctacagagggatttatttttatgatgctggaaatatgaaatgtattttaaaatttcactctggcatatgatttatctrtcamcattactttttttwaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataaycttaaaacttggtaagtttttgtggctgtgtaatctcttcattattatatattttataatagaaaccaatctaaaaatatgggataggaaaatatactaagcaagtactatgtaacatacataattacatgtgtaagttgtatgtatcagccaagatacacttaaggtgaaaacattaaaagagacaaaaatattccttattaataagatacaacaatcaagaacttgtgtccacctaccaatactgtctataattacatgacccaaaacttttatctataaaaagaaactgacaaatagtcaatcataacttggtgttggaaactgacctaagccaatttgcttatacacagcatccaagttatgtctagaaactgctggattatctaagttttaggtgggtatcgttcagctgctccccgcagacttacgagctagtgatagtgaaaatacatttcatgataaatgctgctgtacatacagatatgtatttattatctatttactagttatttttattatttattattatctatgatttattagtaatcaggcacaaaacagctctactatcctagtttctaagcctaatgaagttccagctgtctctttaggcactccaccacatctcgcaggaagagtttactcaaggtgcgtcacaacktggatgtgackrctmcaggggcaaaattttgtccttactgtgaaccatcctctaacctagtgactggacatgctatttcagagttaagcctcaggcatcaccctagggccttgctagataaagtctttcaccttgcttatgtaggagtagggagtagttagcagtgagggaccttttctaacctgctattctaacaagccactgtagcgctcattatttttaatagccagtcttcatactgatcagtgataaaattaacaaaagagcttgtagtaggcagttctgcaatgtgacatttctgattagaatgctcactgcatctagagggttcctttctgtgcttcagacttatacagtgtttgtggattattctaaagtgagttacactgttgtactgaaacaatcattctattgagtcataaactaccrgaaaaaaaaagaatttggatttcactgcaaactatatgacatatatgctacacccaacaaactgggcacccatgttgatttcaaatacacttgaaccattttaaaacattgaccatgaactaagccataaaggaaaactcagcaaattacatgaaataaagcgttgttcactgactctaataaaaaaccaactgcaaaaaawcccacaaaggccacagtgaaacattttaaacacatgcagatgattcatagcttaaattattaaatgtgcacatggaattcaggcgaaacaatacccagggggaggattcatctatttcacaaagtactgtgcacccagtgaccaaaatagttaaaacaccattgttttcagggagctttacattgaggagagacataaaataaaaaatccgtgaattgcatggggtctgagaaggtgataaaggctatggaggatgacaagtcagagtaaatgggatgtgtggcctgcagtcttgtagggttggtgtgacttcatactcagggagtctctgaaggtaaacacttgaaaaagacaaaagagccagccatcatgagtatcttgtggagggaagagtcagaacgaaggccctgagatagaatggttacaggaaatgtgtcttaatccagaccccaggagagagtttttggatctcacacaagaaagagtttgggacgaatccataaagtgaaaacaagtttattagagaagtaaagaaacaaaagaatggcaactacagagggcagctccaagggctgctggttggctatttttgcggctatttcttgataatatgctagggtggattattcatgagttttcccaagaagacggggggatttccccagaactgagggttcctcccacttgtagaccttatagggtaacttctggatgttgccatggcatttgtaaactgtcatggtgctgctaatccattataattagcgtatgatgagcagtaaggactaccagaggtcacttgttgccatcttgactttggcaggttttggctggcttatttacagcgtcctgttttatcagcagagtctttacaacctgtatcttgtgataccagtcctgctgccctcctatcatcctgtgattaagaatgcctaacctcctgggaatgcagcccagtaggcctcagcctcattttgccttgccccattcaagatggagtcactctagttcaaacgcctgtgagagaactgccagacaagttggaacagcaagaagggcattggatattgagcagtgacaaagggggaaactagtaagtgatgacgacaggagagaaatggggaggtctgataatggtttcagatcgtcataggattttggcttttactgtgaatacaaatccatttggtcagtgttaacagtggaaggtatttgagttaccagcagtgaatctgtatgggtctgcagcaacctcaattcttgcctctraagaaagaattcaactgaggggcataaggcagaaaaagaccaaggcaagtttcagagcaggagtggaagtttatttaaaaggctgtagagcagggaagaaaggaaaggagagaatgcttggaagagacccaagctggcaccaagatcaagtgccctgtttaacagtgatgctaggactttataggatggcacttttcccacgattctttccttagggtgggctgcccgcacactcagtgcctcccttacccttgggaagtgagcacccgctgtgtgcttaggaagctgtgcacatgcccatttttaaaacttaaaccacaggctttattccgacttgacttttcccaccaacatttttccattccagaatttcatccaggacatcacattgcatttcgttttttgcctcctgagtcttctccagtctgtgacagtttctcatcttttgttgtttttcatgaccttgaaggcccctggtcaggtattttgtaggaggttcctcaatttgggtttgtctgaggtttaaacgcacaattacactgggtttctgggttttgaggagagcacactagcagtttttttttttttctcatcgtttcatatcatggagtatatggtataatatgattaatcactagggatctcaaccctgatctctttggtaagatggtatgtgccagtttctctactataaggttactctttttcccttttcatatgacattgtttggaaatgagtcactaagttcagcctacattcaaaggaagagaaattaagctccacctcctggaggggttactatctacatgtataatttgtaattcttttgcaaggaaaagctgttccttctcccaatttagttacttattttatcatgtatttctggaagtatggactcatggatatttatttaatactttgggttataatataatactgtattacttattttattgctcaaatgatcatatgtgacgtctctcagggtgactgttgtgttcctttgccatgctctccttttttgttggggaggagggccaagccattttactaaggagaatggaaagggagacaaagaagcgctgatgacagtgagatctgacatccttggctgggccagaatcttaaaggctttgcagttgcagaactattcctgttttttaaagtttcacgtatgtatgagtgctgtttatacatgatgtcttggaatatgtatcatttgtttcactgtttcagcacttcgttttttttggtagtctaaaatgctccaggttgcccttgatttttacctatcccagtgttaagaatgaaccatttctccagtaagtcacaattccttttatcagagaacccctgacaaccacttagctattttccatgcttatagttttgccttttccagactgtgtgatacaactggaattacacaacattgagctttttgggtcagacttatttcacttagtgaaatatatttaaggttaacccatgttgttgtgtgaattgatatctggttcctttttattgctcagtactattctgttgtatggatgtacagtggtttatttatccattcgtttattgagggaaatcttggttgcctccagtttatgacaattatgattaagctgctgtaaacatttgcatacatatttctgcatgaatataagtttttaatttacttggataaatacatcagagtgggatttttgggtcgtatgctaagtttttcttttaatttctaagaaactgtcaaactgttttctaaagtagctgtctcattttacattcccatgaacaaggaatgagagttcatggatttgtttttgagagacctttttgaagagttcagcattgttagagtttgctttggtgcagtccatgtctccagtccctgtgcatttaaacagtagattcaaaattaaaatgatagcatagaaattataaacaacacgaagaaatacaaatggagttactttagttctgttattgtgtgtgtgaccacttgaatttttcctcatgatgacttttgtttaaacatttggaaaacatttatttctttcagtctcacctcatagatgaaaaatgcttcagaatatagttataactgtgaaaagactgttcctgatgttatgatttgctcactgtgaagcttttcatgcactacagacaaatgttggaaagtctgtctcaacttcaagggcagtgaattctgaaagttaatgtggacacaagagtttcttctcagatttcctcctctgctgcattttttttttgagttatcttcttttctggtatgaaattgtaaatcaagtaagtcagatataaaaatatttgcaaacagtcaaaatcaactctaaaagtgatgtagtgaaactcaagctttaaaattgttccttgaagagcagcacacaaaaattgtgtagaaaattattaactatgtaacaacaacaaaaaggtcaatgacatttagacagaaaaaaaaaagaaatttctgggaagaatattagggaaaagaacaacaactgctggccttgcagcagcagaaggaattgcagggtgtgttgaatattttgattatttccaccaggaactagatacttgtaaagcggtggattaagcattctcaagttccttaatgtttagcccattttctcatattcttttagcagagaagaaaaactttagaagctttcacccagtgtaatagaaacttatgatgaattttctggtgaaaatatcttaggggaatttcttctattgcagagatgtttgaaaactrttataatccatcctgaagaaagaaaaacatgaacagtatttcaatttctggagcttattgtaaaatgtgatttttatgaatcwctgaaaaactcatcctcgtacttaagactttttccaagtcttcatacatctatgactccacrtgaaaaaaacttttcaaaattaaaatttaagaagtttttcaatkcgagtgaagaaagctgataaattctcttaaatatccatagaatgtgaatatacaaaaattaatttttgtaaatatgcagaagttacagatcaaaagcagatactataatataattcgcagtggtttaagaccaatatgtagktgtaagtttcccttgttttcccaaaaaacacattagtgcaattaaaaagaatttatcgctttttgtctttaaaattttttaaatttatcccaataaatataaattttgagggtatatctgctaatttaatacctttatataatttgtaaagataaaatcactgtaactagaatacccatcaccttaaatattggtcttttctttatgctagaaacattcmaattattcccttctgactattttgaaatatttaatagatgattgtaaactatgctaaccctactgatctatcaatcactaggttttatttattctaacaaattgtata

SEQ ID NO: 13338 - DNA, 51917 bp, Homo sapiens
  misc_feature (1)...(51917): n = A,T,C or G, or insertion/deletion polymorphism (see Tables 1-2)
gacgtgaggagggttctgggttaatcatgatcagccattactattgctgctgttgtgtgctgttgtactattgttgagctcagcaagggaccatggaagctgtcataatacctggtaaatgtccttgcatttactgagccacctcctacgaaccgcgggcaggggctgttttactggcagggaaacttaggtgcagaggaaagccggctgcccacgtctcttagtggagtgagaggcaggaaactgggtctcaggacaccctccctccacacacatcagggcggccacgttggggacacacgactatttttactttggtgggctccaggctgcccacgtcgtgatctgggtgttcgccatagcaaccagtgacgccatcggcccctacagccaattggagggggccggaagctgctgggctgccggatgacccagctgggagggcaaggtctcccgggagaggcggggaarggtcgcgggggtgtggcgtyaccccaggcctgacttcagctgctctgcgctcagaaaaccaagctgtcacgatgggaggagaataatctacccctcgaaggtctctctgactgcttgaatatgtctgaggacagacaactcacggcgtttagttcaagcagtcatggtgatggaaccatcaccaccatcaccgtggccattagggtctccttcttccccttccaatagttgtgggaatwttttttttttttttttttttttttttttttttgagacagcgtctggctatgtcgcccagactggaatgcagtggtgcaatcttggctcactgcaacctccgcctccagagtagctgggattgkgggcatgtgccaccacacccggctaatttttgtattttttatagagatgaggtttcaccatgttgcccaggctggtcttgaactcctggtctcaagtgatccacctgccttggcctcccaaagtgctgggattacaggcatgagccactgcacccagccagttgtgggatcttataccacttcctccactaccccacgtgaaacagggagggatttgaaccctggtggggggtcccacttgcaccccatccaggcatttccttccaaaactctgacagtcctaggttcccagtctggctcccccactcctgcactgtgtgacccgacaagtgacttaacccctctgtgcctcagttttctcatttggaaaatggcccrgtgacatagggtccctggaggaatcaatgagtagcaagctcagagcctggtgctgggggaracttggatggatgggagtcaagacaatgatcaagacgtgaataataaccaccagttgaaagttgcttccaaaagacaaaaagatgtgaatattttgtttgtttgtttgttttcagatggagacttgctctgtcgcccaggctggagggcaatggtgcgatcttgtctcactgcaacctccacctcctgggttcaagcgattcttctgcctcagcctcccaagtaagctgggattacaggcgcccaccaccacgcttggctgattttgtatttttagtagagataggatttcaccatgttggtcwggctggtcttgacctcctgacctcaagcagtcctcccatctcggcctcccaaaacgctggattacaggcatgagccactgtgcctggcctgaagatgtttttttaaagtggcagagagaggtgargcaaaatcggcagctccctgcaaaggctcccggggaagctggaccacacagaactctcctggcaccactcccggacccttcggtccccgcaccatctgctttccacccacagctccctctgtgcctgctgttcccctgggagtggttcccacccagaggagtggaggttggggaggccccgaccccctgaaactgccctttaaaggtaatatttatggtatacccgtctgcgcttgcccaggctgggggatgctgcctccccaacaagctttagccccaccttgaggaaatcccattttggagaagacatagcacagcaggagcacccccatactggagggattaagagagacccgaagcagctgggtgctgtggctcatgcctgtaatcccagcactttgggaggctgaggcgggaggatcacttaagatcaagagtttgagccaggtgcggtggctcacgcctgtaatcccagcacgctgggaggccaaggtgggcggatcacaaggtcaggagttcaagatcagcctggccaacatagtgaaaccccgtctctacttaaaatacaaaaattagctggatgtggtggcaggcgcctgtagtcccagctactcggtaggccgaggcaggagaatcccttgaacccsggaggcggaggttgcagtgagccragaccacaccattgtactccagcctgggtgacagaatgagactccgtctcaaaaaaaaaaaaaaaaaaggtggccgggcgcagtggctcatgcctgtaatcccaggactttgggaggctgaggcaggcagatcacctgaggtcaggagttcgagaccagcctgaccaacatggagaaaccccgtctctactaaaaatacaaaattagcaggatgtggtggcgcatgcctgtaatcccagctacctgggaggctgaggcaggagaatcgcttgaactcgggggcagaggttgcggtgagccgagatcgtgccattgcactccagcctgggcaagaagagcgaaagagtgaaactccgtttcaaaaaaaaaaggccaggcgcagtggctaacacctgtaatctcagcactttgagaggccgaggygggaggatcacgaagtcagcagatggagaccatcctggctaacacggtgaaagcccgtctctgctaaaaatacaaaaaattagccgggtgtggtggcaggagcctgtagtcccagctactcgggaggctgaggcaggagaatggcatgaacctgggaggtggaatgagcggagatcacgccactgcactccagcctgggcgacagagcaagactccgtctcaaaaaaaaaaaaaaaaaaaaaaagagtttgaggccattctggccaacatggtgaaacaccatctctactaaaaaatataaaaattatattagtcgggtgtggtggcgctcgcctgtaatccagctactcaggaggctgaggctgtgagaatcgcttgtatccaggtgacggagcctgcagtgagccaagatggcgccactgcactccagcctgggccaccgcactccagcctgggcgacagggcaagatcctgtctaaaaaaagagagactcaaagggagaagaggggttggaggcacacagagaggagagctaaggggcttcctggagtagggggtgtcaaacaaagcctgcaggcacatggaaaacaccagtccatgcccagcaaacagcacgtgcaaagggaggtgagactcagcctgctgggcaccaagcccggttggaagttcgatgcccctggaattaaatgggagagaagtcagcatggaccacatggcaccagccccagggcttccaggaggaggaggaggaggaggagaaggagaaggaggaggaggaggaggaggaggaaaataagtggaagctgtccatgagaaagcaggatcaccttggagggctgaacctagaggagccaccccagtagcggcagagacaaaagtccagatacaggctctagcccttctctgccgggggatgctctgtttgtgggacctggtgttttgaaattcggtcatgtgtaaagcaaaggtccaagtaggagatgataaatgtaataagataatagtagtagtagtaataacagctcacgttacccggtgcctgcacacgttatgcgtgaggctgagtttaacccaaattgggaaggtctccacctcctccctggacccagggctgtcgcaaactggccgcccgcgggccaggccggatcctttttcagacctttcctgcacacagccaacagcacgcctcacattgtcaccaccggagaggacgccctgggctatgcgtctggattggccggtcagcacccgtttgtgaatggactctttggcctttggcctccaggaaatctgattggctcgcatcagcgatctaccccctgattggctggggtgctcctggaccattaacaaggtttccagtcaaaagagaccccaaactggggctgatgaagacaacaccttcacgtgccagattggytagaatttctctggcttcctggtgggtacttccctctttgggcctcagtttcttcctttgaaaagtggaactaataatagcactgaccactcgggctgttgggagaattgaatgcatgagagggcttagcctgttaatatgaacggttattcccactttactattattttattattattttaatcttcttccacttggacctttatttttatttttgagatagggtctcgtgatcatggctcactatagcctcaaactcctgggctcaagagatccttcttggctgggcgcggtggctcacgcytgtaattctagcactttgggaggccgaggtgggcggatcacctgagrtcaggagtttgataccagcctggccaacatggygaaaccccgtctctactaaaaatacaaaaattagccgggcgtggtgacatgtgcctgtaatcccagctactcgggaggctgaggcagggagaattacttgaacccgggaggtggaggttgcagtgagccgagattgcgccactggactccagcctgggtaacagagcatgattctttctcaaaaaaaaaaaaaaragagagagagagagawccttctgcctcagcctccttgagtagctgggactacagtcatgagccaccacacctggtacacttagactttcattccatgctccttcctggcttcctgccctttttgattcccccactcctgctcctagccctccagaggagtcttcccagcccctcaatatgggcatgtcctctcctgctccagcaccttccatagctccccatcaccctagggggaaagtctaacctcttcaaaatcagcactgaaggccctggaagcattaagtcctggccatcagcctctagtgctaagaaataggttcaagttcttgtttccccatataaacaggtaagaaaggctacatgcctctgggcctttgcacgtgctgtggcctctgcccggaatgccctcattcagtcggggaatccgtgctcatccctccaccttcgtggagggacgcctgtgctgggttggtttggagaggaagccggaactgcgtgggttcaaatcctgtctgactctgtcacctatactttgtgaaacccggacagtggctatgcttctctgaacctcagtttccccttttgtaacatagaacttaccatcaggaaatgtttgacccccccaccatggaacaggccccacttcttgacgtcagcagcacccccattcgcctacccggaggcggtttctctattttaagaggctgcgggcgggttggcatctaactggggctggaggcgggactgcccccccaccaacaccacgctgctcgccaatcccgccccgccccctcctttccgcccaagtcccccactcttgcctctggcctcagcgcctycagttctgccccacccccgcgcggccagagaccgggtgtctctgatctgcagctcagcccgtgccttccctgaccactcccgacctggcttcccatcacctgctgagttcgcagtcccgcagctaccggtgcggctccaggttggagacccgccggccccattcctctcaccccctcaacccgcccggagctaacctcagtccccgacccccaccccacctgctcagtcctccctaggttccagcttctgtcaacctctttcatttccctaaataccgccccccgctgcaatgcctcgccacccttggctgcctcctctaccccagggctcccagcaatgactgggtcaggcgcctccttcacttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttgggtaagtgctgaatcccaggttccctacctgaaaacttggtggcttcttaagggtgtggtctaagtcccagaggaaaatggccaaatcttaattcctgtttttcttttcttataatggggacactgaggcccagagaagtcaaagggtggctgcccggggtcatgtagtccctgtgtggcttcaaacttaggcttctgctgtccccgacgcctgtgtccctacctcctgatgacacagcctcctaaacataaactcagtaaaaggaggaccctatggctcattggaaaactgaggcccagagaagcaagggtgccctccccccaggtcacactgctggttggcagcgccttgtgccgtaagagagctggttgagggcgcagatcgaatcccagctaggcgacctctggagagtggctttccgggactagagcctcagtttccttattctgacaaatgggcgcctgacagccccaacctccccaggtcgtcgtagggctgagctgagggtgtacagtggtgcagcgacgacccaaggaggtattaatacatatgaactcatattaatacatcgctagtaataggactaaaacaaccatgaacatatggtgagctctctggctgctgttgctagcattattattagaacagctggtggggaggggcagagccctcagcctcttcctcccacgccatcgcttggagcctcagtttccctagatgtccaagggggcaccttcccccttcccaccatgagaaaaagcactttgagaagcgggtggtcaaaaagaagcgatctgagcgttccccaccctctgcctcagtttccctacagcccgtgaaggccccgcccctcccggcacctttcaggccgcgtccacttggccgcgccctctgccttccgcccgcccgcgcaggggcctcacctggagcccgcggcgccgcaggaggctcgactcgtccatggcccgggagtccgcgccgccaggcccgcccccggccccgccccggcctgccmggccccgccgccaggtgccattggccaggccggtcagctgacacggcctggccccgcccctcccggggagcccgaccacagggccccgcccccactgggcgmgctggccccgcccctccagcagagcgcagaagtaaatattttgcatgaatcctctcagaagtaaggcagcatcgttcagccccattttgcagatgaagaaactgaggctaagataggttaatcaatatgcccagcgcattggccgggcgcagtggctcacgcctgtatcccagcactttgggaggccgaggtgggcagatcacttgaggtcaggagttcgagatcaccctggccaacatggtgaaaccctgtctctactaaacaaaaaaaaccaaaacaaaacaaaaaaaaaattacttgggggtggtgacgcgcgcctgtaatcccagctactcagaagactgaggcaggagaatcgcttgaatccaagaggcggaggttacagtgagccgggatagcgccgctgcactccagactgggcgacagagcgagactctgtctcaaaaacaaaaacaaaacaacaacaaaaaatgtgcccagtacacacagcagaacgggttctagggtgaggcgagtgaggatctcacccctgtgcaaaatttaaggtggccccacaaaactcagccatcaagagaaataatattttaaaaacataaaattaatgaaaacatttatgatgaacaaaacatcaaaacttttattttttattttatttttagagacggggatctcactatgttgcccaggctsgtcttgaactcctggcctcaaaagatccttctgcctaggcctcccaaagtgttgggattacaggtgtcagccaccgcatatggccaaaacaccaaaactttttttttttttttttaatttatgagacgagtctctctgttgcccagactagaatgcagtggcatgatctcggcaacccctgcctcctgrgttcaagctattctcrtgcctcagcctccctagtagctgggactacaggtgcccaccaccacaccaggctgattttttgtatttttggtagagatgaggtctcaccatgttggccaggcttgtctygaactcctggcctcaggtgattcacccaccttagcctcccaaagttctgggattgcaggccaaagagttttggtgttttgcctggccaaaacactaaaactcttaagacatgatcagacccttgtccttgcaccactcagccttgtttgcctccctttaatcctggccctggtgccaataaaactttacttacaaaagcaggtagccgctgcagttgtcagtttcttttttgaggatgattgcctttttgccctaagtgtctcataaacaccatctctcacagatatttgaagataattgttctactccattttgcaggaggggaaactgaggctgagaaaagcccaaagtcccaaaatagcacccacatttaaaaaaaaattttttttttgagacagggtctctctctgtcacccaggctggagtgcagtggtgcaatcttgtctcattgcagcctctacctcccgggctcaagcgatcttcctgcctcagcccccataccccagctcccagagtaggtgggaccacaggcacatgccaccatgcctggctaatttttttgggttttttttgtagagatggagtaccgccatgtttcccgcgctggtctcgaactcctggcctcaagtgatgctcctgcatcagcctcccaaagcgctgggactacaggcatgagccactgtgcctggcttagcacctgcattttttctttccctgggactcgcactttctctgcagccgcagttgtcttcggctgccccrctgtacagtgtggacactggagtatgctttcaggctcgaggggaccctaggaagggtcactgggcctgactgtccatgaggtactgtagaattgcatcaagttatggtggccagattgagcaaataaaaatacaggatgccagggaaaacttgtttttctcatacaattttaaaaattgacatataattcacataccataaaattcacgcttttaaagtgtgcaataaattcagtgttttaagcatactcacagagttgtgtaaccatcaccacgatctgattccaggacatttgtatcatccccaaaagaaaccctgtacctattagcagccagtcctcattccccctctctcagcccctggcaactaccaatctgcttcctgttctatgaattttcctgtgctggatatttcataaaaatgaaaacataacatgtggccttatgtgtctggcttcgttcagcatcatgctttcaagatgcacccatgttgtggcaaatatcagtacttcattccgtttcatgaccaaataatattccattgtatatatgtacatgtacattttgttgatccactcatttgttggtggtcacttggattttttcacrttttggtagctattctgaatasagctgctataaacattggcatacaactttttgcatagatttatttctttatttatttattttgagatgaagtgttgctctgatgcccaggctggagtgcagtcgcgggatcttggctcactgcaacctctgcctcccaggttcaattgattctcctgcctcagcctcctgagtagctgggattacagacacccgccaccactcccagctaatttttgcatttttagtagagacgggggtttcaccatgttggccaggctggtctcraactcctgacctttaagtgatccatccaccttggcctcccgaaaggctgggattgcaggtgtgagctaccgccccctgcctttgtggatatattttggttctcttgggtacttacctaggaatggacttccggggtcatatggtgtaactctatgttttgggttgttttgttttgttttgggacagggtcttgctctttcgcccaggctggagggcggagtagctgagactacaggcacatgccgccatgcccagctaattttttgtattttttgtagagacaaggtttcgccatgttacccaggctgatctcaaaatcttgggctcaagcgatcctcctgccttggcttcccaacgtgctgggattacaggcatgagccactgcgcccagcaactctatrttttaaatttgtaaaagacaaccaggctgttttccaaagcaaacacccagttaaatttaaatttccataaacaatgaatgttttttcagtgtaagtatgcccccttcagtacttgggacatagttgcattaaacaacaatgtgttggccgtgtgtgctggctcatgtctgtaatcccagcactttgggaggctgaggtgggtggatcatctgaggtcaggagtttgagaccagcctgggcaacatggtgaaaccgcgtytctactaaaactacaaaaattaagggggcgtaatggggcacgcctgtaatccccgctactcggggggctgaggcaggagaatcacttgaacctgggaggcagaggttgcagtgagctgagatagtgccagtgcactccagcctgggtgacagagcgagactccatctcaaacaaaacaaaacaagacaaaacaaaacacaaaccaatatgttggttgtctgaaattccaatttaactgggaatttaatttaaatgttatttaatgaataatgactacgagtgagtttgttaaatgaatgaatagattttctcctggcaaactcctatgcatccttcaacaccctctttagatgacccctcaggggcatcagggtctcttggccacatggagggaagctccccactcttcgggctgaaggtccctgagaaggcagaagtcaatgggggtggggaagtcgtgtgttttatctggcagtcctacactaagtgaacttcaggctgtagcttgcacaccccaagtgatgagaagctcatgtcctgcaatggccaattgttctgactctgggcagctctgcctcaaagttctcccttagtccagcctggggtggacatgtgactcagactcgtttatccacctcagccactgtgattggttcaaggtgtacatgtgacccaagctcagcctatcagagccctccctggggctttgactggaatcctggggaaagagaggttccctgaaccagggttgggttgggcatgtgggaacatgctggagagagccaccagagaggtctcaaatccgctgctccatctggagaattcctacactgaactgcctcctgaacaacccctcagtgggcaagaaggagtgcttattgagtgactgactggactgactgaatgaatgaatgcagwttttctrtggttaacacacacacacacacacacacgcacacacacaagtatatawatatatatatttgtgtttttttgttttttgtttttgagacaaaagtccagctctgttgsccaggctgaagtgcagtggagcaatctcggctcactgcaacctccgcctcctggattcaagcaattctcctgcgctcagcctcccgagtagctggaattacaggcacctgccaccacacccggctaatctttgtatttttagtggagacagggtttcaccatgtttgccaggctggtctcaaactcctgacctcaggcgatccacccacctcagcctcccaaagtgctaggattacaggcatgagccactgygcccggcctaacatctatatattcttcaaaatccacttcaaattctctttgagaagtatcagaggaccttgtattgaatgaacaaatacattttattcttgtgagcttctatgtacccatcaaaactctcctcacatgtctctataagggacatcaggaagtgtggtggttgaatgaacttttttcttggtaacctcctgagtcttccttaaaacatcctctaatctgtttgggagcggtggctcatgcctgtaatcccagcactttgggaggctgaggtgggaggatcccttgagaccaggagtttgagaccagcctaggcaacatagtgagaccacatttctttttttttttttttcagacagagttttgctcttgtctcctaggctggggtgcagtggcacaatctcagctcactgcaacctccgcctaccaggttcaagcgattctcctgcctcagcctcctgagtagctaggattacaggcgcgtgccaccatgcctggctaattttgtatttttattttattttatttttttgagacagaatttcactcttgttgcccaggctggagtgcaatggcacgatcttggctcaccgcaaaccccgcttaccaggttcaagtgattctcttgcctcagcctcccaagtagctgggattacagacaggagccaccatgcccggctaattttgtatttttagtagagacggggtttctccatgttggtcaggctagtctcgaattcctgacctcaagtgatctgcccacctcggccttcccaaagtgctgggatacaggcatgagaccacatttctaccaaaaactgaaaaaaaaaaaaaaaaagctggatggtcgaggggcggtggctyacgccggtaatcccagccctttgggaggccgaggccagcagatcacttaaggtcaggcatttgagaccagcctggmcaacatggtgaaaccccatctctactacaaatacaaaaattagctgggtgtggtggtgcatgtctgtaatcccagctactcaggaggctgaggcaggagaattgcttaaactcaggaggcggaggttatagtgagctgaaatcgcaccactgcactccagcctgggtgactgagcaagactctgtctcaaaagtaaaaaaaaaaaaaaaaaaaagaaaagccaggcatcatggtggcattggcctgtgtctcagctatatcagaggctgaggtagaaggatagcttgaaactgggaggttgaggctgcagtgagctatgattgtgtcactgcactccagcctgggtaacagagtgagaccctgtctcaaataaaaataataattaaacatcctcaaatgatccctcagaggcattagaaagtcctgattgaatgatgaaaattgttcttgttgatgagtgatgcctatgagtttgttaaattaacaaatgggttgtctcctggctaactcctatgcatccttcaacaccctctttagatgatcctcagcgacgttagggtctcttgccacatggagggaagctcggccctcctcctcgggctgaaggtctctctccctgagaaggcggaagctgaggaggtggggaagtgctgtggttcctcccgtcatgttttctggggccctcgtgactcgatccttcctgcttcacccgcccccgagtctgtggggcacctgaaagtggggcagccctgggaacttatctcagacgagcttctggggmagctgggtggggccataaggggcccacagggcctcttggcaggcctagagacggagggaaggaggtgggcttgccaagaygtggcaaggggaaggtgggatgtggggaacttcagagggagtgtcaggttgtgacttcaataaggggagaaataccacttcacctttgtctggggtacccctccagctcacacacctgccatggctccctaccgccctcggagaaagccaggccctttagcctggcgctcgaggccccagcccatcaccccacagaaacccagacccactgtgtccatcttggtggtccccaaagcacctcctctggacttttgcctctgctgtggcctctgccrgagatgccctgtaattctatacattctagctcaagtgtccctcctccaggcagtcctccctgctccacttcagggcacccggcctccatctgttcctgatcccaaggggctaggggcgtctgtgtccagcttttcacctccccagccctgtatctccctccctcgatgtttttccagcagctgccaggcagaggccactggggaacaacaacaatgactaatcacactggccagcgggtggacagcgctcactgcaagccaagccctccttcatactcacaaaagcccattttgcaggtgggaaagatgaggcctgagagggccaaccttggtgcgggtgggggaagccctgaggcacggtctccactctggaaggggcaaaactatactccacaaggggtggtttgaatccatctcttcatctccagctggggcctcaggtggtctgagtgcccctggactcagtttcccaatctgtgaaataaggcaartgagggactctccaggaattggtggagttgggagggtctcaggatggtcaggagggggccatgactttcctctgatctctacctatttcctccacctttcttgttattttttgagcagggtcttgctctgtggcccaggctggagtgcagtggcgcaattagagctcactgcagtctcgacctccctggcttaagcctcagcctcccaggtagctgggactacaggcacctgccaccatgcccagcaaattattttttgtagagatggagtctcaccatgttgcccaggctgctcttgaactcctagcctacagcaatcctcctgccttggcctcacaaagtgctggattacaggcataatccaccctgcctggcctcctccatctttatgtatctctctatctctgtccctttctctgtctctgcccctcccccaggcctcacacatccatcccccagctgaccctggcctgggccccggggccagagaaggctgtcctgtatggggtcacagggcccccgtccccactgtgccaggcccaggacactgagtctttgtccctaactcactgacctcatagcctgctgggcgcctgrccctggccagctcagctgcccctcggagccaggcttcttgaaggagggacctcctcccaggaagctgaacmgcattgcacaamcctggccacttgggcctcagtttccacagatgctcatccccaggagagaccctctccttctccctcctcagtgcccctggactctaagaatatttcttttttctgtagatgcatctcacgtaacctaaaattcatctttttttttttttttgagacatagtctcactctctcacccaggtgggagtgcagtggtgtgatctcggctcactgcaacctctgcctcccgggttcaagcgattctcctgcctcagcctcctgagtagctgggattacaggtgcatgccatcacgcccagctaatttttgtatttttagtagagactgggtttcactgtgttgtccaggctggtctcgaactcctgacctcaaatgatccacctggctcggcctcccaagtgctgggattgcaggagtgagccaccgcgcccgggccggaaattcatcattttaaagcaaacgattcagtgacatttagcacattcagtgttgtgcaaccaccacctctatctggttccagaacatttgcatcaccccaaaaggaaaccccgcatacatcagcagtcacttctcactcccgcctccccccagcccctgacaaccactcagctactgtctgcctctgtacatttgcctattttggatattttatataagtggaatcatacagtgtgtgcctttcctgtccatcttcgtccacccakcatgatgggtttttttttttgtgtatgtgtgtttttttttttttgagatggagtctcactctgtcacccaggctggagtgcagtggcacgatctcagctcactgcaacctctacctcccaggttcaagtaattctctctgcctcagcctcccgaatagctggaattacaggcacatgtcaccaggcctggcraatttttgtatttttagtagagacagggtttcgccttgttggccaggctggtctcraactcctgacctcaggtgatccgcccacctcggcctcccaaagtgttggaattacagatgtgaaccactgcacccagcccagcattatgtttttgagggttcatccacatggtagcttggatcagagcttctccactgacatttagaggctttgccgacagtggggagggaggggcaggaaacaaaatactcagaggctaagaaatggaacatgggggaaagactaagttgcatctcttaaatttttttttttttttttttaagagacaggatcttgctctgttacccagactggagtgcagtggcrcaatcacgattcactgcagcctcaacctcctgggttcaagccattctcccacctcagcctcctgagtagctgagaatacagatgtgtgccaccacgactggctaacttttaatttatatatatatatatattttgagatggagtgtcactctgttgcccaggctggagtgcagtggcgcgatctcggctcactgcaacctccacctcctgggttcaagcgattctcctgcctcagcctcctcagtagctgggattacaggtgcctgccaccacacccggttaatttttgtattttcagtagagacagggtttcaccattttggtcaggctggtctcaaactcctgacctcgtgatccacctgccttggcctcccaaagtactgggattacaggcgtgagccaccgcgcctggcctaattctttattttttatagagatggggtcttgctatgttgtttaggtagacccaaactcctggggtcaagtgatcctcccacctcgacctctcaaagtgctgggattagaggggtgagcccaggtgcacaaggctggagcttggcatgtggggaggtgggcattgtggagggccagcatgctgcaagctctttgtaacaatttgttggaaggatgaaattaggccatccaagaacactgccctccttcagctcttgagtctcagattcagaagctggcgagatggcccggtgcggtggctcacgcctgtgatcccagaattttggtaggccaaggcggacggatcatttgaacccgggagtttgagaccagcctgggcaacatggcaaaaccccctctcttaaaaaaaaaaaaatgcaaaaattagctgggcgtggtggtgcatgcctgtagtcccagttcctggggaggctgaggtaggaggatggcctgagcctggggaggttgatgttgcagtgagccgtgattgcaccactgcactacagctgggccacagatcaagaccctatctcaaaagaagaaaaaaagaatttggcagccaggcacggtagctcacgcctgtcatcccagcactttgggaggctgaggtgggtggatcacttagggttaggagttcgagaccagcctggccagcatggtgaaaccctgtctctactaaaaatacaaaaattagctcgatgttgtggcagttgcctgtaattccagctactcgggaggctgaggcaggagaattgcttgaacccgggaggcagaagttgcagtgagtggagatcatgccaccacactccagccygggcgacagagcagggctccatctcaaaaaaaaaaaaaaaaattggctagagagggccagagacctggccaagtgcatggaaccacaggtggcccatgggcccatggggctggcatctgggtgttcagttcaggtctggggccagcagggcagaaccccctagaaccctgacttgctccaaagtcagacttgctccagagtctgtggccgccaccatcaccaccaccacrgagctgacttcctgggtttctctttcactttgacttgccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcggtgagtcccctgaccctggcatggcggctcctcttgctgggtggaggcacgtgtatgtgtggagagctgtgggcctgctgtgtgggttggtttcatctctctgtgcctcagtctttcctgctgtcaaatgggagatgggcagtcatggcttctgggatcgaacttagacatctttcctctggtctagattttctcttctgtgaaatgcactaaattttttccacctcccggagttcaatgagaaaaaaaactaaggaaggaataaaaagcaagtatgtatctaataggtatacatagtatagtatcttatgtatgtagtttacaatagatagacatacataatataatgtatacagtcatttccatatttacggggcaatggttccaggaccctctgcagataccaaaatccaaagatgctcaagttcctgatataaaatggtaaagtatttgcatataacctatgcacatccttcyggatactttacttatttatttatttatttatttatttatttatttatttatttatttactgaggtagggtctcactctgtgtcccaggctggagtgcagtggcctaatcataactcattgcagccttgaccacctgggctcaagtgatcctcctgccttagccccttgagtagctgggactgcaggtgcacactaccatgcctggttaatttttttggtgtatactttttacagagacagcgtctcgctgtgttgcccaggctggtctcgaactcctgggctcaaatgatccactcaccttggcctcccaaagtgctcagattacaggcatgagccaccatgcccagccttcccatatacttttaataatctcaggccctgcacggtgactcactcctgaaaatccagcactatgggaggccaagatgggtggatcacttgaggtcaggagttcgagaccagcctggctaacatggtgaaaccccatctctactaaaaatgcaaaaattagccaggcttgatgatgggcacctgtactcccagctacttaggagctgaggtgggaggatcgcttgaacccaggaggcagaggttgcagtgagccgagattgcagcactgcattccagcctgtgtggcagagcaagactctatctcaataataataataataaataractttccttctctgtacactggggatcagcggggtgctgactttttcaatggctcttgagatgcactgagtgcctgtagaatgcccacagcagtgctggccacacctcaaggtcccagcgccttcaggggccaggcatggctggagaccagcagcagggagggggcgagaggcagcccacgaggtatcctggagatagtggcagtgagtggtcagtccagggaaagggaaggaggatgggctttaggctctcaggggtgggtgggtgggtgggggttctgtgtcatcacagagagagatggaaggatggagagccttgtgtgttaagcatctttcccccctcaaggttggacacttggggctgtttcctggggtgccgccttctcccccaaggcttccaatctgcctgcagggctcaggacaggtccttcttgtgggagtgagggcgccggggtcttcctgacccatccatggtggcatccccctccttctctcacccagttccacacctagcagactgtggcaatcccaaagggcacggggatcccagtggctgagggaggtcgctgcctcctggagaaatgttattaataattgccctgactgctagtgggccaagtgtgcttgcctgggccagccctggcaggcctctccctgccatgcaccctctactgtctttccccatgctggcttcagacactggtgccaccccaggcacacctccacttctctctgccctccagactgttggtcttactgttctttcctgcaggggtacctcccgagagtgtctcccaaatatgcatctcaacctctgaggactaaagggtggtggatgaatggatagacaggtggatgggtgggtaaatgaatggatggatgaattaataaatacatgtatgtatgtatgtatggatggatggatggatggatggatggatggctggatggatatatcggtaggtagataaatggatggatgggtgggtgtatggatgaatgaatacgtggatggatagatggatagattggtgactagatggatagatggatggttgggtgaatggataatggattaatgaatgcatggatgcatggataaatacatggatggatggatggatggatggactaatgaatacatggatggatgggtgaatgggtggatggtgggatggatggatggatggatggatggattaatacatggatggatggatgaatggacgaatggayggataaatgggtggatggtggggtggatgcatggattaatacatggattgatggatggatggatggatggatggatggatggatagatggatggggggtggatggatggatggatgaatacgtggatrgatggacggatggtggggtggatggatggatgtatgaatacgtggatggatggatggtggggcagatggatggatgagtagatggatgaatgaacacatggatggatagatggatgggtagatgcgtggatggatggatgaatacatggatggataaatacatggatggatgggtaaatgggtggatggtggggtggatggatggatggatggatgsatggatggatgggtagatgggtgcatggatggatgaatacatggatggatgaatacatggatggatgggtraatgggtggatggtgrggtggatggatggatggatrgatgggtggatggatgaatgaatacatggatggttggatagatggatgggtagatgagtggatggatggatgagtacatggatggatggatgggtagatgggtggatggtggggtggatggatgatggatgaatacatggatggatggatggatggatggatggatggatgggtgaatggatraattcatgggtggatggatgggtagatggtggacggatgaataaatacatggatggatgggtagatgggcagataaatacatgggcagatggatggatgggtggtggtaggagggtgcatagatgggaaagtgggtgggtgggagggctgatgatcacttgggtgtagaccccaaggctgagcccttctccccacacagtgcaaggccaggaatgtcattatgtcttcattgcctttgcagctgcctgcagaaccagtgagtgctgttttcaggacccgccatatccggatgcagactcaggttcggggcagttcctcattgttggctgaggattatgtakggctctgcctgaccccatccacagcggcccctcccatggcctccaccaccaggccaaagacccagccctgcctgtggtcttgggagtccccaccccaccacctgctggcccattcttaccaggttcaagttgccctggagtagccagccgcctctctgaacattatcacttccctagcatggtctcagggctggtgtctgtgtccgttcagattggtcggtacatgggagaaagtacctgttaagcattttgaagccccccccccaacctgataaattattagaacatttatttcatttatttatttttgagacggagtcttgttctgctgcccaggttggagtgcagtggcctgatcacagctcactgccacctccaccttccaggttcaagctattctccagcctcagccttccaagtagctgggattacaggtgyymgccaccacacscggctaatttttgtatttttagtagagaccaggtttcaccatgtcgcccaggctggtcttgaactcctgagctcaggtgatggtgagccacctgcctcagcctcccaaagtgctgggattccaggaatgagccaccgygcccggccatattgtcggaacatttatgctcctaatgcaccctgaaaagggtctgaacactaagcagacacgctgtccattcttttgtttgataacgatttactgagcatcttctatgtgcggacacagttctagacataggcaactggctatgagctcaactaacttcccaagaccacagcctagtggaagagatagacaacaggcaaacaaatgtctatcacaaatgtgatgatgtgttttgaagaaccagaggaggaaagytggggccctggggaccccccaaaaaaaaacaccagaggagggtgagggatagagagagaggtggcaggacatctggcctctgtgaggacaagttaggaggctgaggattcggaataggttgaggtgagagacggcaggggatgaggtaggaaggacgyggggagggtttaggctgaggtgacrctgaaagatgtaagcatcacaaagatttgtcttaggcacgaagacccctccagactctggtctgttcccaagcctacaggatctcttccaggctcggcctcgggccctagggacctgagatgctatcggatatccagtgatcgttacgagtgctcctggcagtatgagggtcccacagctggggtcagccacttcctgcggtgttggtgaggacccctctaccattcccaaaccctcacccaccatcccactcttgcttcaaccccctctggtgcccctactctcggatgcgtgatcttggctgggtcaacactccttcctgggcttcagtttctcatctaagaagagagagttggaggattgtggtggggggttggtcagtgaaggtaggcatcccagggtgggtggccatgagggtctctctagtccttttttcttcttcaccctttcacttatccacccatccaaccatccatccatccatccatccatccatccatccattttttcttttttctttttttctttttttgagatggagtcttgctctgttgcccaggctggagtgcagtggcatgatgtcagctcactgcaacctctgcctcctgagttagagtgattttcctgcctcagcctcctgagtagctgggactataggcacacgccaccacacctgctaatttttgtatttttagtagagacagagtctcaccatgttggccaggctggtcttgaactcctggcctcaggtgatccacccccccttggcctcccaaagtgctgggattacaagcgtgaggcactgcgcccagccctttcattcgtttcttcgctgtgtggtgcagtccttgctgggagatactggggtccctcaaacccctccagtcccagactgatctccaaggaacccccaggctgggggaggaggtgtacaagggacagaaaaggatgctgggggctgggcacggtggctcacgcttgtaatcccagcactttgggaggctgaggtgggcggatcacttgaggccagaagttggagaccagcctggccaacatggtgaaactccatctctactaaaaatacaaaacttagacgcatgtggtggcatgtgcctgtaatcccagctactagggaggctgaggtgggagaattgcttgaaccagggaggtggaggttgcagtgagccgagattgcgcgactgcactccagcctgggtgacagaatgaaactccatctccaaacaaacaaacaaacaccaaaaaaacgatgctgggatgtgatgcacaaagtcggctgtggggtccactaggaccccagactcggcactgacaccctccttcctgctgcagccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtvaccctgcagctctacaactcaggttagcaccttgttctccccmcgtccgttttttacccagagaggccatcaggctgcaaggctggagctagagaggattcctggcccttggcaagggacttgatactactagccattgtcacttcacgtagtgtcacgcaaacactattgtgacaaagcagtctttcatggtccccttaccaatcccctattcgtgggcacktagattgcttctggtttctctctgctagccataatgctgccaagacctggttgggttcttattatctgttctcatgactcgacatcatgtattttgccgggtgcggtggatcacrcctgtaatcccagcactttgggaggctgaggtgggtggatcacaaggtcaagagatcgagaccatcctggtcaacatggtgaaaccccatctctattaaaaatacaaaaattagccaggartggccacgcgcgcctgtagtcccagctactggggagactgaggcaggagaatcgcttgaacccgggaggtggaggttacagtgagctgagattgagccactgcactcctgcctggcgacagagcaggactccatctaaaaaacaacagcaacacacaaaaaagccaaaaaaatttgcctggtgtggtggtgcatgcctgcaatcccagctacccaggaggctgaggcgggagaatggcttgaatccaggaggcagatgttgcagtgagctaagatcaagtcactgcattccagcctgagtgacagagcaagacactgtctcaaaaaaaaagaaaaaaaagaaaaaagaaaagaaaagaatgaaggaaaacatgtcatttgccacaacatggacaaagctggaggacattacgctgagtgaagtaagccaggcacagaaacaaaaacatttcatgatctcacttacatgtataatctttttttcttttttcttttttttgagatggagtttcgctctgtcgcccaggctggagtgcagtggcgcgatctcggctcactgcaagctctgcctcctgggttcacaccattctcctgcctcarcctccccagtagctgggactacaggcgcccgccaccgcgcccggctaagtttttgtatttttagtagagacggggtttmaccgtggtctcgatctcctgacctcatgatccacccgcctcagcctcccaaagtgctgggattacaggcgtgagccaccgcgcccatcccacttacatgtataatcttaaaaaaaaaaagtcgaatatctaggcaccgaaagtagaactgtggttaccggggatggagagaaggaggaaatgggggagatgtaggtcaaaggaatacaatttgtagttacgcagcacaaataaatctagagttccaaggtacagtagagaactataattaaaaataatgtatattgaaaatttgctaaaagaatagatttaagggctgggtgcagtggttcacgcctgtaatcctagcacttcgagaggccgaggtgggaggatcacctgaggtcaggagttcgagaccagcctgaccaacatggtgaaaccccatctctactaaaaatacaaaaattagccgagtgtggtggcgggcgcctgtaattccagctactcgggatgctgaggcaggagaatcacgtgaacctgtggtatggaggttacagtgaaccgagatcacaccactgcactccagcctgggtgacagagcgagactccatctcaaaaaaaaaaaaaaaaattttaagtgttctcaccacacaccaaaaaagtaattatagaaggtgatggatatgtatatatatttttaagagatggggtcttgctgtgttggccagggtggtcttgaactcctgggctcaaatgatcctcctgtcttggcctcccaaagtgcttygagtacaggcgtgggcccctgtgcctggccatggatatgttaaattccttactgtagtaatcatttcactatggatatgtatatcaaaccatcatacctcttaaatttatacaatgatataaaaaaagaatcaggccgggtatgaccacggtgcagcaagactattttatgctaatttatgtctctccttrggtcaggttccttgaaatagatctaaaaactaagtacgatttccctgatagttctaaacaaacaaacaaacaaaaaaagaatkggctggacacagtggctcatgcctataatcccagcactttgggagcccgaggygggyggatcacccccaagagacaggcacttttgtaaaktgcttaccagaattgattaccctctggcaagcaatttacaaaagtgcccgtctcttcacagccttgccagcaatgggtgttaatattttaaagttatcttcactaacaggatcctgtgtataaatctttattaaaaatkatttatttttaaattttaatttaattttaatttgttttgagacagagtcttgctctgtcacccaggccggagggcagtggtgggatcttgtctaactacaacctccgcctcctgggttcaagcgattctcctgcctcaggctcccaagtagctgggattacaggtgcccaccaccatgcctggctaatttttgtatttagtagagacggtgtttcaccgtgttggccaggttggtcttaaactcctgacctcagatgatccacccaccttggcttcccaaagtgctaggattacagctatgagccactgctcctggccatatttgttgtttttttagagacaagttctccctctctctcctagattggagagcagtggtgtgatcagggctcacttcagcctcagcctcctaggctcaagagatcctcccatctcactctcctaagtagctggaaccacagtcatgaactaccatgcctggctaatttttatgtagagatgagggggtctcactatgttgcccaggctggtctcgaactcctgggcttaagtgatcttcctgccttggcctccyaaaatactggaattacagggtgagccaccgtatgtggcttgtgtataaatcttgactttttgatcataatataccaggcttagctgggacctgcaagtgtcccctaattcatatttagggattcagttgcttaccctggacagggtggattttcagggcccattaactcacatacgtgtgggctgcccctcgccaatccctacctctgcttccagttaaatatgagcctcctctgggagacatcaaggtgtccaagttggccgggcagctgcrtatggagtgggagaccccggataaccaggttggtgctgaggtgcagttccggcaccggacacccagcagcccatggaagttggtgagtttgtttcccaagtccagggtggacacgggcctctccagggcaccttcacccccaaatcagtctcaccatctctgcatctgtccccgctcccaaccagcccccactctagcccctgaggtggtttttttytttttcyttttttttttctgagacggagccttgctctgtcgcccaggctggagtgcagtggcatgatctcagctcactgcaacctctgcctcccgggttcaagcgattgtcctgcgtcagcctcccgagtagctgggattacaggcatgcgcccactaccacacgcagctaatttttgtatttttagtagagacggggtttcgccatgtgggccaggctggtctcaaactcctcaggtgatccgcccaccttggccttccaaagtgctgggaatacaggcatgaaccaccaygccttgctcccactaaaattttttaaaataaattttttcttttggaataaccttcgattttcagaaaagttactatataaactggtgcagagaacgcccatatatcctttacccaaactcctctaatgttaatgtcttacataaactccaggcattatttgaatgtcaccaatttttccaggaatgtcttttttctgctcccagattcaatccaggatcccacattgtgtttagtaaaataattattaatttttaaaatttagttataataattttttacygctttatatgttcctaaagaaggtttgaacctagagaaggttctctagtaattaaygatagaaataatccctggaagtatggtctttaatttaaaaaaatttagcgaggtgcggtggctcacgcctgtaatcccagtgctttgggaggccgagttggggtgggattgcttgaggccaggagtttgagaccagcctgggcaacatggtgaaatcccgtctctaccaaaaatgcaaaaattagctgagtgtgatggtgcatgcctgtagtcccaactactcaggagactgaggcgggaggatcacctgagccctgggaggttgaggcttcaataagccatgattgcaccactgcactccagcctagatgacagagtgagaccgtgtctcagataaataagtaaataaataactaattgtaaaacagcaaatatttttcagcaccaaaatgcaaaacaatatatgaatatgtttttattctagggcgactgcggacctcaggatgatgatactggtgagaataataatagtaatgacaacaacagctgcagcaaattggcattaattgagcacctactgtatgccaggtccaatgctgaatttttttgtatgcctcttaccctgccccatagttcagtattggattctttccaaattgcaggtggggaaacaaatcacgacttggagggggtgagaagcctttggccaaggtcacgaccgaagggatggccgcagccaggacttgaactgaggggcagggatggacgtgggtgatcctggaggccctaagaggacagggcctggcctgcttctgctgagcccccaggacccagcacgtggctctgtacacagttggagctcaataagcrcatgatggttaagtgactggtgccaagtcctggacaattcttacggcctgatgttcgacctgcctctccccagagtcctgcctctgccccctggagatgaatgtggcccaggaattccagctccgacgayggcrgctggggagccaaggaagttcctggagcaagtggagcagccccgtgtgcgttccccctggtaagatcactctgagtacaggaacaggggcaagcattagaaataaggcaacagccggaggtggtggtgcacacctgtagttccagctgctcagaaggctgaggcgggaggatcacttgaggccagtggtttgagaccagcccgggcaacatagtgagaccccatctctaaaaaataaaataaaatgggkctgggcgtggtggctgatgcctgtaatcccagcactttgggaggctgaggcgggcagatcacttgaggtcaggagttcgagaccagcctggccaacatggtgaaaccccttctctactaaaaatacgaaaattagctgggcgtggtggcgggagcctgtaatcccagctacttgggaggctgaggcaggagaatcccttgaacccgggaggtggaggttgcagggatccaagatcacaccactgcactccagcctgggtgacagggccagactctgtctcaaaaaaaagtaaaaaaaaaaaaaaaaagtaataataaaataaaatggaaaaagaaataaggcagcaggtattagaaacaaggtggtgagtgttagaaataaggcagagggagaaatgggtgctcaaaccctgacaatgtggcatccggtcttgctgcacccactttagggttttttgctgctgttttttttgtttgtttgtttgttgttttttgttgtttttttttttgagacggagtctcactctgtcacccaggctggagtgcagtggcgccatctcggctcactgcaagctccgcctcccgggttcacgccattgtcctgcctcagcctcccaagtagctgggactacaggtgtctgcaaccacgcccggttaattttttgtattttttagtagagacggggtttcaccatgttagccaggatggtctcaatckcctgacctcgtgatctgccctcctcggcctcccaaagtgctgggattacaggcgtgagccaccgcgcccggcctactgctattttttgttttgttttgagactgtcttgctctgtcaccctggctggagtgcagtggtgtgatcttggctcactgcaacctccgcctcacgggttcaagcgattctcctgcctcagcctccagagtagctgggatttacaggcatgcaccaccacgcccagctaattttgtatttttagtagagatggggtttcgccatgtttgcccggctggtctcgaactcctggcctcaagtgatcctcccaccacggtctcccaaagtgctagaattccaggtatgagccactgcgctcagcccactacagggctttatcaagtgagaatcatcaggctgaacctcacggtgtctcaaggacaatgtcacctgcaggtggcagggtktactaaacagctgctgccctgagcctgggcaacaggaaaatgagtgagagggtttcaaaccatgcagaaaggcctggcgctgtggtttatgcctgtaatcccagcactttgggaggccgaggccagaggattgtttgaggccaggagtttgagacaagcctgggaatcaaaacgagactctgtctctagtctataaaacaacagcaacaacaacaaaaccatgcagagaaatacatttgcattcaaaaaggaacttagaggccaggcgcagtggctcacgcctataattccagcagtttgggaggccgaggcaagtggatcacaaggtcaggagttcaagaacagcctgaccaacatggtgaaaccccgtctctactaaaaatacaaaaattagccggacatggtggtgcatgcctgtaatcccagctacttggaaggctgaggcaggagaatcgcttgaacccagaaggcagagattgcagtgagccgagatcgcaccagtgcactccagcctaggtaatagagtgagacttcgtctcaaaaarcaaacgaacaaacaaacaaacaaaaaaccttaggcaacatgagattacaggtggcagttatccctggggatgcaaattgtgttaatttttcttccttcagttttttctcttttctgcaatttggggcagcaagggattttcactttgtaaatgtggagaatccatcatttacaaagaaaacatccatcagtctttctctccttccaattcgtctagttggtttggttctgattgcagaaaaccccccacagcctcaggtgagattctcggtggagcagctgggccaggatgggaggaggcggctgaccctgaaagagcaggtaacggggctgtcacagggctgtggggtggcctgggatggggagcaggaggcaaaagcctaggcgggggatgagcaagtggtagatggagggagatgagatgtagaggtggcaggaagtgggcaaattgtgggtttaactctgaaggtaatagggagccatggagtgtgtgtgtgagcaggagaggcacatgactggactcagatgttcacagactttccctggctcctgtgtgagaaacagagtgtgggggaattgcacagaagccagaaggccaggaaggagataatggtgactgcatttgcctgggtagcagattattgctttaagtcccaaaacaacccattaagtgcagtctgattagtttacagagagggaaactgaggcatagagggagtatctctgttgaracaaaactgacaaatactccactcgttgactttaccatagtcatcttagtcaggtccctaatgggctgttactataaggctgtagcaaaaatcctttatttcctatgttcctctaactcaaattcctcttcttttttttcctttttttttttttttttttgagatggagtcttgctctgtcgcccaggctggagtgcagtggcgccatctcggctcactacaagctccgcctcccgggttcacgccattctcctgcctcagcctcccgagtagctgggactacaggcgcccaccaccatgccgggctaattttttgtatttttagtagagacggggtttcaccgtgttagccaggatggtctcaatctcctgacctcatgatctaccygtctcggcctcccaaagtgctgggattagaggcgtgagmccccgtgcccggcctctcaaattccttttctaaggaaaaattttctgcttgaggtaactgggttaaaagatggaaacatttttgttttcctgaatgtcagtgggttttgtcaatttcccacctccctcaagctagatgtgtgcgggaggtgaatgcctgtctcacagcagctttgccagcattgaggtttattattcttttaatttttgatgcatgttattggctgtggcctttgtccaagtctgtcttcataggctgtgccctgctgtctgcctatgggatgatgagtgtgatcaggtacccacaagctgtctttcatactcctgacagccaacccagctggagcttccagaaggctgtcaagggctggcgcctggcacggaggtcacttaccgactacagctccacatgctgtcctgcccgtgtaaggccaaggccaccaggaccctgcacctggggwagatgccctatctctcgggtgctgcctacaacgtggctgtcatctcctcgaaccaatttggtcctggcctgaaccagacgtggcacattcctgccgacacccacacaggtgcctcctctgggtggggaggkcggtatgagggcccctcagagctgagcacctactctgagcctcagctagaccagggtgagaggagcgaggcagaaaattttaaaggagtgcctgatttaggggtgtatcaaaaattcagtaatcagcyaggcacggtggctcacacctgtaatcccagcactttgggaggctaagacaggtgaatcacctgaggtcagcagttcgagaccagtctggccaacgtggtgaaacccagtctctactaaaaatacaaaaattagctgagtgtggtggctgtagtcccagctacttgggaggctgaggcaggagaatcgcttgaacccaggagccagaggttgcagtgagccaaaattgtgccattgcactccagcctgggcaacaaagagcragactgtgtcaaaaaaaaaaaattcaataatcaagatccataatgcagttttttgttgttgttggtttgttttttttaagagacagagttttgctaygttgcccaggctggacttgaacttctgggctcaagcaatctttctccctcagcctcccaaatagctgggaatataggcatgtgccatcatacctggctattatgcattattaaagaacaacaacaaaaactagctgagccactgcgytccaccctggttgatagagctacactctttttcaaaaaagaaaaaagagagaaagaaagaaaaaaggctagagttgaccctgtgtttatttaagatctaatttcttttttttcttgtgacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccwtggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagycactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctcyctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatccccagaattgcaagcagtatccatctctctgacattcatgaagacgccctggcgggagggagtgggagagatttgcccagggactgagtgggtgtgtnctcgtgcttctgagtttggcatgagaccaccagtggcgccggtcaggccagggaggcctagtcttgcatcacactctccgcctaggctaggcaagtggtgggcagccaggtatctgccacagccggagacgcctacaaggctggaagtgggtgtaatggcagtacaggaagctctcatggtgaatatcctggcaaggagacagcagttaggctggaggaggactcagctcattcaaacaccacctgctgactggatgcggcggattaygcctgtaatcccagcactttgggaagccaaggcaggtggatcactggaggtcaggagttcgagaccagcctgggcaacacggtgaaaccccatctccaccaaaaaataataataaattagccaggaaatggtggcgcatgcctgtrgtcccagctactcaggaggctgaggcaggagactcatttgaacccgggaggctgaggttgcagggagccgagatcatgccactgcactccagcctgggcgacagagcaagaatccgtctccaaagaaaaaacaaaaaaaaacaaacgccatctgctacccactttgtgcctggccccaaggcagcctccagtgcagggaaacagccaaacacagacayccctggccctgtagggtcaggggtatagacgagagggtgggagagaggctgcaggagccagagaaggggactggggagagagatggcaactgtctcgatgcgtctctcccctctccttccagaaccagtggctctgaatatcagcgtcggaaccaaygggaccaccatgtattggccagcccgggctcagagcaygacrtattgcattgaatggcagcctgtgggcyaggacsggggccttgccacctgcagcctgactgcgccgcaagacccggatccggctggaatgggtaatggcctggaatggcctgcgcctacccctcctctgtgccctcccttttaggtcctggtgggttcaaacctgcagggaaggcacacagygggtgtctaagkcccagagaggtgttgcygcttactcaatgtcatacagaggtagggacagggtgaggttyggagcctctcacccatatgggtctggaacctcttgctggcatcctgagctcagttccaggcagatcacacacatacaggtaatgaatctcacatcccaaggtgtttgttaaatattcaaccncgccagggaaggtggcagttcgcgagatgctggtggcaaattaatgagcagtctttarggaaaggggggccgtgaggctcaggtggcctctcactctcycgcttcctgctctgggccttgccagagccccagaaagcctcagcctcagcctgttccttgaagaatacacagcctgaggagacagaactggacacggaacccctgaccccattgtccgggcaaggtggctaacacctgtaatcccagcactttgggaggctgaggcaggtggatcaacagaggtcaggagttcgagaccagcctggccaacatggagaaaccctgtctctactaaaaatataaaaattagccaggcatgatggtgtgcacctgtaaatcccagctactcaggaggctgagacaggagaatcgcttgaacccgggaggcagggattgcagtgagtcaagattgcgctattgcactccagcctgggtgacacagcgagactccatctcaaaaaaaaaaaaaaaagaagccctggttccatggagtaagggctgggttagagggggatggggatggggttgggggtgttgcatagggaagagatcttggaggaggggatattggtgcaagggctttgaaacatgagtaggagttttctgggggttcctggcaratggcacagccagtgcaaaggtgcagaggtgggaacacaatctactgaatggcctggcctttgcttatccttccagcaacctacagctggagtcgagagtctggggcaatggggcaggaaaagtgttaytacattaccatctttgcctctgcgcaccccgagaagctcaccttgtggtctacggtcctgtccacctaccactttgggggcaatggtaagtgacccaaacctgcaggtttacattattttttctttttaaataatttaaaaaaatagaggctgggcacagtgactcacrcatgtaatcccagcactttgggaggccaaggtgggtggatcacctgaggtcaggagtttgaaaccagcctggccaatgtggcgaaaccctgtctctactaaaaatacaaaaattagccgggtgtggtggcgggtgcctgtaattccagatacttgggaggctgaggcaggagaatcgcttgaacccaggaggcggaggttgcagtgagctgagatcatgccactgtactccagtctgggtgacagagcaagactctgtctcaaaaaaaaaaaaaaaaaaaaaaaaaaggacaatgctgttaaggcagacagaatggctcacccctgtaatcccagcactttggcactttgggaggctgaggcttgtggatcacttgaacccaggagttcaagaacagcctgggcaacatagcaagaccccgtctctacagaaagaaaaaagtttgccagccatggtggcatgtgcctgtagtcccaactactcaggaggctgaggtggkmagatcacttgatcccaggagtttgaggctgcagtgagctatgattgcaccactgcaatcatacaacctctgcctcccgggttcaagccattctccttcctcagcctcctgagtagctgggattataggtgtgcactaccatgcctggataattttttgtatctttagtagagacagggttttagcatgttggccaggctggtctcaaatgcctaacctcgtgatccacctgccttggcctcccaaagtgccgggattacaggtgtgagccactgcgcccggccagcattgtccattttatagataagaaaactgaggcccagggaagggaaatgacagtgactgagtggcagaaccagaattaaaacccagctcacctgactctgtggccaatgttacctccgtctctggacagtgggaggctgggcattcaggaagtgctcaaccagcactccttttttttttttttttttttttttcttgagacagagtcactctctgtggcccaggctggagtgcagtggcacgatcttggctcactgaaacctctgcatcccgggttcaagcgattctcgtgcctcagcctgccgagtagctgggattacaggcgcccaccatcatgcctggctaatttttgtagttttagtagaaacagggtttccccatgttcctcaggctagtctcgaactcctgaccttaagtgatctrcccaccttggcctcccaatatgctgggattgcaggcatgagccatcgtggctgggctttttttttttttaaagacagggtcttgctctgttgcccaggctggagtgcagtggtgccatcttggctcactgcaacctctgcctcctgggctcaagtgattctcctgcctcagcctcctgagtagctgggattacaggtgtccgccaccatgcctggctaatttttgtatttttagtagagaaggggttttgccatgttggccaggctggtcttgaactcctgrcctcaaatgacttacccacctyggcctcccaaagtgctgggattacaggtgcgagccactgtgccaggcctcgaccagcattcttggtgttgactatgacaatggtactggttgcagcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcaggtacgtgaggcagtgcagacctggcttggggaggaagggaggatcctggcctgtgatctctcttgctgtgtgaccctgggcaccttgccgtccttctctgggccttggttatcaaacccttaaaacaagagaattggctgggcgcagtggctcacgcctgtaatcccagyactttgggaggccaaggcgggcggatcacctgaggtcaggagttcaagaccagcctgacmaacttggagaaaccccgtctctcctaaaaatacaaaattagccgggcatggtggcacatgcctgtaattctagctacacgggaggctgaggcaggagaatcgcttgaacccaggaggcggagattgcagtgagccgagattgtaccastgcactccagcctgggtgacagagtgagactctgtctcagaaaaaacaaaaacgaaaacaaacaaacaaaaaacaaaaacaagagaattagacttgagggtcttttttttttttttttwaattttatagacagggactcactctgtgcccaggctggagtgcagtggtgccatcatagctcacagcagcctcaacctcctgggctcaagcgatcctcccacctcagcctccctagtagctggaaacacaggtgcacaccaccatgcacagttaatattttattttttgtagaaatgaggccttgctatattgcccaggctgggattttttcttttttttctttttgagagggagtctgtctctgtcacccaggctggagtgcagtggcgccatctcagctcactgcaacctctgcctcccgggttcaggcaattctcttgcctcagcctcccaagtagctgggattacaggcacccaccaccatgcctggcaaatttttgtatttttagcagagacggagtttcaccatgttgaccaggctggtctcaaactcttgacctcaggtgaatcacccgccttggcctcccaaagggctgggattacaggtgtgagccacygtgtccggcctcgctcaggctggtttcaaacttctggcctcaaactatcctcccaccttggcctcccaaagtgctgggattagtcatgagcacccagctgaacttgagggtctcgatcaccccttgcagaccctggagaaggctgggtgggcaccagccaagtgcttatggtgtattggattcatccatgggaagctgcccctcacatgtagcagcagctgaactctcatcaagcagggatgactgtctccattccacagatgaggaaacyaaggcctggaggggggatctgatgagggacaggaaagcccacaaaacagggtttagccaggagggtttttggctttccccaggaaagagttcaagtgcatgtcggtggtgttagacagaaacttttactgaagtggccgtgtagagcagcagcagaagtcctgctccttgcagagtggggacgccccacaggcagggcagctacgtctcatatttatacccgcttttaattatatgcaaatgaaggggcggtttatgcagaaatatctaggatgaaggtagtaacttccgggttgtgggatcattgccgtggacaggggcggtaatttccgggtgttgccatggtaatggtaaactgacatggcacactggtgggcgtgtcttatggaaagcccaggacctgctttagctagtcctcagtttggtcctgtgtccaagccctgcctccagagtccaatcctgcctccaacctcagatccacctgcccaaagatccaacaagtcagccggacgcggtggctcacgcctgtaatcccagcactttgggaggctgaggcgggcggatcacttgaggccaggagttcaagaccagcctggccaacatggtgaaacctcatgtgtattaaaaatacaaaaaattagctggctatggtggtgggcgcctgtaatcccggctactcaggaggctgaggcacaagaatcgcttgaacctgggaggtggaggttgcagtgagctgagattgtgccactgcactccagcctgggcaacagagtgagactccatctcaaaaaaaaaaaaaatcttgagatgaatgggcgcattaagagaagagattttaggttgggcttggtggctcacrcctgtaatcccagcactttgggaggccgaggtgggcagatcacgaggtcaggagatcgagaccatcctggctaacacagtgaaaccccgtctctactamaaatacaaaaaattagctgggcgtggtggcgggcgcctgtagtctcagctactcgggaggctgaggcaggagaatggtgtgaacccaggaggcagagcttgcagtgagccgagatggcgccactacactccagcctgggcgacagagcaagactccgtctcaaaaaaaaaaaaaaaaaaagaaagaaagagtagagattttagcaaaatgcctatgaatccccaccccacccacaggctgtggtagcccagcctggcctctgaggagtaaagaggtcccaggactcagggttgcctctcccactgcagagcatcccgtgcagcccacagagacccaagttaccctcagtggcctgcgggctggtgtagcctacacggtgcaggtgcgagcagacacarcgtggctgaggggtgtctggagccagycccagcgcttcagcatcggtgagtggagggggtaggacccagttatttacccagcatgcactgcactgcgcttcccacaatgatcttagcagccctgccctcactctcactccctctatggctccctactgccctcaggagaaagtagcagctcaaactgctcccattgccttctctcgcagcttcctctcacactccaggagccttgcccatgcaggcccttccctgcctcctgcctggaatgtttgttttccacacggtccaactcctattcgtccttsaaaactcagctcaaaagttccctcctccagcaagacttctctgccyccttctggccatgcccttgtttacaactgtcccttctccctggtctgacactgcggggttggggtagatgtgtcaaggtatctgggggctcttggggaggaggaagatgcaggaatctgttcattgagcgacaaataaatgaatgcaaaaataaggaggacacaggcaaaacccggtgtggtggctcacacctgtaatcccagcactttgggaggctgaggctggaggattgcttgagccgaggagttcaagaccagcctgggcaacatggtgagacctcatctctacaaaaaatatttttaaaatagtggggtgtggtggtgcacacctgtagtctcagctgctcaggaggctgaggtgggaggatggcttgagaccaggagttcaaggttgcagtgagccgtgactgcaccactgcactctggcctgggcgacggagcaagaccctgtctcaaaaaaaaaaaaaaaaaaaaaaaaaaaaaaaaaaaatagaagaagaagaaggagaagaaagaagaagaagaggaagaggaatagaagaagagggaggaggaggaggaggaggaggaagagaacaacacaggctctgttgtcgggtgcatggttataagagattcagagatcaaatgatccctgttcatgccacggtgtcctttcagttccaagagaaccaactggaacccagagaacaaaagagtcagggttggtggggggcaggcaggcctgggtccaggggcagccacatgtgccctatgtgcaggctcctggaattacrgagtctttttttatctttttgagacagattttccctcttattgccgaggctggaatgcaatgatgcgatctcggctcactgcaacctccgcctcccgagttcaagcgattcttctgtctcaccctcccaagtagctgggattaccggcgcacaccaccacgcccagctaatttttgtgtttttagtagagacaggtttcatcatattggtcaggctggtctcgaactcctgacctcaggtgatcagcccacgttggcctcccaaagtgctgggataacagtcatgagtcactgtgcccggcctggaattacagagtcttgaacacttcctgcatgccaggcctttatttcttgacagctaccgggcaggtgggttctgtggtctcccagtgagaagcccgtggcatgtgcaccaggatcagcagcaagttcatggagaaaccaggccctcctagctccttccctgaggaagaggcaggaggtagccctctgccaacccacgctctcccacctcagaagtgcaggtttctgattggctcatcttcttcgcctccctggggagcttcctgagcatccttctcgtgggcgtccttggctaccttggcctgaacaggtaactgacacctcttaccgttaccatagcgatggtaatgatgctgggcaggggagccctaaagtggagcttagcccgcagattgggtccttggctttgcccaggaaataattcaagggcaagccagaggtagaagaaaacagctttattgaagcagcagttatagctccgtgactgcctctgcagagcagggcttccctgtaggcggagagtagccgctgagagcggttttgcagtcagatttatacttacttttaattgcatgcagattaaggggggcagtttatgcaaaatttctttcttttttttttcttttttgagatggagtcttactctgttacccaggctagagtgcagtggcacgatcttggcttattgcaacctccccctcccgggttcaagccattctcctgtctcagcctcccaagtagctgggactacaggtgcgtgccatcacacccagctatttattttgtattttcagtagagatagggtttcaccatgttggccaggctggtcttgaactcctgacctcaggtgatcctatgcagaaatttctagggaagggatagtaacttttgggtccttggtcattcccatggaaaggggcggtgacactggtgggcatgtctgattgaaagctgctttcaagccgggcacggtggctcactcctgtaatcccagcactttgggaggctgaggcaggcagatcgctttaggccaggagttggacaccagcctggccaacatggcgaaacctctctctaccaaaactacaaaaattagccgggtgtggtggcacacgtttgtaatctcagctactcaggaggctgagtcaggagaatcgattgaacccaggaggcagaggttgcagtgagccgagatcgcgccactgcactccagcctgggcaacagagcaagactccgtctccaaaaaaaaaaaaaaacctcagctcctctcactggtcccctttcctccccagggccgcacggcacctgtgcccgccgctgcccacaccctgtgccagctccgccattgagttccctggagggaaggaggtaaggatgccttttctaattccaagtctttttattgggtgcacaygctggacaagggttacgcattagctcattttattctctcccaattcatcaaggtaaggactccaaaaccagtgctccataccccttcccattttaaagacaggcaggcagaggtccatttcctggcactagaaacagaattcaaagtggctttattataaaggaaacctgatggaaaaaatcccaagggaatgggcttcagatatgcctgaatccagcgattggggtctatctcggagctgcccgttcagggttcttccgcaggcaggctgagccttctctgattggaagcagggtgtccattttccccattaactggggcaaaagtctcagggccatcactgattggtccagcttgggtcacatgcccttccctgagcctatggctagaaccagaggggtagggaagggtctgatgggtgggctggccagggtcacatgaccattgctagagctgaggtggggtcactgcactgtcaaccacaccatctgtgaaaagagggagggaaatttcccaaagacagatgggagtgytcttcctaagaggggctgaatgggagtcagtgcggcagactccatcctcaaatcggtctcaggatatatggagtctcgctctgtcacccagcctggagtgcagtggcgccatctcggctcactgcaacctctgattcccgggttcaaacgattctcctgcttcagcctcccaagtagctgggattacaggcgtgcgcaaccaagctcagctaatttttgtatttttagtagagatggggtttggccatgttctccaggctggtctcaaactgctgacctcaagtgatccacccgcctcagcctcccaaagtgctgggatgacaggtgtgagccactgcacccgtccaggtctcaggatgttagagaatttaaccagcagtgacctggtccrttccatcctgctgtggatgggaagtagagctctgctcacagctgtggccctaccctccctctgcagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaaggtcctggggcccagtgggccagacggtcaggggtgcaaccctgccckgggggtgggggggctagacatccatcgctcctgggatatcagggcctggaggcctgagggagaaacgaaaacatccactttgtcttacagacacgaagagcgactatctcaatcacaacggctggttattaagcacttatggcatacccagcccattccatccactcacatgattccctaccaaatccctacaaccaccccctgaaaggaaccatgactgttgtactttacagatgtgatcgttgaggctcagagagggtgagtgactcgccygaggctacgtagcacacacaggagtcacatttggacccaaataacccagagctcctccaggctccagtgcacctgcctcctytytgccccgtgcctgttgccacccatcctgcgggggaaccctagatgctgccatgaaatggaagctgctgcaccctgctgggcctggcatccgtggggcaggagcagaccctgccatttacctgttytggcgtagaatggactgggaatgggggcaaggggggctcagatggatccctggaccctgggctgggcatccacccccaggagcactggatggggagtytggactcaagggctccctgcagcattgcggggtcttgtagcttggaggatccaggcatatagggaagggggctgtaaacwttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcattcattcattcattcattcattccacatatatttattaatctcttcctctaggtctcctccaggagcacctaatccgggggagacagagccggatgagagcttggaaccctactaagttaggactgagcaggggaagggacggcctaggrggagtggagcagccgggcactccggtaacaggaaccgtggtttgcccccacgctccttcctcctcacgcccaccaactcgcagcaggacccttgccccccttacacaccctgaatcctccctctttctgcccacactgccccacctccctcgcgttctgcagccgcctccccctgatccccactgcggtctgagccgaggtgtgggggggsgctcctgaaatcccaccccagccctggcgattagcgggtagtccagattctccccatggccaccaggtggcaacagcggcgcgcgtttccccggccgggcccgccctgcctcctcccaccgcgtttgctmaacagacttttccggtttcagacagaggaggggagttaaaaagcccagaactactgaattttgtggcaaaaaaaggatgagacctctcggggagagacccctggcagccaatagggccaggaggcaagaggcccaggccccgcccctttggtctgggggcctccctttccccatcgatgcatctagatagggaaacagaggcctggatctcggtgccccagccacacggtggctggtcagagttctgcaaatgccccccgccccgctccggatctgccacatcccagcttctgctcaagccgttccctccaccaggcatgccctcccttgagcgtttatcctcctttcttttttctgagacggagtttggctcttgttgctggagtgcaatggcgcgatcttggctcacggcaacctcccgggttcaagcgattctccygcctcagyctcccaagtagctgggattacaggcgcccgccaccctgaccagctaaaatgtgtttgtatttttagtagaaacagggtttcaccatgttggccaggctcgtcttgaactccagacctcaagtgatccacccgcctcggcctcccaaactgctgggattgcaggtgtgagccctggaggcccctggagttggcygcaaacccacccctatgcacagtcccttgggtgcgagaagtaggagacaggcaatgtttactggcagcagctgggacttttgccagagtgcatggggaagatgcacaccctgcttccactagcgggagactgagctggacagagggaagcctggagcttggagcctctttccttcctaccgtggggatgcctgtctgagagaggagcctgcagggaggacagcagcaccgagatgaagcattagttcctggatccagccatacctgaaacccaatattttccatctggttcctstttttaaaaaatattttaggccgggcatggtggctcacgcctgtaatcccagcactttgggaggcagaggcgggctgatcacctgaggtcaggagtttgagacaagcccggccaacatggtgaaaccccgtctctactaaaaatacaaaaattagctgggcgtggtggcaagcgcctataatcccagctacttggkaggctgaggcgggagaatcgcttgaacctggaagggggtggttgcagtgagccgagattgtgccactacactccagcctgggcgacagagcgagactccgtctcaaaaaataaataaataaataaataaataaataaatattttttwttatttwttgtttcttttttgagacagggtctcactctgttgcccaggctggagtgcagtagcaccatcttggctcactgcaacctccacttcctaggatcgagtgatcctccagcctcagcctcaggctcaagccttgttgccaaggttttgccatgttgcccaggctggtctcgaactgctgagctcaaatgatccacctgmcttggcctcccaaagtgctgggattacaggcatgagccactgcacccggcctcagttccctgtttgatgaagccactttgagtccttcttctgtccctagaaaatgaccaacaggaggttctttctgggcctctgcttayccgtctataaaataggaagggrtttggagtccttttctcaatgggcccagcaagtttgcttagctgggccctggcctggtatttattgagcaactgctatgcaactattactccagggctcctcagagcagccattgcctcagcttctcccagcagctccaggagtcaggatggtgttagyccccatttcacagctcagtttcattcattcatttaagaaatcagggtcyggcgyggtggctcacacctgtaatcccagcactttgggaggccaaggcgggccgatcgcttgagctcaggagytcgaggccagcctggccaacatggtgaaaccccgtctctactaaaaatacaaaaattagccaggtttggtggcacatgcctgtagtytcagctacttgggaggctgagggctgaggtgggagaatcacctgarcctggggaggtcaaggttgcagtgagctgagatcgcgccactgcactccagcctgggtgacaaggtgagaccctgtctcaaaaaaaaaaaaaaaaaagccagcattgagtgcctactgtataccaggccccatcttgcacaagtcaggatcttcctggtcataaggggctcttagctgggtggggaaggcagacactaatctaattatcactcagagagttatgagaaaccgtaagagtgatgagtggggatrtgaggagtagccagtgagrgagggcttcctggaggrggcaatgctaggaccaaggtggtaaagaggggccagaagagggagtgcaaaggccctgaggttgctggtggrgaatggacgggggatgggggaagaggttgtagcccacgtgaggctgggggcatrtggaccagagctgttttttttcttttgagatggggtctcgttctgtcgcccaggctggagtgcagtggcgtgaccacagcgcactgcagsctcgacctctcrggctcaactgttcctccttcctcagcctcctgtgcagctagaaccacaggcacgtgccaccacgctcagcttagtttatytgattatttgtagagacagagtctcaccatattgcctgggctgatctcaaactcctaggctcaagtgatcctcctgtcttggcctctcaatgtgctgggattacaggcgtgagccactgtacccgtgggctaggtttttttttttttttgagatggagtctcgctctgttgcccaggctggagtgcagtggcgcgatctaggctcacygcaagctctgccttccgggttcacgccattctcctgcctcagcctcccgagtagctaggactacaggcgcycgccaccatgcccggctaatctttttctgtttttagtagagacggtgtttcaccatgttggccaggatggtctcgatctcctgacctcgtgatcygcctgccycgkcctcccaaagtgctgggattayaggcgtgagccaccgcgccyggcgggctagggttttattcttgggttgtggggtcctggagctggagagtcaggtcctgacgggtgagaggttcagagtttattctggctgcagttcagctgggagttttctggctgcagttcagctgggagtaagtgattcatcttgtgggcctcagttttctggtccataaaatggatgtggtcaggcagcctctccagagcccctgcccctcttcccacctcccctcctctgtctctgtctttcctgatccatcttttcccttctccatggctcccacctactgggtgggaagcgtgtctccatcagagagataggctgcctcagtttaccttcccaggtaccttccttctctatctctccagtagcctctgggtttggtcagaaacagatgttgtctctgcctctgcccttcagccgggatgggactgaggtgtcaggtttctgggaaccatgagctgcaggagatgacccctggactcagggtagcccctggcctggcccctgatactttattatctgtgccccagatgccaggccctctgcccaggaaggcccttcttccaactctgccctctgcccatttctctctctctcttttttaactcatttctttcatttaaaaaaaaaatttaaagtagaaacagagtcttgctatgttgtccagaccaatcttgaactcctgggctcaagcaatcctcctgtctcagcctcccaaactgttgagattataggcacgagccactgagccccagccttattcctctttttttttttttttttagatggaatctcactctgtcgcccaggaggctggagtgcagtggcgtgatctyggctcactgcaaccccacctcctgggttcaagcaattcttctgcctcagcctctggagtagctgggactgcaggcaccyaccaccaagcatgcatggctaatttttgtatttttgctagggacggagtttcaccatgttggccaggctggtctcaaactcctgacctcaggcgatctgcccaccttggcctcccaaagtgatgggattacaggcgtgagtcactgcgcccggccattcctccttttttaagatacattcacacaccatacrattcaccctcttaaagtgtacagttgacactgagcgtggtggctcatgcctgcaatcccagcattttgagaagccgaggcaggaggatcacttgagcccaagaggttgaggctgcagtgaaccgtaattgcaccactgcactccagcctgagtgacagagtgagaccctgtctcaaaaaaaaaaaaaaaaaaagtayaattcagtggtttttgtacaatcacaaggttgtgcagccatcactcatacctaattstagaacattttcatctccccaaaaagaaaaccttgtgccatcagtagccactccccgttcccctcccccagcccctggcagccactaatctgcttcctgtctctatggatttgcctgttctgggcatttcatatcaatgaaatcatacaatatgtggcctttctgtctgttcttttgtgaaagaaactcagatgtttttgaaacgcatcctcattatagtgtgtgtcagggtttcgttcyttttgatggctgartagcattccattgtgtggatgtgtcactatttatttatccactcagccatcaatggacatttcggtggtttccattttctggctattgtggatagcgcagctctgagagtttgtgtacaagttttggcgtaaacacctgttttcagttttctccgtatacatctaggagtggaatcacagagtcatatggtaattctgtgtttaacttctggaagatctgccaaagttttccacgtcagctgtaccatttcacattccctccagcaaggcatgggggttcaaatttctccacatcctcatcaacacttgctattttcctttttcttttctttttttttttttttttttgagacaggatctcactctgtcacccaggctgcagtgcagtggcgtgatctcggatcactgcaacctctgcctcccrggttcaagcgatcatcctygtgcttcagcttcccaagtagctgggattacaggctcttgccaccatgcccggctaatttttgtatgtttactagagacagagtttcaccatgttggccaggctgttctggaactcctgagctcaagtaaccctcccacctcagcctcccaaagtgttgagattacagacgtgagccactgcgcctggcctcctttttcttcttatccttctccttctcctcctcctccttcttcttctttttgatgttctgatgccaaggctggagtacagtggcgttatcttggctcaccacaatctctgtctcccagattcaagcgattctcctgcctcagcctcccaagtagctgggattacaggcgttagcc

SEQ ID NO: 13339 - DNA, 26471 bp, Homo sapiens
gtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggcyggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagygctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgaccccygccctagaacttttgccagtgccttttytgaaactcctgtgtcccgggccccccaggcggagaaggatatgccggattctgcctggggctgggctytaggagaccccaaatttgacaccacagaaagcaaataaaacacttgaaatacgcawacatttcctgtgtgtccttttgtggggctggagttcagctgggtgcccggggatagaggggaccccgtgtcactgggtttctattctcggtggtgctgggcccagggcagctggtgaccatgtgctgagtgagcgagaggaggggaattctgcctccagtggtctccttcctcaaaatcagaggcctggcccagcgcagtggctcacacccggaatcccagcactttgggaggccgaggtgggtgaatcacctcaggtcaggagttccagaccagcctggccaacatggcgaaaccccgtctctactaaaaatacaaaaattagccaggtgtggtggcacgtgcctgtaatcccagctactcaggaggctgaggcaggagaatcgcttgaacccgggaggcggaggtcacagtgagccaagatcgcaccactgcactccagcctgggcaacagtgtgagactcagtcycaaaaaacaacaacaaaacccgcggacctttgttccaacacacagggaggttgaggaacttgcctgtggtaacacaggcactggggtttgagcgatgatctgcrtcaacctccagggcatacaaaatccccatcatggctgggcacggaggctcacgcctgtaatcccagcactttgggaggctgaggccggtggatcacctgaggtcaggagttcaagaccaggctgaccaatatggtgaaaccctgtctccactaaaaatacaaaaattaggccaggcgcagtggctcacacctgtaatcccagcactttgggaggccgaggcgggcggatcacaaggtcaggagatcaagaccatcctggctaacacggtgaaacctcgtctctactaaaaaatacaaaaaattagccgggcacggtggcaggcacctgtaatcccagctacttgggaggctgaggcaggagaatggcgtgaacccaggaggcagagtttgcagtgaaccgagatcgcgccactgcactctggcctgggcaaaagagcgagactccacctcaaaaaaaaaaaaaaatacaaaaggtagctgggtgtggtggcrggcacctgtaatcccagctacttgggaggctgaggcagcagaatcacttgaacccggcgggtggaggtttccgtgagctgagatcacgccactgcactccagcctgggcgacagagcaaacaagactccacttcaaaaaaaacaaaaaatccccatcattctgacaggggatgccatgccattgccacctttacagacagggaaactgagtttccaccagttgaagccccttgtcccctatgtcacggccagggagagtaggggtgggaatgtgaacccaggcgggcttctctggagcggagggccttgaagaacacaaatggacatgttcattccctacgcctgtcctcagcaggaatgaagacaccctggtctctggctctctgagaataaacttttgacaccaaagggacttggacaacagttaggaagatgtcctggagcaagtggaccccgtgggttgggggaacttcttggastcacagaggactgagggttcttgcacccccagtggaggtattcatatctgggtggtctttcccatagggtcgactcttattattgttatttaatgtagagacagggtcttgccatattgcccaggctggtctcaaactcctgggcttaagttctctacctgcctcggcctcccaaagctctggaattccaggcatgagccaccatacccgtccctttgctgtcttgagccttagtttacccatttctcgtggggcttttgtggcaattcaatgagattctgcttttacagcccttaacttggagcctggtgccctgtcattgctcagtaaatacaatgatcagggtgtgggctctcgcttataatcccagcactttgggaggccaaggcgggtggatcacttgaggtcaggagttcgagaccagcctgggcaacatggtgagaccccccccccccatctctacaaaaaatacaaaaattagacaggtgcagtggcgcacacctgtagtcccagctactcaagaggctgaggtgggaggatcacctgagcctggggaggtcaaggctgcagtgagtggtgatcgtgccactgcactccagcctgagtgacagagtgagaccccatctcaaaaacaaaaacccggtcgggtgcggtggctcatgcctgtaatcccagcactttgggaggcaaaggcagatggatcatttgaggtcaggagtttgagaccagcctggccaacatggagaaaccccatgtctactaaaaatccaaaaattagccagccatggtggtaaacacctgtaatcccagctactcgggaggctgaggcaggagagtcgcttgaaccagggaggctgaggttgcagtgaactgagatcgcgccactgcactccagtctgggtgatagaatgagactccrtctcaaaaaaaaaaaaaccccacaaaataaatacagttaccatcacctcctcttccaggaagccctcctggctacctaggcatctcctctgactcctacagctgcctgggtgtccccattgtagcactctgggtggtaattgacagcctctgtgagagggtggatgggtatgtgtggggccccctctgtgtcttctgtgcccagcacagtgccagggacacagtagggaagcaataaactgctgrgaggagagstgagtgctgtgggtccactcctgaggccagccaggggctcagcaaggcaccaatgcctcctcccaggagtgaaagatgctggaatcaccaggctcctcctgcagtctggggtccccacctaaggaggcccctcaccccgtggctgtcccagtcattcaggaagtgtccactgtgggctgagccctggactggggacacagcaaggatcaggcagctgggagtacagcctggaggwccccccttgggatgagggctgcacaggcagttaaagggtccaaggatcatcccaggatatggctgagaggctgcaagaggctccatcccctagaggccccctccgccctcgcctgggtgctcccagccttactcaaaggagcaggtcggcccggtgcgttgtctcacacctgcaatcccagtgctttgggaggccgaggcaggcggatcacttgagcacaggagttccagaccagcctgggcaacatagcaagattctatctctacaaaagtaaaaataaatcttataaagtagctgtggactgggcacagtggctcacacctgtaatcccagcactttgggagaccaaggtgggcagatcacctgargtcaggagtttgagaccagcytggccaacaaggtgaaaccccatctctactaaaaatacaaaaattagccaggcatggtggtacacatctgtaatsccagctactcaggaggctgaggcaggagaatcccttgaaactgggaagcagaagttgcagtgagctgagatcgtgccactgtactccagcctgggtgacagagtgagaccctgtatctaaaaaaataaaataaaaatgaaaagatgaggatcttggcctccattcttgcccttccactccattccaactgctgagcctctcacaccctctgtggctccctttcgcctacaggaaataggatttctgtactgggcatttgaaccccattcccttgtttctgctgacccccagcagtctcaatatcccctacttcctcttcccagaaccaccctccccaaagcccttatcgatgcttggaggattcctatgcatccctcaaaatccaaggtttgggaaagatgctgcagtggtctcaagacatcctcagtgtgatgacagcctggggtgggggtaagggggcaaagtacagcaccagaaatcccaactgagtccccccacacgtcttccaccttcccaccctctctttcgggttctggctccctgcctccaggcaatcaccagtttttaccaggagtgcctcagacctgcccggacatgtccaagtcccctagaagcagggaggggtgggtgaggctgtcacctctcccttccctgtatggtgctgataagggcgtggggaggcagagacaggcagagatagacatgatgagagacaggcagaaatggagggagagccagggagagakagacacaaagagaaaaagtggaaattctccagatattttgtttagggtgaggacacggagacacagagagggacttagccagctgaggatgacgatttgggatgttaggtcacccaggtgctgtgctgtgtaactcaggcacagagctgccctgttccgagcctcagtttacccctgtgactcagagcagatctccatacccccatcacagggctgtgtatccgagctcagccagagcctggcatgcagtaggtgcttcataaatacacactgtggacagtagaattatgatgggagcgagcgtgtgaactgggttgctaatgtggagcgtgaagrgggaggcccagggttactcggccaatgggttccgggcagcaagcacgtgggggaagcctcagctgaccacttcctggccagtttatgcaggaactcgcacagccggtccctgaggctgagcccaccacttccgccccccatggtcccagccctgctgactcatactcagctgccacggtccgctttccctgctgagcacgggggtgggggcgggggggaagagggggagggaagggcacctgaccgaggccagaggcccagaaaggacagaaggtcatggctggggagaagcaggcaggagaaccgagtcttggccttaactggctggcaacgtaaaacctgccctccacaaggacaagatgaaaacttggggatttggaggggacaacaaattagactcaatcacaatttcaaacttttggatgtcaatatatccatcaagaaattgaaaagaggcctggcatggtggccgatgcctgtcatcccagcactttgggagaccaacgtcggaggatcacttgaggtcaggagttccagaccagcctgggcaacgtggtgagacccsgtctctacaaaaaaatttaaaaattagctggacaggggccaggcgcagtggcttacgcctgcaatcccatcactttgggaggccgaggcctggatgacagtgagagactctgtctaaaaaaaaaaggacaggtgcggtgsttcgcgcctgtaatcccaacactttgggaggccaaggcagatggatcacctgaggtcaggagttcgaaaccagcctggccaacatggtgaaaccccatctctactaaaaatacaaaaattagccaggtgtggtggcgcatgcctgtcrtcccagctacttgggaggctgaggcaggagaatcacttgaacccgggaggcagaggttgcagtgagccgagatcgtgccattgcactccaggctaggtgacagacagaaaatcttgtctcaaaaaaaaaaaaaaaaaaaaacccaccagagataaaaatgggcagcagatgacattgtttacataatactgaccacaaacttgatgtcctaaaagaacagggacttctctcagagttctggaagccagaagtccgaaatcaaggtgtcacagcaggactggttccttctggaggctgtcaggactcagaatgtgatactccaaagtatggctccttggcaaaaactttgtggtttttgtttttagagacagggtcttgctctgycacccaggctggggtgcagtggtacaaygatagctcactgcagcctctacctcctgggctcaagcaatcctcccacctcagcctcccaagtagctgggactacaggcatgcgccaccacacctggctaattacttttatttttgtagagatgaggtctcgccgtgttgcccaggctggtgtcaaacttcttcttcttcattttttgtttttgagatggaatctcgctctgttgcccaggctggagtgcaatggtgtgatcttggctcacagcaacttccgccttctgggttcaagtgattctcctgcctcagcctcccgagtagctggaattacaggcatgtaccaccgtgcctggctaattttgtgtttttagtagagacggggtttctccatgttggtcaggctggtcttgagctcctgacctcaggggatccacctgcctcagcctcccaaagtgctaggattacaggcgtgagccaccgcgcccagcsaagacagttattttaaagtatttgtctagtgagtctgatgtgtgggcttccttagggatggtttctgtctgttaattttgttccttaaaatgcgccacactttgctgtttctctgtatgcctagtgatgtttttgttgttgaaaagcgagcatttgaatattctaaattatggtaactccagaaatcagattctccaccttcctgagagttttgtgatttttgtttctgtttttaattatggaaggcagtagccatctctttgtttagatagttttccaaaccgcttttttttttttttttgcaaagactgtattccggccgggcccggtggctcacgcctgtaatcccagcactttgggagtccgaggcaggtggatcacgaggtccggagatcgagaccatcctggctaaaacggcaaaacccccctctctactaaaaatacaaaaaattaggtgggcatggtggcgggcacctgtagtcccagctactcgggaggctgaggcaggagaatggcgtgaacccgggaggcggagcttgcagtgagctgagatygtgccacggcactccagcctgggcgacagagcgagaccctgtctcaaaaaaaaaataaaataaataaaataaataaataaataaataaacctgttccccaaatatatatatgaaattaaaacatgcgtggtcatgatcaagttctaattacagacaaagacttccwtgagattrgggagaacctgccttggactacggggaccacttcaactctcttgggaatgatttttctttaggtgggtgctggataggggtgtttgtgattttattattaatacttttgtgtgtgcctgaaagatttcacaatgacaaataaaactgagaggaaaaggtttggcagttccccattaagttcaatacagggttactctgtgacccagtaattccactcctcagtagagagccaagtgaaatgaaaacaggtgttcaaacaaaaacgtgtacacccacttttacagcagcattcttcatcaaggcgaaactacagtacaaatattgtaagattccatttctgtgaaatgttccgaataggtaaatctataaaggcagaaattaggccaggtgcagaggctcatgcctgtaatcccagcactttgggaagccgaggtgacaggatcgctggaggttaggatttgaagaccagcctgggcaacatagcgagatcccatctttacaaatttttttaaaaattagcaaggcactggctgggtgaagtggctcacgcctgtaatcccagcactttgggaggccgaggcgggtggatcacctgaggtccggagttcgagatcagcctgggcaacacggtgaaacccccgtctctactaaaaattcaaaaattagctgggcatggtggtgcatgcctgtaatcccagctactcgggaggctaaggcaggagaatcgtttgaacccaggaggtggagaytgcagtgagtcgagatggcgccattgcactccagcctgggcaacaagagtaaatctccatctcacaaaaaaaaaaaaaaaaaaaaagcaaggcacagtggcatcaggctggggtgggaagatcacttgagcccagccattcgagaccaacctgtgcaacacaggaaaaccccattctacaaaatagtaaaaaattatcagggcatggtggcacatgcctatagtcccagctactcgggagagtgatgggggaggatcacttgagcccaggaggtcgaggctgcggtgacctatgattgtgccactgcactccagcctgggctacacagccagaccctgtctaaaaagaaacaaaacaggcaggacgcggtggctcacacctgtaatcccagcactttgggaggccgaggtgggcggatcacctgacatcaggagttcgagaccagcctgtccaacatcgtgaaatccccctctctactaaaatacaaacattagccgggcatggtagtgggtgcctgtaatcctacctactcgggaggctgaggcaggaaaattgcttgaacctgggagatggaggttgcaatgagccgagatcgcgccactgcacgacagcctaggygacagagcaagactccatctcaaaaaaaaaagaaaaagaaaaaaagaagaaactctcattgatggagtgttcattgatggagcactttttgggagtgggttgacatgctcacaggtgtttttaacctcacctcgtctctgaagaggtgcagataaaagtcacctggtgaggaaaatgcctttttaaaaacaatttttagagggccagcacggtgactcacgactgtaatctgagcaatttgggaggccgaggtgggcggatcacttgaggtcaggagttcaaaaccagtctggccaacatggtgaaatcctgtctctactaaaaatacaaaaattagttgggcatggtggcacatgcctgtaatcccagctactcgggaagctgaggcaggagaatcactttaacccaggaggtggaagttgcagtgagccaagatcgcgccagtgcactccagcctgggcaacagagcgagactctgtctcaaaagaaaaaaaaaagagatggggtcttggggtctcactgtgttgcccaggctggtctccaactcctggcctcaagcaatcctcctgctttggcctcccaaagtgctaggattacatgcctgagccactgtgttcagccagggtgtcccttttctgagactgcattcttyccaccttgcccaagtattgcaggagaaccacaggccccatgctgtgctggcgaaaatctcatctcatgctggcctgttagggtggccatatcctctcatttcagaggctctgagggagatggaacaggctcagcggctggctgcttggggctctaaccccagccctgctgtcttctggctgtgtggccgtgacgagcccacctctctggcctcagtttgtcatctgtgaaatggacataatctatccaccacatcaggctgtataaagattaggccaggtgtggtgcctcacacctgtaatcccagcgctttgggaggctgaggcaggcagatcacctaaggtcaggagttcgagaccaacctggccaaaatggtgaaaccctgtctctaataaaaatacaaaaattagctgggcatggtggcatgtacctgtaatcccagctacccaggaggctgaggcaggagaatcgctggaacccgggaggcagaggctgcagtgagccaagattgcaccactgcactccagcctgagtgacagagcgaaactccrtctcagagaaaaaaaaaaaaaaaaaagatatgtccaagtcctaacgctcagtatctgtgaccttatttggaaagaaggtctttgcaaatgtaattaaactaaagatcttgtactgagatcattctgaattaagaatggaccygtggctgggcacagtggctcacacctgtaatcccagcactctgggaggctgaggtgggcagatcacctgagatcaggagttcaaaaccagcctggccaacatggcgaaaccccgtctctactaaaaatacaaaaaaaaattagctgggcgttgtggtgcacacctgtaattccagctactcgggaggctgaggcaggagaatcacttgaacctgggaggctgcagtgagccgagattgcgccactgcattccagcctaggcaacaagagtgaaactctgtctcgaaaataaaaacataaaaagagtggacccatggccaggcacagtggctcatgcctataatcccaacactttgggaggccaagatggaaggatcgtttgaactcagccgtttgagaccagcctgggcaacatagtgagacccctgtgtctaaatacaaacacaaacagaaaacaaaaagaacccgggctggctgcggaaccccctagatggcacaggcacatcctggctttcgaggacagtcacgagcatgagacagcatttcttcttgtcctcggggcctgcaggaagtttttaagtaatctgcttttgtgcctcttccaaatctcctcctatgaccctgtttaccttacatcacaagaaacaatcaataaaagtggtttgtgttcgtgagtgccgtgtgtttgacaaaggcgttgataactgagagctggtagtggaggggggagattttgggagattggggccctgccaggtggacggactggcctgacctccrgcccctgygctctgtttacttccatcccagctccacctctggggacccatggaagctgtcggtgaggaacacaggatccgacctgctgagctcatctctggccacctgcctgcatccgccccatctctcctctcagcttggccatgaggcgggctatgaggtcattggttaaagatttggggaagcagagccaggcgagtggccagatgtggtggctcatgccatcacaggatcccagcactgtgagaggacaaggaaggaggatgcttgagctcaggagttcgagaccagcctgtacaacatagcaagacccccgtctctacaaaatataaaattagccagttgtggtggcacgcgcctctagtcccagctactcgggaggttgaggtgacaggatcccttgagcccaggaggtcgaggctgcagtgagtgggtaacagagccaaaccctgtctctaaaacaaacaaaaacagaaacaaaaagtacactacttactgtcctgcttctcaccattccagcctggtagtccttttttttttttttgagacagggtcttgctcagttgctcaggctggagtgcagaagcgtaatcacagctcactgcagccttgatctccaaaaagactaccagcttggctgggtgtggggactcatgcctataaccccagcattttgggagccagaggcaagaggattccttgagccaaggagttcgagaccagcctgggcaacacagtgagaccctatctctaaaattttttttttttgagatggaatttagctctcgttgcccaggctagagtgcaatggtgcaatctcagctcaccacaatctccacctcccaggttcaagcaaaattctcctgcctcagcctcccgagtagctgggattacaggcatgcgccaccatgcccggctaattttgtatttttagaagagacggggtttctccatgttggtcaggctggtctcaaactcccaacctcaggtgatctgcctgccttggcctccctatctcctcattgggggccataggattaaatagcttttttctttttttatgagacggagtttctctgtgtcccacaggttggaggcagtggcacaatcacggctcacggcaacctccgcctcctgcctcagcctactgagtagctgggattacagtcatgcgccaccacatctggccatcttgtgtgtttgagtaatctcggtatatatccattttgtctatgaagctcgttaatttgggccccaaagcacccgctggcaatggcctttaagtgcgaaaatcctggcattaggcgtcccccaccttttttttttttttttgttgggacggatgtaggtgtgtcgcccaggctggagtgcagtggcgcaatctcggctcactgcaagctccgccttccgggttcacgcctttctcccacctcagcctcccgagtagctgagactacaggcacccaccaccatgcctggctaatttttttgtatttttagtagagagggggtttcaccgtgttagccaggatggtcttgatctcctgacctcgtgatccgcctgacctcggccttccaaagtgctgggattacaggcacgagccaccgcgcccagcctggtgtccttatttcttgggaaaggatacagagggtcagagaggcgccccagcttgtgcaggaatgcattcctgagatctggcctggccgtggtcactggagtgtttactctgcttacagggtctggtgtagtgggggatggctgggtaggaacgtgcgggctataaagccagaccccaggtgtcagtgcggttcagaaagcaactagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacaggtgagctctgagacctccacccccaggacagcccccaygtctattttctttttctttaaagatgttcttatttgggggccaggcgtggtggctcatgcctgtaatcccagcactttgggaggccgaggcaggcggatcacctgagatcaggagttcgagaccagactggccaacatgacagggtgagaccccatctttacaacaaatacaaaaattacccaggcatggtggcacacgcctgtaatcccagctactagggaggatgaagcaggagaattgcttgaacccgggaggcggagattgtagtgagttgagatcgcacaactgcactccagcctgggcaacagagcgagactccaatccaaaaaaaagaaaaaaatcccctaggacagggctgtggctgagaccctgagggctggaggcttggctggccttgcacagcagcgggtgcatgctggggtggggagaggcctggagaccctgtgactccactgggggccttgctgtgtgaccccctagtgagtccttgtgtctcttacccacgcatgcctgtcacatgcagacacccacacacacccastatctgccggacagrgcagcccttcctctccgcagccaggaagctggacataggcacaagggctgacgcctggggccaggaatccygcctgagcattaggagaaggtctggaaccccagggggaagggcactcctggggcatcccctgcccctctaccatctggtggctggactctacaccagcctgccctgctctaaaaccccagctcctcaattctgtgccacctcctctctgggcccagacaagagcagattcatccctgccccaaaggaaccaccagtcttgggtcagcagagctgggcacagacacttccagtgccgtggggctgtaactgtgataggtctgttgctccatgcacttggcaagtcaacagctgagaaaacaggttgcaacatggaaagagttttaatccgaccggcgtggtggctcatgcctgtaatcccagcactttgggaggctgaggcgggtggatcatctgaggccagcagttcaagatcagcctggccaaccaggtgaaacctcatctctactaaaaatacaaaaattagccaggcgtgatggtgcgcacctgtaatcccagctacttgggaggctgaggcaggagaatcaattgaacctgggaggcggaggttgcagtgagccaagatcataccactgcactccagcctgggcaacagagcgagagactgtctcggaagaaaaaaaaaaaaaaaaaggctgggggcagtggctcatgcctgtaatccccacactttagaggcagaggccgacggatgacttgaggtcaagagttcgagacctgcctggccaacatggtgaatcacygtctctactaaaaacacaaaaattagccaggtgtggtggcgcatgactgtaatcccagctactcagtaggctgaggcaggaggcggaggttgcagtgagccgagattgtgccactgcactccaacctgggggacagagagaaactccgtctcaaaaaaaaaaaaaaaaagagatttaatcctagggccacccaatgaggagataggagggaacctcaaatccatttccaggaggaggagtttggggccatataaatgtatatatacaaatatatatatwttttttaagatggagtcagccggccgtggtggctcacgcctctaatcccaatactttgggaggccgaggccggcggatcacaaggtcaggagattgagaccatcctagctaacacggtgaaaccccatctctactaaaaatacaaaaaaaaattagccaggcgtggtggggggtgctcatagtcccagctactcaggaggctgaggcaggagaatagcatgaacctgggagctggagcttgcaggttggagtgcaatggcatgatctcagctcactgcacctccgcctcctgggttcaagcgattctcctgcctcaggctcccgagcagctgggattacaggcatgtgccaccacgaccggttaatttctgaaattttttagtagagacagggtttcatcatgttggtcaggctggtctcgaactcctgacctcaggtgatccgcccgccttggcctcccaaagtgctgggattacaggcrtgagccactgcacctggccaggggctagagttttaatttttaaggattttggagtgggctgaagtgtggaggtcattgcttggtgaaagagtgcaggaggtgaagtcacagacagtaagaaactgtattctcatgcagattccgttcctctgtggggtcttcacactggtgggtgtcattggttaaggatttcaaaaacatcttaagaaattcttctaaaaagtcttatgattctaaggtcggaaatcacatctatagcaaatggtcggtatcaggtgctacaagcaacttgcggtcacaaggaagtgggtcaaagtgcagcctgattagtgcttaattataactaagtttctgtccagaattctttttttttgagacagagttttgctcttgttgatcaggcggaagtgcaatggtgaaaacttggctcactgcaacctccgccctctgggttcaagcgattctcttgcttcagcctctcgagtagctgggattacaggcatgtaatcccaccaccaagcccagctaattttgtatatttagtagagacagggtttctccatgttggtcagrctagtctagaactcttgacgtcagatgatccacgtgcctcggcctcccaaagtgctgggattacaggcgagagccaccgtgcccggcgcagaattcttttttttagagaygaggtattgccatcttgcccagacttgtctcgaactcctgggctcaaacaatccacccacctcggcctcccaaagtgctgagattactgacataagccaccatgcctggcccccagaattatgaatcctgtgaggatggcttcaaggtgagcgctgagccagacaaaaggatggggtttgggagcaccctgcttagactggaaagataatgttggagaagacttcctggaagaggggctttttgcgtagagttttgaagaatgagtaggagttctccagaggaggatgagtaactgcaataacacccagtttatcaagtgcctcctatgtgtctggccctgtgctttacccctcatttgaccacctctccagtgagagtctcagtccyttttttcctggtgaggaaacaggcatggcagagaggcatgacacatcaaggttgcccttcctggctccatctagccygttctcctctgcttcctttgtttttcaccatctttagcctttgaccccaaccaaaaagagaagagaggaaatcccatgggcatagacagccacctcttaaactcttgtctggaatttttcacatagtaacaatgtctttttttcctccaaaaagactcccaggctggaatggtgtcctcatatcgaggaagaggatactgaggcycagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacgstgaatggctctcagatgctcctggtgttgctggtgctctcgtggctgccgcatgggggcgccctgtctctggccgaggcgagccgcgcaagtttcccgggaccctcagagttrcacwccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgaggtctgggctgtggtgggacccaggagggggcaggcagaggggcacactcttagcccgccctaaacccatctgtgccgtrtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacacctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcrggaggagcacttgaatccaggagattgaggctgcactgagccatgagtgccccactgcactccagcctgggtaacagcaagaccataataaataaataaataagtgaagcaagtaagtttttgactgccagaagaaaagcagagccatggttggaatctcaggctgcctgaatatcagatatacattaattccttcaagtatttactaagcacctattgtgtgccaggcacagtgtcaaccaagctaagattctaagtagggaatatgaatgatacacaaggaaataaaatagggtgcttcctattttaggcaggctggaaggaagaggaggagccagccatackgagattcaggagattcaaggggagaaatgcccytttttttttttttttttttttttttgagagggagtcttcctctgttgcccaggctggagtgcagtggcacgatcttggctcactgcaacctccaccgccccgattcaagccattcttctgcctcagcctcccgagtagctgggatcacaggcgccagccaccatgcccagctaatttttggtakttttagtaraagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttccygaggggctccccgaggcctcccgccttcaccgggctctgttccggctgtccccgacggcgtcaaggtcgtgggacgtgacacgacckctgcggcgtcagctcagccttgcaagaccccaggcgcccgcgctgcacctgmgactgtcgccgccgccgtcgcagtcggaccaactgctggcagaatcttcgtccgcacggccccagctggagttgcacttgcggccgcaagccgccagggggcgccgcagagcgcgtgcgcgcaacggggacsactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttcsgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggrggasgcgacctcagttgtcctgccctgtggaatgsgctcaaggttcctgagacacccgattcctgcccaaacagctgyatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaaggctcaaggaatgagtggcaaggtgttctcggagatgccaagccattggaaggtgcttacgacacctgtgggctctaagggcagccttggccattcctgactccctgactctctgtctctatttctctatctccttattgctgtttcttttttctttttattttttttagacggggtctcactctgttgcccaggccgaagtgcagtggcacaatcacagctcactgcagcctcaaccacccgggctcaatcgatcctcccacctcagccacctgagtagctgggactacaagtgcatgccatcatgcccaactaacttttgtattttttgtagaggctgagtttcgccatgttgcccaggctggtgtttctgttttggaaacagctgagaccccatacctttttaagtctcagcttccctccatctttcctcattcctcaaaacttctctctttggggtctgaggcagaggatctgtctctgtctttgtctctatcaccatcctgttgctctccccacttgggagtcacctttccaaacacaggcagctcagagccaagtctatctgcaaccaagtgccttgttttgtggtactgtccccaacctgaggggttagtcccatcacccctcctgtttgtggcacttccatgttagtgacacctcattctttcacatataaagagtagggagaaacaaataagttgtgaagaatattttcatgcacaccacatctcccaggttatatatacttcctgtttaggatgttggaattttgaggtgtgctgagtccagccccctctccacaccaaactgcctgcccatcctgaatctctgagaggaatggcgatgggtgtcttgagggacagagtacccacttccagcagtgaggtgtatctgctgggaatgccatcacccacaggccaacctgaatgactgcaggttccccttaayrtattcagtgagtgcccactttatgccaggccccggacacagctgtaaaaagacacacaaggaccaccccmctttgcggagcctggttgagtgaaggggacaaatgagtaaatcctaagaaagtagttgattgcagtaagatttgtgctggggattcaacccatcagttcattagtgaacggaggcagaggtgatctagatagttggatggggaggcctccctggggagggaggtcacatttgagctgagacctggaggaagaaaaggagtcggggagggggtagttgagggtggacattgcaagtaaatgcaaacagcaagtgcaaaggccctgakatgggagcaggctcacttcagtcacagcaaagctgttgaaaatgggcacctaggaggcttcaaaattaaactcaataccaaaaggcagcagatggtgtcactgagtctttccccaaacaacagctgttgcctttgcaaggtatagggctgggcctgtgccttctctgtgcttctccaggctcttgcacaagttggtccacccagccagcatgccctttcctctccaattctcaaactcctatgcatccttcaaaacccactgcagattcccctcttacatgcagccttattcaaactcattcaattgtctccatgtggggactgtgctcccattcttccctttggcccaggcttgatctcccaggactgagggtacttgtctctagttctatctcccccaggttggaggattgggctgggaccagctgataggaaacccagttgaggcatgagcctgamaaaactcttgaaatacagacatctgtgagtcattaactctgcctgagaagaaaccagggacagcttctcaaaggaggtggcattgcaccagggtcttgaaagattttctcagaatattagagctaaaggaatatatacatttttttattttggggktggtgtgggctgctctggaggccaagcctggagatcagggacctgggaaggggccctgagaggggcagaagggaggaatgtgcctgggygcrgtggccacgcctgtaatcccagcacttcaggaggccgaggygggcagatcgcttgaggtcaggagttcgagaccagcctggccaacatggcgaaaccccatctctattataaatacaaaaattagctcggcatggtggcgggtgctgtaatcccagctactcaggaggctgaggcaggagaatcacttgaacccaggaggcggaggttgcagtgagctgagaccgcagcattgcactccagcctgggtgacagagtgasactcagtttcaaaaacaaacaaacaaacaacaacaacaaaaaaaaacagggatgggaggtggggagcaatttgggagtctcagatggagacttggtcttagaactcagaaatccccaccttgaggaacccacgcaccctgagccagcagcctcatcagcctcgaagcatttattgagcactgcctgtacatccacaggagggtgatgacaggattggcacagtgaccstcctgtccccttgttgggggtctctcctcttccccctctaggagctgagggagctgaggagcggcatgagggacagggagggggcggcagagcttcctggggcctcaaggacaatcctttcctgtmcccattcttcagatggggaaactgaggccatggaggmgttaggacgccctgagtcacccagcagggactgaaggggttctgggtggaggttaggacatcttaggctcagtgcccggggatcacgtactcctcttcatccattgrggcctggcccagtgactgcaggttayagtagacaggctgggaagccaggtcgatgtccttgtagttgatgtaaaagtcattgtcctctgaagggtgagccctggggggacagacagaccaggggtaagtgtgggasggggaggactcaggggacaggcacatgagctttgagaaagtccagagygggccaggtgctctgactcacgcctgtaatccagcactttgggaggctgaggtgggtggatcacctgagatcakgagttcaagaccagcctggacaacatgatgaaacctcgtctctactaaaaatacaaaaattatccaggcatggtggcacaggcctgtagtcccagctactcgggagtctgaggcaggagaatcacttgaacccaggaggtagaggttgtagtgagccgagatcgtgccattgcacttcagcctgggagacagagcaagactctatctcagaaggaaaaaaaaaaagaaagcttcagagtggctcagtccaccccgartatttacatatggggaaactggcacgggctagcgttctgactcctagccaaccccacctctctctgaggaggctgcgggagggcagtgatttagggaaggttctgtgggtgtaacgctgcggtctgaggaccctgaaccctttttccttccttaaaaatgagatagcggccaggcgcggtgactcatgcctgtaatcccagcactttgggaggccaaggcagaaggtctgcttgaggccaggagtttgagaccatcctgagcaacagggtgagaccccatctctacaaaaaattaaaaaattattcaggcgtggtgacgtgtgcctggagtcccatctcctcgggaggctgaggtgggaggaccgcttgagcccaggaggtcgagcctacagtgagccgttatcacaccactgcactgcagcctggatgacagagggagaccccgtctcaaaaaaaacagaaattgaggtagctgttcattattacattaaaatctaaatttttgtttcctcttgaaaaatcggaagctctggccacgtcagtcacatgcacacaagtggctgcacccacactctgtgctccttccgatgggaaatgttttcaccactgaagcaactgactttgtggccctcatatataaaagcaagtctctgagcctcagtttctgcatctatagaattggtcaaggagcaggtagctacttaggaatatttgttatggtcagcaagacctccagagaattttcctgcctcctgaacattctaattccaacccagctcctcttgtaaaaagggccactgggccaggtgcggtggctcacgcctataatcccagcactttgagaggccaaggtgggcagatcacctgaggtcaggagttcaagaccagcctggccaacatggcaaaaccccgtctctactaaaattagccgggtgtgatggtgggcgcctgtaatcccagctactcgggaggctgaggcaggaggcaggagaatcacttgaacccgggaggtgaaggttgcagtgagccgagatcatgccattgcactctagcctgggcgacagagcgggaaaaaaaaaaaggcaaaagggctactttgtgttaacagcatctatcagtcaattatactctagtacgaattgcccaccaacccctaagtggttgtagggggacgaacaggtctgggacgcagggtttgtgtcctgccttttttgactggctatgtgaccttggacaagtcatttccctgcctcccagagcctccatgtctgtaactgtaagatgcagggtggaaatgacacagtcaattctaaacacagtgtttctggaggccagtacataaaggaggctgatccggaagcctcggggacagggaggccaagatgaacatcagagcacaagctgcttttgcgagtccagtgtcttcaacaccctgcctcagaccatttctgcttttgagccatgttgacatctgctttgcatattttctcctttctcaccaacagccttccgatagcctccccacctcctggcacggactctgctgcccaaacacagccatggccgcggccccttcctgcttggccctccctgttcccctcaggcctcagctttcaagtcatcccttctcaaaaaccattcacagcaaattctctgttctttcccacctctgggtctctgcccctgagggtcccaccccttgaaattccctccattcccttttccaacctagaaaagcttttcttttctttttttctttctttctttctttttttttttttttgagacggagtctcgctctgtcgcccaggctggggtgcagtggtgcgatctgggctcactgcaacctccacctcctgggttcaagtgattcttcttgcctcagcctcccaagtagctgggattacaggcacccacgaccatgcccggctaatttttgtatttttagtagagacagggtttcaccatattggccaggctggtctcgaactcctgacctcgkgatcctcctgccttggcctcccaaagtgttgggattacaggcatgagccaccgtgcccggcctaatttttgtattttttagtagaaacagggttccaccatgttggtcaggctggtcttgaggtcctgaccacaggtgatctgacctcgccttggcctcraaaagtgctgggattataggcatgagccaccgcaccccacaccaacctagaaaagttcaactcatttgtctaagcccagcaaaatcatccagaagccggtggcggtggctcacacccataatgccagcactttgggaggctaagacatgaggatcacttgaggccaagagtttgagaccagcctgagaaatatagcaagacccccgtctctatgaaaaatacaaaaattagttgggtgcggcggcatgtgcctgtggtcccaactactctggagactgaggcaggaggatcacttgaggccaggagcttgaggctgcagtgatctgtgatggtgccactgcactccagccagggcgacagaatgacactgtctcaaaaaaaaatgtcggctgggcgcggtggctcacacctgtaatcccagcacttaaggaggctgaggtgggcggatcacgaggtcaggagatcgagaccatcc

SEQ ID NO: 13340 - DNA, 33042 bp, Homo sapiens
tggtactgtcttcatgatagtgaatgagttctcacaagatctggctgtttaaaagtgactgtcacctccccacatccctctcttgctcctgcttttgctatgtgatatgcctgctcccctttcaccttctgccatgattgtaagcttcctgaggccttaccagaagctgagcagatatcggcaccatgcttcctgtaaagcttgcagaagtgtaagccaattaaacatcttttctttataaattaccaagtctcaggtaattctttataacaatgcaagaatggcctaacaaaatgtctatctagttccaaaatatttttatcagaagaaaactctgtaccctataagcagttagtccccatttcttcctcagcccctgggaacctctaatctactttctgtctctatggatttacctcttctatatgtttcatataaatggaatcagacaacatgtaaccttttgtatctggcttcttttggaacaggaattaaaagaaattaaataatgtgtaagyggaarctcagttgtatgtaacaaaacccaactccccctgagaaagagaaagagctggagccctttaaaaattaactgcctgtttttctgtggctagtgagacttacctctcctcctttcccaggcattgtgaagaccctgtttctctagctgtgcagctgcaaggtcactagacagataaactcaagtcgcaaaacatgtttcttcttgaaaagtaagaaatgatgtaatgcatgtctcaattaattgaataactgtctttatttctcacttctgtagtatgcttccccctgcacagatacccctctctcccaccccacaaaatgcttaaaaggtaacttaactctttgttcagggctcagtcctttggatgttaatctgacttggccagtgcacctaaataataaatatcctcctgaaccccatcggtctctctgatttcttaaaaaatcccgcaatatttccactaccaaaatttgttgacacattggrtatgacttgtgaaaaaaaagagaggtgtctcagttaactccaaaagttttggtctgagtaactggaaggatggagttataatccactgagatggaaaggctgtgggaagagccctacagattggaggagaaattcagaagttcagtttgggatatgtaaaatatgagaggcttattgaacaactaaatttgtttggggatggagatgttgagtaggcatttggctacaggagaatggttctggttgtacagaatttagaattcgttcgcatttaaatggtattcaaagtcaagagtgtgaattggaccaccaagttagtgaggttagacacagaagagcaaagcggtgatctctggagtactccaagggtttsgaggttggggagatgagsgagaatcaacacatgatacagaagaaatagccagtgaagtaggaggaaaaccaggagctccctggtgaagtaagatgaggatggagaataggctgtttgtgttagtgaagtgtaggaccttggtgagagcagtctcagggaattggtgtggctgaaagcctgattggacaagcttcaagacagaattacagcctgagcaacatagtgagatcctgtctctayaaaaataaaaaataaaaaaattagtcgagggttggggcatgtgcctgtagtcttagctacatgggaggctgagggagaaggggcactagaccctaggattccttgagtgcaatragctatgatcgcaccactgcactctagcctgagtgacagagcagcattcccatctcttagagaaagagagagagagattgagagaattagaggagaggacttagaaaaaagtaagtctagatacttctttcagggtatagtgggagcactggcactttcacaagtctccctggctccacgtttttccccattttaccaygtcttccaagttcctgccataagttcagcttaatgatcaagagcatggatttggaactgattggcctctgttcaaattcccaaccatgtctcttactagttatgtgactaaggcaactttctttttttaaamtttttttwaattatactttaatttctgggatacatgwgcagaaygtgcaggtttgttacataggtatacatgtgccatggtggtttgctgcattcatcaacctgtcatctacattaggtatttctcctaatgctgttcctcccctagccccacatcccctgacatgccccagtgtgtgatgttcccctccctgtgtccatgtgttctcattgttcaactcccacttatgagtgagaatgggtaatgtttggttttctgttccagtgttagtttgctgagaatgacggtttccagcttcatccatgtccctgcaaaggacatgaactcatccttttttatggctgtatagtattccatgatgtatatgtgccacatcatctttatccagtttatcattggtgggcatttgggttggttccaactctttgctgttgtgmatagtgcctcaataaacataagtgtgcatgtgtctttatcgtagaatgatttataatcctttgggtatatacccagtaatgggattgctgggtcaaatggtttttctagttatagatccttgagaaatcgccacattgtcttccacratgattgaactaatttacacttccaccaacactgtaaaaagcattcytatttctccacatcctctccagcatctgttgtttcctgactttttaataatcgccattctaactggcatgagatggcatctcattgtggttttgatttgcatttctctaatgaccagtgatgatgagctttttttcatatgtttgttgactgcataaacttcttcttttgagaagcatctgttcatatccttcactcactttttgatggtgttgtttgttttttcttgtaaatttgtttaagtttcttgtagattttggatattagccctttgtcaggtgaatagattgcaaaaattttctcccattctgtaggtttcctgttcactttgatgatagtttttttttttctactgtgcagaagctctttagtttaattagatcccatttgtcaattttggcttttgttgctgttgcttttggtgttttagtcatgaagtctttgcccatacctacgtcctgaatggtattgcctaggttttctcctagaatttttatggttttaggtcttccatttaagtctttaatccatcttgagttaattttyrtataaggtgtaaggaagggatccagtttcagttttctgcatatggctagccagttttcccaacatcatttattaaatggggaatcctttcccaattgcttctttttgtcagctttgtcaaagatcagatggttgtagatgtgtggtgttatttctgatgcctctgttctgttccgttggtccatatatctgtttttgtaccagcaccatgctgttttggttactatagccttgtagtatagtttgaagtcaggtagcatgatgcctccagctttgttctttttgcttaggattgtcttggctatacaagctcttttttggttccatatgaaatttaaagtagtttttttctaattctgtgaaaaaagtcagtagtagcttgatggggatagcactgaatctataaattaccttgggcagtatggtcattttcatgatattgattcttcctacccatgagcatggaatrtttttccattcatttgtgtcctctcttatttccttgagcagtggtttgtagttctccttgaataggtccttcacattccttgtaagttsgattcctaggtattttattctctttgtagcaatcgtgaatgggagttcactcatgatttggctctctgtttgtctattattgctgtataggaattcttgtgattttttcacatkgattttgtaacctgagactttgctgaagttgctgatcagtttaaggagattttgggctgagacaatgggattttctaaatatacaatcatgtcatctgcaaacagacacaatttgacttcctctcttctatttgaatacactttatttctttctcttgcctgattgccctggccagaacttccaataytatgttgaacaggagtggtgagagrggcatacttgtcttgtgccagtttttaaagggaacgctttcagtttttgcccattcagtatgctattggctgtgggtttgtcataaatagctcttattattttgagatacgttccatcaatacctagtttattgagagtttttagcatgaargggtgttgaattttatccaaggccttttctgcatctattgagataatcacgtggtttttgtgattggttctgtttacgtaatggattctgtttattgatttgtgtaygttgaaccagccttgcattccagggatgaagccaacttgattgtggttgataagctttttgatgtgctgctggattcagtttgccgtattttattgagtattttcgcaatgatgttcatcagggatattggcctgaaattttctttttttgttgtgtctctgccaggttttagtatcasgatgatgctggcctcataaaatgagtgagggaggagttcctctttttctattctctggaatagtttcagaaggaatggtaccagcacctctttgtacctctggtagaatttggctgtgaatccatctggwcctgggctttttttarttggtaggctattaattgctgccttaatttcagaacttgttattagtctattcagggatttgacttcttcctggtttagtcttgggagggtgtatgtgtccaggaatttatccatttcttctagattttctagtttatttgygtaaagatgtttatagtaatctctgatggtagtttgtatttctacgggatcagtggtaatatcccctttaccattttttattgtgtctattgattcttctttcttattagtctagctagtggtccatctattttgttaatcttttcaaaatgcagctcctggatttattgattttttgaaggctttttcgtgtctctacctcctatggttctgctctgatcttagttatttcttgtctttcgctagtttttgaatttgtttcttaacctctttgagactctttagaatggggataataatcatatctatagcagagagctgttataaagattaaacaatataataaatatggggcgctgagcttcagagtttttgttgttgttattattattttcctaaaaatgcaaatctgatttgcatttgactcattgactcacatcagtgggtcttcctttttattgtccttcatcatatgggtcctaatttcacatgcagtcttataaaaccatctcattttatagtccaagaatattaaaggtacttgtaggctcccaaacctacacggtgaaaagctagagagcatgggctctcttcaggggttaacttcaggaagtgccactaacaaggacgtccrctaggtggtgagcaaggaaagacggaggtgaaggaaccgaaacgagtcaagtccactgcttagctctactgaagttttgcaaacatcataaataygtctgaaatgcagttttgatttgtagtatttgcaatttccaagggccatttaccacaggtagccaagagttagtttagcatttatgaaaaagataggggagggtggtggaaaagaaggaggaggaggagagagagaaggaggaagaggagaacaagaaccaaacaaaaacaagaacaagaacaagtagaagaagaggagcaggaggaaaaagaagaggaagaagaacagcaacaacaatgagtgaaggaggaggagggtaaggaaagatgcataggagaatggaaggaaggatagmaaggagggaaggaagagagaatctagtcacattactttctgatcagcagttcatttttgtctcagtgggaggcaatagaggccagtctaggaaaggggtggggaaagaggaaagagaagtgcaggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatggtgagcctttcagcctaaaagacgtttagatgctcagatagaaactcttggggttgtagaggcaggtggcaaggataggaatcaccccatttcaattctggttttaaataatatagaaactaaacattttctcagaccctcaaaaaaagtgatcctgaaatctttcttctcagatatgctgatttcctcttcttgactttgtctctggggagactcttgaagaaatactattgaaatcagatcttttgcaataaacactgtgtctacctgagaagtgatatgctttggaagatagaatttttttaaaattatactttaagttctagggtacatgtgcacaacatacaggtttgtcacacatgtatacatgtgccatgttggtgtgctgcacccattaactcgtcatttacattaagtatattttaaggtgtgcaggaaatttgtgactttgtcatttcagttgctcaaaaaggtatttctttttattaaaaaaagaaatacttttctttcctggtgtctggctatctaattttttttttttttaggtatttgaggcattgacycattatgatcaagagtgaggctataacattaaatataagcatcaatagttaattaagcagcaacaatactttaaaaaatatacatagtaaatattaaatagttttatctaatagctcagcagaaaagcaggtataaaaattaccaaaccatagaaaaaattcagggcagtaccgattagcaacttgagactaaagcgtaaaaataaaatagaacaaaacaaaactgtgcatcagttctgatgtaaatttgaagtaatttttcatctatgtctgagaaacctgttacctcagacagggttagyagacatatgtgttttattctgattattaagaaagttgtaagcaccacctcaaaggctrtaaatgtgtggtttaagagtatacatctaaatataattttgtatttcatttgcagatatttccatggaaatgtcagagcacccagagggacttatggaacatcttcaagttgtgggggtggacaatgctctgttgtggtatgttatgatatttatatatcgctaagtctattttacttatattcatttttcttaaatatccactagttatacatagtctaagggaaaattatttcacagagctgttaattctatcccttctgtaaacatctcttttcttcttacctttagttcttccccagaaactcctgaacactatttttaacctataatagcccatgctgtagagttcaaatcccaataaccccacaaaatccctcaattataaaggaataatgttaattaagaaatctctgttaaggtacttacaatctgtaccaaatatttagcacctcattttctattttttattcatmrttcagtgtacattaatgtcatttctacaattacaatacgagcttattaagggacggggstttatcattttttggtccttctcccattgttgtgacaaattttatatctgattcttgaagactctccagcaatagctttgaacttggtttttcatttcctaagtaaactaatgtcttctttctccctagcctggattttcagctctagccaagcaaacatgctaactctcccgttcacacattccttatgccatgtctgcactgtgtcacatagaaacttagtgctcttttcatacaacaggtattttctgagtccctacaatgtgtgaaatttatgctaggcactaaggatacagcagtggacacaacagttttttccctcttagaacttgcattctagtggaatgctcattcaaaactctgttcaaaatgtttattttatgatgctctttaccatcaattatatctgtttctttactgtattaaatagtgattcatgtagatcataccatgcttagaatgccatatattattatgaagtcattgtgtaattatgtgtttaattagatatcttcaaagccctcatatttgatgggtccatatgtttattaaacatcatcagttgagtctctttgtgtatagaacatgatctaatgaatttcataatcctataccatttggctttgtaaattgttctttttaaaaattatacagttagatatataagagttgagtggtatattgggcttttccagaagcagttcttcctatggtaaaataaaatgttttttatgtaaaagaggttacttaaaagtatgtcactgttcttcctgtccttattatgcttctcccataggtacatatgtgttggccttcaagaaatgattccaggattaaaaagtatacgtaaattgtatagttatatgatattacackgtaattagttgtaaatcattaacagctacaaagaaaaagaaatatgaatgtctaaaatatgttggttaaatttcacctgaaataattttgagaaaaaaattaataagaaaataaacctagaaaaccactaaatttgtttcaaatagaaccttagataaaagcatcttatattcaagccagaaggtctaggttctacttcaaatctgcaaacaactattctgtgatcctgagatggtcacatacactcttaggctctgtttcctcatctctaagtgtctrgctcagcctggagtagtgctaggttctttttagctgtaacattatgtaagtctgcataggtcacactgatgtcttgcagatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctctyactgaagaagcagagaactggggagatggygagcccaacaacaagaagaacaaggaggactgcgtggagatctatatcaagagaaacaaagatgcaggcaaatggaacgatgacgcctgccacaaactaaaggcagccctctgttacacaggtagggagtgasaagacggctatgctgcctcagactcaggaagggccacgsttaagagaatactcagatttaccccatggaaaggtggggggatgagaacagcttctggttcattctaaaatacatctagccctctatataatcttgcatcgtgtcactcctaagaatttttggtgtgtaagatttgtccctgtgcacaaaagctatacccctaaatcaagttacatcaaaatgatagatctacgtaggaagtacagaggaagarctagacaatcagtgcctttgataataaggcaggggaggagaagctgacagctggggccagttggaaacttaggctcacatcacctcagttttcacattgtgaagtagagagtgtggtgctgcgtgcttccttcttggtctaaccttatataattttatataaaaattgcactrtctttggtgtatgaatatttctgtaaaatcttctacaattccaaaacagccagcattttccaagtgatgttttaataatgaaccatagttaatttggtctcttataaattggactctacygttttagcaaatttggactttttaatctttgatttctataaagaaagggattgccaagaaataattgcatgcagaaatgattgaggtcaggtcatcatttaaccttctcactcattaaaaacaagtaatttcaagagtttcaaggtatgccactaagyttcctatargtgttacagaatattagtattggtaatttcattccaaaagcaaataaatgcctatgactatatgcttagtgtattttatacgtaaaaattttagcatatgatttttatgctatgaatttacaaataaacctttcctgattatttaaatcatctcagacaaaaggttatctatgtctaaagaaatgactttgagtactaaaatgtaatcacattaaaatattttttttctgacctccttaaagcttcttgccagccctggtcatgcagtggccatggagaatgtgtagaaatcatcaataattacacctgcaactgtgatgtggggtactatgggccccagtgtcagyttggtaagtctctttcctttctttgcttcttcttaggtaaagtcacaggaatcattatagcttatcatgaagctggttggaacaaaatgatactagccactctgagaaatgggaagttttgatcagaaagctctgctttcacaatattgttacctttccgtaaagatttcataagtcagcatgaagtttcgaytcacttctcaacaagtctttttgagtaccacaagaagcacagtgttgggataaaagctgtcagggttacmataaggaattagcatggtagattcccgctctcaagaagctcacgatctaatgagcttgttagattaattagaactctaaggtctggaagaaactatgccatttatcattaggaggctgagttacccagaaagtatcttgctttttccttctagtagttcctttccttcttgcagttctccacacttaacacatgtgctctgtagcacactgactttgctggtggccttctctctcattttgcacatggccaaaaaacatgtcatctttaagacattgttcaaagacagtttcttctaggaagctttcttagttctgatagctccacatatttcttcctcatttctcccacttatgttgaagtcatctgttcacttgtccgtctcctctggtactgaaaacttcttgagatcagtaagtgtcctatttatcattgcatctttgggatccacaaaatgcctgtatatatgaggcacttgcttgtgagcctgaattgaattggacaatttaattttttwaaaaagcaatgtttgtaaacaataaagaattaaaaccaaaatacatttaaatgtcaaccaactgaaatagatctatagatctaactcatttcacttgatccctgggccatgactccttcctaatactttaccctcaccccatttttgaactctattttttaacccttatgttattggtatgcctattttactcatttttaattattggtatgcctatttcactcatttttaacattttacttttctttgtcttggtttctctcatatcactcttttctcattctttctacctgtgatcatttctcctgagatccttcatgagcacttatccaggaccataaactactataatttctcagcttttgtcttttgtatattgctcttctgactctaatctacatgtatcctttggtcaaacttactgacttttgcggactcacaaatctatgtgatctttggactgataagcctatctccagctctgaactcaaatatgctaaggatgtcctttgggatgtttaaaagactataaaaccaattgttcccagtcagcttttctcttcgtatttcttatctcagtatgtggaatcaccatttacatgggcaccctggtatgagactctcttaactcccccaacatttatgcagggtaacattctaccaatttttacaacttagtgtttttctaatttgtcttccacttgtcaactctactaccattgccgtcattatctttcttctagattcttgcaatagtttattagatgagttccacaattttaaattagctcccctcaaatacattattcatactacagggagactgatcaattaaaagcaattaaaacacatcacacatacatgacaatccacccattaatttctacctaccattttgtcctacagggtgaaatctaagctcttcaagccccagagtaatgcttgatatataatagatactctttaaatcaatgaaaaaagataacattttctcttagttcccatgtytctccctaatctcatctcatatagtttccaaatacaaaaattcttctgattccttgagtccattcttccttgaagtctctagagcaaggtagcaataatggcttaaatytgacagatgaggaataagacatgaaagttgtactgtttactaaatggcatggcagggtctaaaatgtgaaaactttgatttccaagtcttaaatttacctattgtaccaccaatcagaacagggaaatagatacagtttctggakagggttgtcaaaatcaaaagagttaaaattctggaactgagctagaatagaagacagaattgaggtcaaaatgcttcctagacttttatattctctccttgcaaagaaggcttattatggagacccactctttctctgaacatcttgctcccaatactctagtagactcaggggctctgatgtgatagttatttcccgactaagctggtcattcccagttacacctatttggctttaaggattctcactacagataatgctgaagataataatatgaagactagctaatgtttacttagaatttctgatgagtcaggctttgttctaasgtccttgacttatgctaattgaattacatttagtttccatatcaatttgataaagataacacaatttcattattcctcttatatagatgaagaaactgaagttggagggttcaagtaaccttgtttaaaggcacatggttatcaagtggcagggctaggattcaaatccaggcgtcagttcctcttaactcttccccatactgtttctttccctattgaagtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaactggtcatctccagaaccaacctgtcaaggtgagtaacttcagactagaggttttgtcatgcaatcctgggcttacagtcagaacattcagtagaagtttgctgagaagtcaaacttaggagcctaatttaacctaactttgtttaacctactgtgatgtttctcaaaggacttattctaactaaatttttttgaaaaacctcccaaacaaaaagtaaaaaccaaatacccctgaagccatctcccagtgtgtaacatgacttatagcaatacagcatggttatactgtgttttttatttttctcattgccattgcataaataatgtcttgttgaacctcagttacattttggttcttctcctctcaataacacctgttttatgtggtgtcctacttaataccaaccagtttccttcccagggtagtggaggtctttcttggttgttttatttggcttattcttaaaatcacttttacttttcctcatgcataaacttttaggagaataacaactgaaaaacaaaaacacaatctcttgatcttttcaagtttgaaataaggtaggtttttttttttttttcatttttaactgccaaccttatctccatatgggagaaaaccaatgtcatctgaacttacgaagttttggttaacttttctacaagtatgctcctgatgcattagtttaagtagtttaattcttaraagtgctatcaaaatcccttattgaaattataaaactgtcarcccacctactggaatttacggaagttggacttgcttcagtgaattgggatgtttttcaaaatgcttgggtagatatcagaacagatgaaacrgcagagattctctgagaatatcccataagarcccttgatgcagaggccatatggcatggtacttccagcagaaggggagggtcaccttagctagggcagcagcctggagtagctactcctctccccacagctttcaatgcttccttgccttcatctctcattcaccacccaccatcattctcaagaaaataaagcctggaagcaatatcacaagtaatgtagtcaggcagctttggctaaaaatcctttgctcaagggagggtctctactcagaaatactgttttgtcttttttttttttttctttttcattgaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaaygatggagctgatggatragcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccagggccagggagtagagtggatgagcagagagaggcagggaggcctttagcagaggactgtgtattaggcctatcagagacatttccctttaaggcctagctagtgttcatttcctcctcatcttcatcaagccaacaggtaccttctgtctggagctcctgggaacttgagccttctctcaatcatatatttgggtgtggggatcaaatcaccttgaaaaggttcatcaaagtaatgggaagaactaaggatagaatcagaccctctgccaatatgtaaaaaagtagattccttcaaatgttagtatcaggagacagatttttttttataccagtattttcaaatagaggctcccaaatgaacttagtttacacttacaagagtatctctaaacatgcccttttacttattcgtgaaggaagtagagggaagtggtaactactgcattggaaagaaattagtgcaggtccttggcatgtaaaaatcaagtgcttatttttgcacaactgctttaaagtaaaagcattaatgatttcctttgactggtgaattatccagttcagatcattggcttttatttttcctgaagttgtattaggcttttagctcttctctgtgtttcagagttccagwcattgaacaagtccatggagctaaatacaaygatgaccattcttgccaacatttttaggkgcattttcaggaactctatgaaccacaaatctgggcattgagattctgtaggcattagactagcaaggctggtccagtctttgcctatgctgtagactcatcaggggccttcccatgccagtttcctcatctgtcaaatggcatcaaatgggctactactgggagatgtaaggaggaaaaaagtcaaatatcatgagatagactaaggaaataatgctgrtggtctcatgctatgtgccttactgatttctctttcagaattggacaaaagtttctcaatgattaaggagggtgattataaccccctcttcattccagtggcagtcatggttactgcattctctgggttggcatttatcatttggctggcaaggagattaaaaaaaggtatgtgagtttaacttcacatgaaaagaacacaactttaaagtgaaaaagaaaaaaaaaagaaacccacaggaaattaaatgtgatagattcaacacaagcaggatgccaagctttacattctagagccatcagtccctggagacatgtaaatcagcccaggacacaccttcattaaaacaggttggctgattttcgcttttcatctgataaacttttaaaaatgtctattaccttcaaggcarcttgctaggctgataacaactaagtgagatattctaatggttctttgctcttatgtaattctttaatacttttttttttttgagacagagcctcactctgtcaccaggctagagtgcagtggtgcaatttcagctcactgcaacctccgccttctgggttcaagctattctcccacctcagcctcccaagtagctgggactacaggagcgtgccaccatgcccagctaattttttgtatttttagtagacacggggtttcactgtgttagccagagtggtctcgatctcctgacctcgtgatctgcctgccttggcctcccaaagggcttggattacaggtgtgagccaccacgcctggcctgctcttaattaattctgaaaaaatgacacactatctctgtcctctaagagcctacatgccttggatttcaatgctacaattccactaggaagtgggtctaatgtccactaaggtttcaaggcactgctcccaaatacctgacctcttcaagagtcacctggttcccaacacatgggcattgcattaaccctgggagaaattcccatgtattctcccaagtatctattcaccaaggccacagctctaaccaaatgcaccatatatgctttccaaccatccgtcactggagaggaaaagagaaggaggactgccttgagaagttaacatctgctgcccagattatcactccctttaccttaagrcatgagtgtgtctcagctttaaagtgtgagcaacccactagcctgcagcaggccttgggtgtatggtgccacatttggccaaactcacctggaagaaccattcaaggctgtaacattcatggacattgggcagcttttaagatatacctgttttggccaggtgtggtggctcatgcctgtaatcccagcactttgggaggccgaggcgggcggatcatgagctcagcagttcaagaccagcytggccaacatggtgaaaccctgtctctactaaaaatacaaaaattagccaggcgtggtggcgggcacctgtaatcccagctactcgggaggctgagacagaagaatcacttgaacccgggaggcggaggttgcagtgagctgagaccgcaccattgcactccagcctggtgacagagtgagactctgtctcaaaaaaaaaaaaaaaaaagatatacctgtttcaagttcagggatgatctcgaaacaattgctaaccaactgctctgtgttgcctttctgtgggctcagttgattgtcattttaattttccttccatcaaattagttagtacgtattctgttcactgaatatggtatgtaaaggttgccccctgtccatttacactggcaattacaaaaatattatttatcagtccctaattgcgtgccactctgatcttatctttcatttaaatttgagaatagtgggygctargtaagttttctaaccaatccagaaagacaaagtgtgtgaggggggtggggattgttgatatgcaagaacttcattagctatgtataacctgagagcactgagcagttaaaatgtctctgcccttgctattagaaattctgtgctgattgaatctcactatcttatagtattatacagtactaagtactatacagtactaagtataagtatcaagtactgcattaaggcaaaagaagaatgacagttttctccaaccactgattattctttccattgagacttcaaatcttgaccccggttgtcctgtctttcttcctaccttgggcgatgatggcagaactgacggatagagaacagggtgggttattacacactgccccctgggataaggtggctattgtctaaataattttaaggactttggggctgtaagtcaccttaataaggaagctatttatttccgaattctaaaatcttttaataagtgtttgtagaatcaaaagaatagaatcaaactcatttgcatgtagtgaggggttagctggctaaggctgttttataagcaagggtaaaaaaattagaggggttgtttttaaattttttaccttggagtcatttctgtacaagatctcaaaccgataacttgaaaactgctgtgggaatcagtgtggggcaaacaggaaacagataacgggcagttaggctagttacagttatgccaacaaagaaaacagaagccccaaaagatcactggcttggtaggaagcttagggtatctttaagataacattaaatagtcttcatctgtgggccaggcaccttggctgtcacctctaatcccagcacttttggaggctgaggcaggaggattacttgagcccacgagttcaagaccagcctgggcaacatggcgaaaccacatctctacaaaaatacaaaaaattagtcaggcatggtagcatgcacatgtagtcccagctacccaggagactgaggtgggaggatcacttgaacccaggaggtcaaggctgcagtragccatgasagcaccactgcactccacaacagagtgaggccctgtctcaaaaaaaaaaaaaaaaaaagtcttcatttataaaacaacatcttccattttcaccaacttacaaatgattctgctttccaaagattttagttgtaggttggtcctttaaaacatgaagagtatttttcctatggaggcaatggtagaaataatggctacattcccaggctaaatctaagasaaaatatagttaatggcatttacaaggataaaagtaaaaagtcataaatctctatgtgtgtgtttaggtgtgtgtgtgtgtctatgtgtgtgtgtatatgtatatatatacacasagagagagagagagagagagagaatttataggctttttgggttctaatagttagaaaaagggcacaggtaactatttagagcatggtagccaatgaagtgactagagccttcacccctattcttctgtcctcagatgaatcttctgactctagcactttgtcccctgccctagtagtcttagtatggagactttccctcctttcttttaggaaaggaataaggaacagttccagaaacatgtgtccttgtgcatgggctcatctagacacattttgtgcwccaggcattatcattttctgattagtcactaccattggccctgtttggtaaataaggaaaccagggcaatgatgttttaggccaaatctcaaaaataccatatcagcaggacccagagtcagagattagactccagtccagatacatcttctaaaatcactggtcttcagatttgtgaactggttttttcctcggttggaagaatttcccaccagaaccaacacacagggttagaccagggcatgaaactgaacacatgcccccttagttcctttttcttcaaaatgaaactctctcagtaggaacagattcttactcatctattgctgttaggttcatcatcmctaaaaaaaatatttatgtgaagytaaccagaatctgaaattaattcagatttgattccccctgctcaagtgcacttggtcatcagcaggctgaattttagaagaaaagatttcaaatagtagtctttaatactttaaakgattaaaacagtaatgcaacactgtctacgtgctaggacctgaactaaatacttggaaatattttattttatcaacccaatgaggatgatacaattattatgcctctttaacagatgaagaaattgtagtttagaaaagaaagtagctgttcaaatacacactacactacaggtggcaaaatagggctttcacctgggtaggatgattctagaatgccactttacagccactgaaatatattgcctcccaaatgattctttctgctcaaagagwtttttttaagttatctacttatttatattctgcttttttcaaaaagaatgtgagaacagtacaaaatgtgttcagtatagcaaattaaaattaattaaaaagtaagaaaaagaagccaatttgggcaacccactcgggtccccttccacgctgtggaagctttgttgtttcgctcttcgcaataataaatgagcttgatgttttattgagtacaaaaaaaaaaaaaagaaagccaaatttaaacttagggtacaaaaatcatttggaaccaaggttgaagttatggcacaaaaatgtatgtcacaaagttttatatacttggtaggagagggtctcagatctagctctgagtttccttacagccagtcaaaggagaaccatgtgatattccttgtgtttgtaagataaaaacacattagttactcagatgaggctgcacaattcctaccaacaagaccaaagtgaaattctcttgtggattctcatagagatgatgctgtgagctgtaatggcacatagttttacagtattagcagctgtccctcaagggaagaatctgcaggtaggatgagatggcagattgggaagggataaacacttgaatggacatattgggtcttgccaccaggcaatttagcaattctgtcttcttgagtagcacggagaatggaatggaacctcaggaggcatctgcatcaacatgtctgttctgtattagtgtctaccactgtttattaagccagttcctcaaatctcctttgacacagatagggtccacctaacaaatacctaatatacttcaaaagacagttttgagagtgggagtcttccttctcccttacttgaaaaactttaaattgtctaatttttgctaatgccttttctctattttctattttcaggcaagaaatccaagagaaggtaagttttattagtggcgaggagtttccacatctgctgattcrttctctacttccttaagttacttcctgctctagctagacacattaaccccatagtagtttatttacctggggtcctcatccaaatgaccagataaggtgataaatctactagcttcctttcagagctgtgctttttggtgctagtggagctgaatgaatgaatgaacgaacaagtaatccctattagaaaagggcagtttatgtaaagggagatttttctgattacctcagaattttttctgagggttaaaaacattgtggtgtgttcttcttgttcttaaatatattatttaagaaatattcaattgaacaagcacttattgagaaatgaataaatgcttattcaattgactatttgcattcaattgctctaacaggcattgtccttcagaaatgtgggaaagatagggagcatgaattctacctacagcttccccaaggaggcaagtatttttcagtttggtcttgaagctcaaatttcttctactggagaaatagcacagtgggaggagatgcagacatgtgaaagttgatggcccacctggcagaaatgaagatggaaaaatatttctcagtatctagggtttagtgacttgctctggaattttaggaaggagagtttaagtaaaataaactatgaaaggaggactttggtgacatattcagtacccagctggacaactgagcttcctttaaaatgctagaaatgaagtgagatgatttctgaagggattggatgctggtttgggcaaccatcctaccaatcacaaacttagtatgggccattgcttagaatgcaaaggaaaaagtggggaaaaatgaggcaccagaagccagatcataaactaatgtataagccatgtgatatgggctttatcttgaggtcttttgggatatcactaaaggggtttaaacagtgagtagccttacctctggcatcttataaggtcaccctgcagagcagtatggcaagtgtgggagacaggtgagcctggattcaaagagacttgttttggaggcatttgcagttattagattaaaaccgatggcgcctgtctagggaactagtagtaagaatgggttcatgaaataagaggaggtgatattaactgaatgtgtctgttaattggctaaaagtgagagagaagaatcaaattatcatctttctcacctggaaactggcggatggtagtcctgtttacttctgagaagggaacataaaagaatgagaggttttggaggtaaagatcatgggttcagttttgtactgagctttgggtgtatgcacatcattcactgtggctcattggacctatccaaagcacagaggctatggcaggagaagtggatttgggtccctcacatttcaggaggtaactgccatctcaggagtgggtactatcatccagggagggtgtgagtgctttaagaatggaagaggacctgggagagagtatgggagccagaggaacatcattatctaataagtcacctaagggaaagagaaatgaaaagatgttgccaggcagggagaaggaagaggagaaagagtgtggggtaatgaatgccaaggaaacaaagaaaggggaacggtttcaaacattgccaagagaaccagtaagtatcccctggatgcaacaagggtgtcagtggggagactatttgcagtgcagacatcaagacagaggtcagacggccaagcattgagcattactgaggatgagaaagtagagacagaacaagcagtcatctcttttaaaatgtttggctgtgaaggagaagtggggcaggggtaactggatgaggatgtacgatcagtggaggttctttttattctttttaattactctgtcttctctttactagtgcaaatggagtctagtgaggaaaggcttctttctctgggctggtctccctatgtctgtggcaggaaacccacagatgtgaagatttctttcaaactcgcacctactgagtgaaagtattttctggcacaatctacccagagctgttttctggctaccggaaccacctgttttaattgccactagatggaagcagatcaactagattttttttttttaagatgtccttgaggcacaggaggagagactggctggaagaatattagcaaaaagctaattaccatgctaagcaaattgctatattaagtttaatggttcactgawtttttataatcagtcaattaatagttgtttattgaacatttttgtgttggaaactgctaagcttycttgagacagcaagaggagtcagcctggtccctgatttcaggaaaattattacctagctggggagttaagacaggaatatagaaagaaaaaaatcagaaaaatacaaggcagagcatggtaatggccaatgggtgctatatttaagaaggaaaaggtcatttggcttggtggttatagaaaatgttataaagaaggttgcttatgaagaatagataggatttaggtatatggagaaaagcaggaaaggaaggcagtctgtaggaaggaaattgtgtaagcagtggtatggtagtgagamtatgaaagcatttttcaggggccactgagcagaactttcttgagcccatggcttattgaggagttgtggagttgaagttggaaaggaaggctggccccaayaacataagtcttgaatgcttcaccagatggtctagaaaggcctagcaaagaagaattatttgcccagctctcatttattgaccaaggctgtattaattcataagaatcacagaattctaggtctgaatatgatcttggtggatatcacattcaaactctttttgtagttgaactaattaagtaagttttctataggccttgagcaagtgacagagttagttacaataatcataaamctttatcaaatattaattccatgttgtatactgttatgaatggtttacatgtcttaaatcatgaaatatgcctttaagtctgtgggagaagggtctatgaacatcttcattactgataaagaaacaggcacagagaaataaaatagcctgaggtcacaataaatggcaatgctgagatccatactcatttggatccaggaatcatgctcttaacgcgtatgcttttagaactcaagacccttgactaccagcttagagtggcaagtcccaggcaccctccttttccagtaacgtggttttttttttcacactgaaaccattgtgtgacggcactgaggaagggtggggtagaagtatggtgtgtttttagaacaagtcaaaggtaaaatgaatactatcacactaaacaccatgagcctttttttttttttttaagttcttgggtgaattttcatagtagtttgtgttcatttctattagcttttgaatggtgaatgaatgactccttgggcatttgtggtttcatttcttgctgggttattttgactcttctgcaaaatgactctgtttatcacctcatttggtttctactgtctaaattctggcaggatagaagctacacccaagatacacaggaagatatgatgccaacctcagaggagggcatatgtgaaattttgttttcagaaacatttttttgtctctattttggcaagcacatttgcagctgctgaactgtggtttaccctgacagttcatcatgagaccagctcctcagaatctggttctccctttgaaaggtgctgtgaagacataccatatttcattctctccttgtcctttccaagaataagacagttgtgtcacacaaaaaaagtgtcacttatttctttaaactaaatgtgttaccatctcattaaattatatcccaggatataatttatcacgagtttataaccaccactatttcatgagtttaaattttctccaatttcactttccatttaagcatgccttctaattccttgactttccactgctcaaaatcaatctacagctgggctcggtggctcacgcctgtaatcccagcactttcggaggccgtggcaggtggatcatgaggtcaggagtttgagattagcttggccaatgtggtgaaaccccatctctactaaaaatacaaaaattagctgggtgtgctggcacgtgcctgtattcccagctactcaggaagttgaggyggaagaatcgcttgaacccaggaggccgtggttgcatgagctgcctccgtgccactgcactccggactgggcaacagagtgagactccatctcaaaaataaataaatwawtaaattaaattaaattaaatwaaaataaacataaatttaaaaaatcaatctacactgtccttcagactcattagatctggagacaaagaccktatgcaccacaaaaatttctccaagtggggtctgtgcgccagtggcataagcatcactaaagagcttgttaggggtgcagaatctcaggctccactcagacctactgaatcagagtctgcattttaacaccatctctgagtggtaagcacatgaaaatctgagaagtgctgctactagggtttgcttacatttgttcatcttcagaggttcctaaagcctggcctcttgtctgagatttccagctgaaagcatttccttgctcctcttctcatctctaatgaatatttacctttactactaacactccaagttttgcaatttttaaactcttattatcttttgtttttctttcagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctaccygaccaacagttccttcagcttccatttygcccctcatttatccctcaacccccagcccacaggtstttatacagctcagctttttgtcttttctgaggagaaacaaataagaccayaaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagamcttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaactagtttgcctagtttgttattttgaaattatcatatgttttgttttytccccagtgagattacatgctccttcagggcagagtttgtgtcagatccctggagtatctagtgcattacttgacactcaataaatgaatgttcaaataaatcagaaagagcatacagtgcactgctgatataagtttcagcaaaccctctttctctatggcatctgatgacctgggcagatatcacctaatgtcaacagctgaattcttatgagagaatagagccctttcagaagctagctggaaatacctccttgtcccatggccaatatagatttcatacaaatttgcacacattatgagaataattttttggtaatgattacacttttctttctcaaagacatctcagattctgtattatagcaaaagctgttgcaaaagattctccctatagtacactgtaaatcttggatgtgcaaatcacattcatgtggtttagggtacatcccctggaggtgtacagtgcacacgtgcacagacacacatggcaaccctgacaaaaatgtttattccactaacacatcagggccaaggaacccaaatggacactactccttgtaattatgatgtatatagatttaaaaataaagttctatattcaagctctaggattcctatatgatcttaggaattacataatagtaatcccataaatcaagattcataatataaaattctccagaaaccttggtcttaacctccctgagacttacttcctatgcccataaaacaagaatgaaatttgccttgcttaccccacagggttattgtgatggtaccttaagtatgaaactgctttgtgaactgaatctgaaacacagactttttttttttttttcctcactcaaatcttacctttcatgctttcatggtgtaagattctggttcttatcctaaggctggaacagatggagctctgagtccttatcctgagattagaagccaggaagtctttcacttgtgttccaataggaactcagccctcagattttcactgcacagggtcagctctgccccctgcacttctgcttgcgggaggaggaagggcctgggacagggagtcagaggcatcagtgggaaccctgcctctgtctccgtgatgtgaccctggccagttgttactctctctgaacttcagatttatttatgaaatggggatcccattatcttygtcacatgattgtgctccacattttatgaaataactcctcctatgctttactcagagtaccaagttcatgaaattgwcagagtcccaggaacacagaattattcattccttctgatttgttcacccaagatcaatgtgcctgggctgtattattgtagtttcctacagaaatagttcaccaaattaaaatctaatttttaaaaaattagctgggcatagtagcacatacctgtagtcctagctagtcgggaagctgaggcagaaggattgcttgagctctaatgatttaatgagaatagaaagaagcaagaaagaggcttcttgtccaaattgcactgtggaaaatgaataaatgtattctttagacatctatatttttccccttaaacttcctccyatctgccagttgacttctctgtacagttctttctccaaagttctttgcattgccctctttcaacttcagcaatttgatttttcccttctgttcaaatgtcctattatggacattttatggaaagaaaatctgccatcaccataacagcctacccaccatttatgacaaaggacagggaaattattaggagaaataatgagatctttacttccctttggcctttgtggccttgtctgatccagtgggccccaacattttatgagatatatacagccttccctgcgagactctgaaagggttttagttaaaagtaatataataattatcacgcgtgtcggtgtgaagagaccaccaaacaggctttgtgtgagcaatgaagcttttgaatcacctgggtgcaggtgggctgagtccaaaaatagagtcagcaaagggagatggggtggggctgttttataggatttgggtgggtagtggaaaattacagtcaaagggggtttttcacttgtgggtaggggtgggggtcacaaggtgctcagtgggggagcttctgagccaggggaaggaatttcacaaggttaatccctcagtcaaggtggcgcaggaacaaatcacaatggtggaatatcatcagttaaggcaggaaccagccattttcacttcttttgtgattcttcacttgcttcaggccatgtggatgtatacgtgcaggcttgggctcagaggcctgacatttctatcttcttatattaataagaaaaataaaacgaaatagtggtaaagtgttggggcagtgaaaatttttgggggtggtgtggagagataaygggcgatgtttctcagggctgcttcgagcaggattaggggtggcgtgagaacctagagtgggagagattaagctgaaggaagattttgtggtaagggktgatattatggggttgttagatgaaactgtagcaggacaagacacagacaaaacccctcagacactgagttaaagaaggaagggctttattcagctgggagcattggcaagactcatgtctcaaaaaccgagctctccgagtgaacaattccttttcctcttaagggcttacaactctaagggggtctgcgtgagagggtcatgactgmttgagcaagcagggggagcaagcagggggtacatgactaggggctgcgtgtactggtaattagaggaacagaacaagacagggattttcacagtgcttttccatacaatgtctgtaatctatagataacataactgattaggtcaggggttgatcttaaccaccaggcccagggtgtggcatcaggctgtctgcctgtggatttcatttctgccttttcatttttacttctttctttggaggcagaaattgggcataagacaatatgaggggtggtctcctcccttaaaacatttgtcgtatagaatgattggtgatggcctggatacggttttgtatgaattgagaaactaaatggaagacacaaggtctgcataagagaaggagaaaaacaggtattaaaggattaagaatcgggagaacccaggacatctaattagagtgcccaagggggttcagcataattacttgcttggttggcaaggtttttggctctatccttgagttttttttatgttgtcatataccaggccagattgatttaggtaaaaacaacactcttcatttaaaaatatgcagagtccccttttttagcagtgagtaaattgaggactcggtgattttggaggaaagagaaattgtaaagccagcaattgtttgttaaagaaggattagaaatggctaggagagagtgagtgagattgatagtgtggtggagatagctggggagaggtagagagtggcataagaatgggaacaagaataagagtgaatataaaagtaaagaatagggctttattagggtgaaagtattggagtgtaccttgtcactgaagatcttctatccactttaagagagacttaagggtggcggtttgaggtaaaaccaggagatatcagttatgatggtttggaggaaaagtataaatcagcactgtaaaaaagggcagggcatttacaagtagttgagaatggtgaataggagtatgactagacagaagattgtagggatgacaagtttttggggcacagttcaagttgggctggtgtctggaatgagactggggcctaataaaaaggagcgtccatacagaatcttaaatgggctgtaccttgtagcatttcgaggacaggcccgaattctgagaatggcaagtggtaaaagtactgtccagtcctttttaagttggaggctgagcttggtgaggtgtgtttttaaaagaccattaatcagttctacctttcctaaggattgaggacggtaaggggtatgaaggtttcactgaataccaagagcctgagaaactgcttgcgtgctttgactagtaaaggcttgtccattatcagactgtatagaggtgggaaggccaaaccaaggaattatgtctgacagaagggaagaaatgaccacggtggccttcttaggccctgtgggaaaggcatctacctatccagtgaaagtgtctacccagaccaagaggtactttagtgtcctgatttggggcatgtgagtaaagtcaatttgccagtcctggggttggggagattagctggacatgatcagcagggagagcacgtgtgttttcatgaagaactatgcctggataggtaatggatgaagaagaaatttgggttgactgaggtaatgggggctgtccatgaagccttgcggcagtacagcccaggtaagttgctgaggctgatgggtgtcagggtcagtccaagtgaaagtgaagagaggctgggatgaagggtgcaaatgaatagtaaagaaagcatgttttgagatccagaacagaataagggttatggaggggttttggagggaggtattgaggataggagagtatatgggtttggcaccatggcgtggataggcaagacaatttggttgataaggcacagatcctgaactaacctgtaaggcatgtccagtttttggacaggtaaaatgggggaattgtaaggagagtttayaggctttaaaaggacatgttgtaacaggcaagtgataacaggctttaatccctttaaagcctgttgtgggatgggatactggygttgacccaggtaagggtgattaggttttaatgggatagtaatgagggtgtgatttgttgccagggagggagtakaggtgtcccatacctgtgggttaaggtagggggatatgagaggaagtggcaaaggagttgccacttttgggttgggaagaagggcagcaatgagatgtggctgtagtccaggaatagtcagggaagcaaataatttggttaaaatgtctcagcctaataagggaactgggcaggtggggataactaaaaagaagtgtataaaagaatgttgtttaaatcggcaccagagttggggagttttaaggggtttagaagcctggccatcaatacccacaacatttatgaagacaagggaaacaggaccttgaagagaaggtaatgtggagtgggtagcctctgcattgattaagaaggggacggacttaccctccactgtaagagttaccaaaagcatctgtgatggtccaggakgcttctgaggcgatcaggcagcatcagtcttcagccactaagccaagaagatctgggaaggagtcagtcagagagccttgggccagagttccaggggctctgggagtgggtgctgggcaagttggacagtccgatttccagtggggtcccacacagatggaacatggcttaggaggaatcccaggctgagggcattccttggcccagtggccagatttctggcacttgaagcaagatcctgatggaggaggtcctgtaggaatgcttgaccactgtggcttaggcattttgaagttcttgtgtactggagatgtggctggggtttctctcacagtggaggcaaggaattgcaactcagaaatatgttgctacttggctgcctctactctattattgtacgctttgaaggcaaggttaattaagtcctgttgtggggtttgagggccggagtctaacttttggagctttttctaatgttgggagtggattgggtaataaaatgcatattgagaataagatgaccttctggcccctctgggtccaaggctgtaaaatgtctaggagttgctgccaaatgagccatggagtgggctaggtattcatatttgatgaaaaaaagcctaaatactaactgagatgggagaggttggataaagaaaaaggagcattaaccttgactatgcctttagctccagccacctctttaa

SEQ ID NO: 13341 - DNA, 28693 bp, Homo sapiens
gtagacatgggagacttttcattttgttctgcactaagaaaaattcctctgccttgggatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaawwaaaaaaaawwaaaaattaaaaagtgaggctgggcacagtgcctcaagcctgtaattccagcactttgggaggctgaggcgggtggattgcttgagcccaggaatttgagaccagcttgggcaacatggcaaaaccctgtcactacaaaaaaaaaaaaattagcagggtgttgtggcatgtgtccataatcccagctactcaggaggctgaggtgggagggtggaataaatggaatgtgatccaacaaaattattattattattattttgatgatgtctattgcccttttgaaatacccaattctggcagggtgcagtggttcacgcctataatcccagcactttgggaggccgaggtgggcagatcacctgaggtcaggagtttgagagcagcctggccaacaaaccccatctcyactaaaaatacaaaaattagccagctgtgttggtgagcgcctgtaatcccagctacttgggaggctgaggcatgagaattgcttgaacctgggaggtggaggttgcagtgagcygagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaaagcagatactttctctgcctatttgatgatacaaaactmgccctaccacaccaggctaagggagagaagaggatccgtgtcctacagaattccccctattagcctacctgccccatagcccccaaactctgctgctaatcaactgtgccaggtcaggaagaaagaaactggagggaaagaagaagcctaatagattgaaaatcccttcagcaaacattttttgagagccttataactgttagtgtctactgaattaaacttactagtgttaagaaaaattatctgaaacatgttactaaggtaaaaagatgattgtgtgactttttgctgtcatgataaagcattgactagcaagtctacttgtcatctgtccctgaagagaaacgtgacactattttcatattaattacggcccagacattgtacaattctgtaaagtaataagatgtgacaatttcctttcctgcctggtagagaagataatcccaaaggttatgatattattactctgtaggacattaacccatttagtatttaatttagcaatcttacttcaatattttycttttccattgactataaaaactcaagttcttttttcttttttttgagacaggtctcacattgttgcccaggctggagtgcagtggttcgaacacggctcastacagtcttgacctcccacatcccaggctcaagtgatcttgcctcagtccctcaagtagctgggactataggcatgtgccaccatgsccagctaatttttgtatcttttcgtatagacggggttttgccatgttgcgcaggctggtctcaaactcctggctaagcgatccacccaccttggcctcccaaagtgctgggattacagatgtaatcccaccatgcccagccaaaactctagttcttatattctattttgaactggctttgtcgtcctgcttgtcccttcattaatgagttaaatgaaactctgacccatgctcactgtctatttcaatgagaattatggttggttttgtttgtttgtttgtttgttttgagacagagtctcgctccgttgcccaggctggagtgcagtggtgtgatcttggctcactgcaatccccgcctcccagattcaaatgattcttttgcctcagcctcccaagtagctgggattacaggcacctgccaccactcccagctaatttttgtatttttagtagagacggggtttcatcacgttggctagactggtcttgaactcctgacttcaagtgatccatccactttggcctcccaaagtgccgggatttacaggagtgagccactgcgcctggccaagaattacrtttttaacatgctgacagttgtccttgacactaagtgtcagaccctggattaagtaatttatagacccatgatactcctttgagatagtttttgtccccattttccagatgagaaagtgaaggcacaaaaagataaaagaawttttctcagtgccagttttgtgccaggagctttactaagttacagtttttttctccttccctcgaagtcctgtttatctattcattgattaaaaaaaaaaaaatcattgagtacttacgatgtgccaaatactctgctaagctggtaatacagaactttaaaacacattctctgccctcttatggcttttggtgtggaagacagatgcataaatagacaattatcatttaaagaagtaagggaggaaaactctctgaacttattctggtttgggggctgcctgcaaaaaaattaattaatgaattaattaattaaaaattaaaaaaaataaaaagaactaagggaaagagagggctccagtagaacagagggagcatctaaccctggcttgtggacatgaagtcagggaaggcttcctgtagtaggtgacacctgagtattctaataggaattagtagggctgaagaaggtggtgggaagcacctcaattcaaaattttgattcctttgtgtattatgaaaggctcttctgactcctgcttacctcctcatatcacttcttccttcctatcacctactcctatttggccatacttaagtattactgctttctcaagtatgttatattctytctcctttcctattatattcttttgtaccttcttcaccctgtacttgaaacaactttttcctcacccctacttgccccttaggcattatcggggttttttgtttttktttttttctttgtttgtttgtttttgagacagggtcttgctctgtcacccaggctggagtgcagtggtgcgatctcagctcactgcagcctcagcctcctgggctcaagtgatcctcccacctcagcctcccgagttgctaggactacaggcacrcgtcaccacgcctggctaatttttgtattttttgcagagcccagatgaactcctgggctcaagcaatcctcccacctcagcctcccaaagtgctgggattacaggtatgagccaccggacccggcctggaaagcattcctttttaaaccaggaaaatggcaagaatattctcttatattctctatcactttttttttttttttttyytggagacagagtcttgctctgttgcccaggctggagtgcagtggcacgatctcggctcactgcagcctccgcctcctgggttcaaacgattctcctgcctcagcctcctgagtagctgggattacaggcatgcaccaccacacccagctaatttttgtatttttagtagagatggggtttcaccatattggccaggctggtttcaaactcctggcctcgagtgatccacccacctcggcctcccaaaatgctgggattacaggcgtgagccactgtgcctggccttctattactatctctgttaaacattgtactagaggttatagccagaacaataagttgaaacaaacattataaaaattaaaaaagaagaaataatctgtcattatctattggtgctatgaatatgcatgtagaaaatccaaaagagtctaaaaataattattataacaaacaaaagaatttattaaggttgctagaaacaaaactaatgcaacaaaatcatcagtacttctatatgctgagaataagcacaccatgagatttaaaaaaaaattatttgcaataatatttttaaaatatggagaacttgactgggtgcagtggctcatgcctgtaatcccagcactttgggaggccaaggcgggcagatcacttgaggtcagagtttgagaccagcctggccaacatggtgaaaccctgtctctactaaaaatacaattagactggtatggtggtgtgtgcctgtaaccccagctactctggaggctgaggcaggaaaattgcttgaatctgggaggtggaggttgcagtgagccaagattgtgccattgcactccagcctgggcaacagagcaagactctgtctcaaaaaatatatatacgtatgtatatatgaagaacttagaggggaaaacttaacagaggatgggccatatgttcagagagaaaattatgaaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaagacactcttgaagaacaaagaggaaagrcttgatctacaagatataaatacattatgaaataatactaatcgagggccaggcactgtggctcacgcctgtaatcccagcactttggaaggccaaggcaggtggatcacctgaggtcaggagttcgcgagcagcctgaccaatatggagaaaccccgtctctactaaaaacacaaaattagccgggtgtcatggcgtgtgcctgtaatcccagctactcgggaggctgaggcaggagaatctcttgaacccgggaggcagaggttgcggtgagctaagatcctgccattgcactccagcctgggcaacaagagtgaaacaccgtctcaaaaaaaaaaaaaaaaaaagagraaaaaaaatwwaaaaaaaaaaagaaataatacyaattgagataatgagcattggtaccaggtgagacaactggaccactgaaacagaatagacatatttactgtaagtcagagatgccactgcagatcagtaaggaaaggccaacttttgataactggttctgtctgggacagtggatatccattaaaagaaactaatcttgacctccacttcataccatacctcaaggtgaaagacaaaactaaaaagctttgaacataaacagaatatcttcatgaccttggggtttagggaagggttgcttaaataaggcacaaaaagtacaaactgtaaaggaataggttgataaacataaccaccttaaaattaggaacttttgtttatctaaagacatgataaagaaagtgcaaagcggctgggcgcggtggctcaygcctgyaatcycagcactttgggaggctaaggtgggaggatcacttgagcccagaagtttgagaccagcctgggcagcatagcaagacctcatctctacaaaaataaggttttttaaaaaaaaaaaaactgtgacggtwaaaccacytactcaagactcagcaatggtggatgccctacgacacctaggtggcgtagcytactatacccctaggctccttggtatagcctattgctcctaggctacaaacctgtagaacatgttatgatcctgaatactttaggcaactgtaacacaacggaaatatttgtgcatcttaagaaatctaggatttgctggcaagatggccaaataggaagagctctggtctgcagctcccagtgagatcgatgcagaaggtgggtgatttctgcatttccaactgaggtacccggtttatctaattgggactggatgggcaatgggtgcagcccacggagggcaagcmgaagcagggtggggcgtcgcatcacccaggaagtgcaagaggttaggggatatcccccctagccaagggaagcggtgagggactgtgccctgggaaatggtgcactacggcccagatactgcrcttttcccaaggtcttcgccacctgtagaccaggagattccctcyggtgcctacrccaccagggccctgggtttcaagcacaaaactgggcggccatttgggcagacaccragctagctgcaggagttttcttttttttttttcataccccagtggtgcgtggaacgccagcaagatagaatcgttcactctgcaggctgggcgcggtggctcatgcctgtaatcccagcactttaggaggccaaggtgggcagatcacgaggtcagaagttcgagaccaccctggccaacatggtgaaaccccgtctctactcaaaatacaaaaattagctgggtatagcagtgggggcctgtaatcccagctactcaggaggytggggcaggagaatcacttgaacccaggaggtggagcttgcagtgagctgagattgcaccactgcactccagcctggacgacagggcgagactccgtctcaaaaaaaaaacaaaaaaaaaaaaacaggwttgttcaatccgctggaaagggggctgaagccagggagccaagtggtctggctccatgggtcccacccccacagagctcagcaagctaagatccactggcttgaaattctcgctgccagcacagcagtctgaggtcgacctgggatgcttgagcttggtggtgggaggggttgtccgccattgctgaggcttgagtaggtggttttaccctcacagtgtaaacaaagctgcagggaagttcaaactgggtggagcccaccacagctcagcaaggctgctgtggccagactgcctctctagattcctcttctctgggcagggcatctctgaaaaaaaggcagcagccccagtcagggacttacagataaaacccctggccagcacggtggctcacgcctgtaatcccagcactttgggaggccgagacgrgtggatcatttgaggtcaggagtttgagactagcctgactaacatggtgaaacaccatctctactaaaatacaaaaaaaatgagccaggcgtggtggcaggggcctgtaatcccagctactcgggaggctgaggcaggagaattgcttgtacccaggaggtggaggttgcagtgagccgagattgtgccactgcactctagcctgggtgatagagtgagactctatctcaaaaaaaaaaaaaaatctccctgggacagagcacctgggggaaggggtggcttggaaacagcttcagcagacttaaacgtccctgcctgatggctccgaagagaactcccaggacaacattcgagctctgataagggtcagactgcctcctcaagtgggtccctgacccctatgtatcctgactgggagacacctcccataggggccaacagacacctcatacagaagagctctcgctggcatctggtgggtgccyctctgggacaaagcttctagaggaaggaacaggcagcaatctttgctgttctgcggcctccagtggtgatacccaggcaaacagggtctggagtggacctccagcaaactccagaagacctgcagcagaggggcctgactgttagaaggaaaactaacaaatacaaaggaatagcatcaacatcaacaaaaaggacgtccactcagagaccccatctgaaggtcaccaacatcagagaccaaaggtagataaatccatgaagatggggagaaaccagcacaaaaaggctgaaaattccaaaaaccagaatgcctcttctcctccaaaggatcacaaytccttgccagcaagggaacaaaactggaaacagagaatgagtttgaagaattgacagaagtagacttcagaaggtgggtaataacaaactcctccgagctaaaggagcatgttctaacccaatgcaaggaagctaagaaccttgaaaaaaggttagatgaattgctgactagaataaccgtttagagaagaacataaatgacctgatggagctgaaaaacacagcacgagaacttcgtgaagcatacacaagtatcaatagccgaattatcaagcagaagaaaggataacagagattgaagatcagcttaatgaaataaagcgagaagacaagattagagaaaaaagaatgaaaagaaacaaagcctccaagaaatatgggactatgtgaaaagaccaaatctacatttggttggtgtacctgaaagtgacagggagaatggaaccaagttggaaaacactcttcaggatattatctaggagaacttccccaacctagcaagacaggccaacaatcaaattcaggaaatacagagaacaccacaaaatcaatgtgcaaaaatcacaagcattcctatacaccaataacagacagagccaaatcatgagtgaactcccattcacaattgctacaaagagaataaaatacctaggaatacaacttacaatggatatgaagacctcttcaaggagaactacaaaccactgctcaaggaaataagaggtcacaaataaatggaaaaacaatccatgcttatgtataggaagaatcaatatcgtgaaaatggccatactgcccaaagtaatttatagattcaatgctattcccatcaagctaccattgacttccttcacagaactggaaaaaactactttaaatttaatatggaacaaaaaagagcccccgtatccaagacaatcctaagcaaaaagaacaaagctggaggcatcacgctacctgacttcaaactatagtacaaggctacagtatacaaaacagcatgatataccaaaacagatatatagaccaatggaacagaacaaagccctcagaagtaacaccacacatctacaaccatctgatctttgacaaatctgacaaaaacaagcaatggggaaaggattccctgtttaataaatggtgttggaaaaactagctagctatatgcagaaaactgaaactggaccccttccttacaccttatacaaaaattaactccagatggattaaagacttaaacataagacctaaaaccataaaaaccctagaagaaaacctaggcaataccattcargacataggcatgggcaaagatttcatgactaaaacaccaaaagcaatggcaacaaaagccaaaattggcaaatgggacctaattaaactaaagagcttctgcacagcaaaagaaactatcatcagagtgaacaggcaacctacagaatgggagaaaatttttgcaatctatccacctgacaaagggctaatatccagaatctacaaagaacttaaacaaatttacaagaaaaaaaacaactccatcaaaaagtgagcaaaggatatgaacagacacttctcaaaagaagacatttatgtggccaaaaaacatatgaaaaacagctcatcatcactggtcattagagaaatgcaaatcgaaaccacaatgagatactatctcatgccagttagaatgatgatcattaaaaagtcaggaaacaacagatgctggagaggatgtggagaaataggaatgcttttacactgttggtgggagagtaaattagttcaaacattgtggaagacagtgtggtgattcctcaaggatctagaaccagaaataccatttgacccagcaatcccattactgggtataaggattataaatcattctactataaagaatacatgcagaggtatgtttactgtggcactattcacaacagcaaagacttagaaccaacccaaatgcccatcagtgatagactggataaagaaaatgtggcacatatataccatggaatactatgcagccataaaaaaggatgagttcatgtcctttgcagggacatggatgaggctgaaaaccatcattctcagcaaactaacacaaaaacagaaaaccaaacactgcatgttatcactcataagtgggaggtgaacaatgagaacacatggacacagggaggggaatatcacataccagggcctgtcarggggtagggggctaggggagggatagcattaggagaaatacctaatgtagatgacgggttgatgggtacagcaaaccaccatgacaagtgtatacctgcgtaacaaacctgcacattctgcacatgtaccccaaacttaaagtataataaaaattaaaaaaagaaatctaaacacagaaaaggtacagtaaaaatatggtatagtcswttttaaaaggtacacctgtagagtgtgtacttcatgcatggagcttgaaggacttggtgttgctctgagtgggtcagtgagtgagtggtgagcaaatgtgatggcctacgacattactgtacactactgtagaatttatcaatactgttcacttaggctgcactaagtttatgcaaaaatatttttctttcttcagtaataaattaaccttagcttactgtaaaaaaaaaaaaagtgaaaagttaatatttatgtgttctgtgttcaggaaaccaggaggaatggatttggctgaaactggaatacatggatagataaggctagagagataggcaggagccaagccaacaatactaggctcccaycaattgctggggcaggcaagagcaggcatcatcctgagtgtttggagcttcttttcatgttccctaagttggggggtgttggggggatgatacagggggaaattctgattaagacttaacatctattcctttgccttctcttcaagaagtcatacttgatgtccatccctcctggacagggtccgttctgtttgctgctaagctcctttcttatctctcccacctactgaacacgtactgtgttctgggagttttgaatgcatcatcttgtttatcctcatgagatggtctaataatgaagaaagcatgttttggcatccaactcacctgggtatgagtcccagctctgccttttactagctggatgtctttgagcagctcagttccctgttctgtgcttctgtgtcctcatctgtaaaatgggaacgacggctatttcttcagactgccctccctccctccttttctgtctccctccctccctcccttcctccctccctctttcccccttcttcttttcttttctttctytctttctttcttttcttctttccttctttcttttttctttctccttctttccttccttccctcctctctctctctctttatttctgtctgcctgtctttcaacagggtcttgctatattacccaggctggtctcaaactcctggactcaagcaatcctcccagcttggccccccaaagtgctaggattacaggcctgagcacctggcctggactttcttcagacttttcacagggtactagtgagaaaaaaatacatggactctgcttacttaatactgtgcctggcacattgtaagctcttcgcacatgttattgttattattcctcatcctaagggggaagtgcctttgaagggtccacactcctttgttacccaaattgggccaggttgcttaaactgccgttcttcagtagctaacaacaggggtgggagagcctggtcctctgaagtccagctgggcacacggccagtccctggcctgtccctgctcctgctgccctggcaaggcctccctcacccactggggctgcaccagcactggccccagctcagcttcctgtctcccttatcttcctccagcatgtgctctctggagtaggaaacaccaccrcttgcttccttcatttccctttgctcaacgggaccctcattctttaggtctcagtcaaatcccagctgctggcctggtgcccactctgtgattttctacacctcagccacccaggccagatgcagtgtaggccatggctccaacagcagcatttctcttttcttccccacccccatccctgggtttagaatgagaaaakgctcaagttgcccccctcccaacttccctacccgcaacactctttttattttctctgttcccagctccatacttccatgcytttttttttttttttttttttttttgagatggagtcttgttctgttgcccaggctggagtgcagtggcaggatctcggcttactgcaacctccacctcccgggttcaagtaagtctcccacctcaacctcctgagtagctgggattacaggcacgccaccatgcccagctaatttttgtatttttagtagagacggggttttaccatgttgcccaggctggtctcaaactcctgacctcaggtgatccatccaccttggcctcccagagtgctgggattacaggcatgcccagtcccatactttctgagttcaaatcctcgctctgcacttccaagctgtgtgaccttgggcaagttacttaactatttttctgggctttgattttttttttttttttttgtacagaggagcagaggaggattcatcaggttgcccaggttggtccaaactcctgggctcaagggatccttctgcctgggcctcccaaaatgctgggattacaggcatgagccaccatgcccagtttttttggttgttgtttgttttgttttgttttgtttgagacagggtctctttctgtcacccaggctggggtgcagaggcacagacatagctcactgcagccttgaccttttgacatcctgggctcaagccatactcctgcctcagcctcccaagtagatgggaccacaggtgtgtactaccatgcctggctaatttaaaaaaaawttttttgtagagatggagtctcatatgttgccatgctggtcactaatttacaggcatgagccactacacccaggcagctttattttatttatttttttgtctgtagcatggaaacaatgagcatggtctgccccagagaaagtgattaaaggcctagcacatagtatgaatttaaagaatgttttataacatatatattaaacattcaagcatgttggaggtatgtgttaaaaaaatgtattgatggaaagtgatcaaaataatttttgagtcactgtgtgggagttaaattcacaaactttggcaccagagagagagagaaactttcaaattatagcttttgctgtgtgaccttaggtaagtcacttaacctctctgagcctcagtttcttagtaaaatggtgatgctagtgaaacccatttcacagggctagcataagaataaagtaagattatttaagtaaagagccgaacactgtttctggcctacaataagtgttacctataataatgctatcattgtctcactgttcaattttcagggctctagtatatgagaggggtgcttgggaaatagctgttgctgctgctatctgtccatgatggatcttaacctgattagaaaggcctccatgtggctgggcgtgggggctcgtgcctgtaatcccagcactttgggaggccaaggcagatggatcacttgaggtcaggaattcgagaccagcctggccaacatgatgaaaccctatctctactaaaaatgcaaaaattagccaggcatggtggcaccygcctgtaatcccagctacttgggaggctgaggcaggagaattgcttgaatccaggaggtggaggttgcagtgagcagagatcataccattgcactccagtctgggcaacagagcgagactccatctcaaaaaaaaaaaaaaaraaagaaagaaagaaaaggaaagaaagcccttgatgtaatgagctctgtgtaagataatgtggatgaaagtggacccagaccctacccgcttagatggaaggctcacagcattcaattccaaattggttcaatcgtacactcttttgccctctcttatccatcccaaagtacccttcaagccttcaagggagaaaaaaggcaaagcaaaaatatgcacaacctcactaagaaccagaaaaatgcaaactaaaaccaaagagaaatgccattttacacccaaccatctgataatgccaagggctggcaaggatgtgaagcgagggaattctcatacactgctgggaacgtaaattggcacaacctttctgtaaaacagtttggcaatatctagtaaaactgaagatgcatatactttattactcagaaattccactgtcaagtttgcacctacaaaaactcccacatatgcacaaggactcghgtatgagaatgttcataccagcactgtttgtaatagcaaaaaactggaaaaaacttaagtgttcagcaacaagagaatggatacataaataatgatctattcccaaaattgatttttttttttgagacagggtcttgctctgttgcccaggctagagtgcagtggcatgatcatggctcactgcagtctcaacctcctgggctcaagcaatcctcctacctcagcctcctgagtagctgagaccacaggcacaacccatcacacccagctaattttattttttttgtagagatgggggtctcactatgttgcccaggctggtcttgaactcctgggctcaaatgatccayccacctcggcctcccaaagtgctgggataatacctccccagccggaatattttaaagcagtgaaaatgaatggtctacacatagccacatgaatgaatcttattaatacattaartgaaaaaagcaaaaggtacagaggaatacatacattttaataccatttatataaagctcaaaatatgtgaaataccactatctattgtttagggatatatacataagtagtgtaagtatacagaaatataaggaaatgaaaaatatcaaatcttcattttcatctgaagtggttacttcaggggctgtggcagggagagagagatgcagctgaggaagagtccatagggggcttcaactatattagcaatattgtatttcttatgcttggtggtggggataggtatgtttgaaatgtaatcctttaagcatgaaataactcttcaaaaatgaaatatttcaggctgtgcacagtggctcaggcttgtaatcccagcatgttgggaggctgaagtgggcggatcacctgaggtcaggagtttgagaccaacctggccaacatggtgaaatcccatctctactaaaaatacaaaaattagccaggtgtggtggcaggtgactgtaatcccagctacttgggaggctgaggcaggagaatcgcttgaatctgggaggtggagkttgcagtgagccgagatcacgccactgcattacagcaagactccatctcaaaaaaaagaaaaaaaaaaagaaaaaagaaatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcytacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaascaatcatcttctgagatttatacagattgctcataattctctcctattttttaaaaacatgctgcagtgaactgctttacactcattttatgactacttctgagaccaagatcycggattatgtaattgttatttacttaaaattctggtaaaatgtagccattayactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcytcaacttcaggatgttgacaacattgctgccgatactgctgctgtctggctgggcyttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacrggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttmacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttytgggtgtaggaagcagagattaccaagcatggttccatagcctagaggagtccagtgtggcctgtgtgtgtttggagacagccaggtagtatcccgtgagatacacactaatatrtggtggtctgggatcactgaaacagacacactgtgtctcgtggggcatcagaaaaaaatttccaagaagagggcaactgagctgggtctttttttctttgcttttctttcttttttcttttttytttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtayttttagtacagatggggtttcgccatgttggccaggctggtcttgaatccctgacctcaagtgatccgcccgcctcggcctcccaaagtrctgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccaraaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcvcatgtagactggggttaataatagtagctattgcattaagccactggggaaaggcacaaagataataatgtatgtaaagcccattgcccaggttataataagcactgaatcracattggctatgattatttttgattaatgaaggggagggggttatggcactggaagattttaagtaggaaaaggacatgatctcayccctgggtcargtgraggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagytgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggrcttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagamcccaagttcttctctcaaagccccactccttccccgtcacaaccctaactccttcttctcaaagaccscaatttcttttctcaaagcaccaagcaccactccgtcccccttcccccaccatcatggcctttaaytcctttctctcctagtcccccaccccacccccyyttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctrgccccttctttcttagcctctaacaggctaaccccaaacccctcctcacagccccaggcccttctccccatagttccctgacctaractcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcrgtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagctcctttcttctcccacatctgcccactgaagatttgagggaggggaratggaraggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccmcaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccmctttgcaaaatttctggaaaagtaacctatacccatttcttctgcttccttatttctcactcattcttttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactstragatcaccagtaacctctaattgtcaaaccrtcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggyttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcrggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttktttttttttttttttttttttgagacgragtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaaygcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcaytgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagataycataattcctctctttctttgtggtaaacatgaaggtgtaccatccagttctacctccaaagaaagacttcctgttggcygggcatgatggttcacgcttgtaatcgcagcactttgggaggccgaggtggggggatcacctgaggtcaggagttggagaccagcctggccaacrtggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaatawataaatayataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcytaagcaaggcaggggtataaaagttcggtyattttggccaactgcaggacaactctgagaatargttggattgacaagggctagccagggctggaaatattcactccagagctccctgccagggaggctgggtctttgtcagatctgcattgccgtttgacttctctcttakctcakccctacttcttccccctggtaagcatcttgcacctcaaactctgtctcagcctctgcttccagataacccaacttgtgtgtgtgtgtctctctctctttcaaaattgagaaattttctcaatcytgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttwwttttattttatttwattttattttattttgagatggagtctcactctgtcacccaggctggagtaaagtggtgcgatctctgctcactgcaacctccacctcctgggttcaagctattctcctacctcagcctcccragtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaractttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtkatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcmtggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaarggaaagaaagaaagaaaaatgttatgctctsatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacat

SEQ ID NO: 13342 - DNA, 67126 bp, Homo sapiens
aaggcaggtggatcacttgagtccaggagtttgagaccaccctgggcaacatggcgaaaccccgtctttactaaaaatacacaaattagccaggcatggtggagtgtgcctatgatcccagctacttgggatgctgaagcacaagaatcacttgaacccaggaggcagagtttacagtgagccaagatcacaccactgcactctagcctgggtgacacagtgagactcagtctcaaaaaaaaaaagtagaaaactcatcaagctgtacagctaagttctgtatacctcatatatgaatattrtatcttaattaaaaggaaaagtctattaacaaaaagagttctcaaaaatgctcaacctgaacctccttagggggttggcagaagcattaactaaagctctcctrtatttcaccaaaatgtgttggcaattcgtagcctgcyggaggaagggaggtgtgagctgttccctgtgttcagctggacagcctcccactctctataggcgcttcttttagagccagctccactgctggtcctggaggttttttggggaaggcgatcaaaaaatttacaatgtccatgactactatagggaatagttctacgatgctggctgcgaaaaccagatcaacttattaggcacagtagacacagtgataattttactgtcccatgaaaatgttttaattttaatttcttttgaaatcagaacaaaaataagaatactgtaataatgagcatataataatgaattcagccagcgttatatgtgtctttataatgcaattggaaactctcattttaaatttttttttttgaaggaaaaaggggtccttaaaggcaaaggtgcctggggcccacacaagtcataatgcagccctgagtaaaaggaaaggtgctagggactgaattgtgctcccccaaatgtcttgtgttgaagccctaaccccccaaggtgactgtatttgaagataaggcttttaggaggtaattaaggttaaataaagtcataagggaggggccttaattcaataggattgttgaagaagaggaagagagagagaaatctttctccctgaaagcacacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaagcttgcaatttgttaggtargtaggmattctttttttctctgcctatttgaaggactacctactttgaaggttgcagatcagcagcagaaaaaawttttttaaaaagctttttaaaaaaattttagaagaaatcaaaggtttttttggtaataaaattttattggcttggcatgrtggttcatamctattatccagcactttggaggctgaggcaggaggatcactttagccagggaggtcaaggctgcagtgagctgtgatcatgccactagactacaacctgggtgacasagtgagactctgtctcaaaagaaaaaagaaaaaagcacagaaaaataaataaaattacttataaatgtgtgaaaagatttttaatctcacttataattaaagaaatacaaatcaaagcatcctaattttattttatttatttttttttttgagacggagtcttgctctgtcgcccaggctggagtgcaatggcgtgatctcggccactgaaacctccacctcccgggttcaaacaattctcctgcctcagcctcttgagtagctaggattacaggtgtgtgccaccacgcccagctaattttttttttttttttttgagacggagtctcgctctgtagccaggctgcagtgcggtggggcgacctcggctcactgcaacctccaactccctggttcaagtgattatctcacctcagcctcccgactagctgggattacaggcatgcaccaccacccccggctaatttttgtatttttagtagagacggggtttcactatgttggctaggatggtctcgatctcctgacctcatgatccacccacctcagcctcccaaagtgctgagattacaggtgtgagccatcacgcccagcctaatttcttgttgcccagactgcagtgcaatggcgcaatctcagctccctgcaacctccgcctcccaggttcaagagattctcctgcctcagcctcctgagtagctggaattacaggcatccaccaccatgcctggctaattttttgtatttttagtagagatggagtttcaccatgttggccaggctggtcttgaactcctgacctcaggtgatccacttgcctcggctcccagagtgctggaattgcaggcatgaaccaccgcgcctggccaatttttgtatttttaattgagacggagtttcagcatgttggccaggctggtctcgaactcctgacctcaggtgatccacctgccccggcttcccaaactgctgaaataataggcgtgagccaccgtgcccagccycaatattttttaaaataagaaacaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtgstggctcacgcctgtaatcccagcactttagsaggctgaggcaggcagattgcttgagcccagcagttcaagaccaatctgggcaacatggtgaaaccccgtctctacaaaaaatacaaaaattagccaggagtggtggtgcacaggtgrgaggatcgcttgagcccaggaggtagaggctgcagcgagccatgatcatgccactgcacgccagacttggcaacagagtgagactctgtcccagaaaaaaacatttttaaaagatacaaggatgttcattgcatcatttccagtaacaagtgacaagctaaatgcccaagaagagactgattaaataagttacatagtggatcaaaaattattaacgtaagtatttctagccttcccctaccatctgccagctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcacgcctgtaatcccagcgcttcaggagtctgaggctggtggattgctggaggccaagagttaaagaccagccaggccaacatggtgaaaccccatctctaatgaaatccaaaaaaaaattagctgggcgtggtagcgcacacctgtaatcccagctactcgggaagctgaggcatgagaatctttggagccggggatgtggaggttgcagtgagctgagatcatgtcactgcactccagcctgggmgacagagcaagactctgtctcaaaaaaraaaaaaaraaaaaaggaaaaggaaagataaatttataatgtattgccaggaccacacaaacccttcatatgtaccaggaatgcaagtagaggaattgagttattttgaaatacttgttggctggtgatttatatttcattgatttagacactgctctgagtatggcttcagaagtgttacatacgcakaataaaatcctttacagctattaaaaggagtgaggtaggaaagcatactgctaaaagcaaagaagccagatgagaactgtgtactgtacatccccacttgtttaaaacgtttgtatattatattcacatatgtatgctttccactacatagaagttttctggaaggtatttctgcacatttataaagatgcacrtctaataatttcatttccccccattttctacttattgctctgaggtcaacactgaatagtccttatgaagatggtattgaatattctttcaacaaaaaagtctccggatctcaactactggagctcagaaaacgataccccaaagtaggaggctttggcatgctaagtactttgaactaaaggagattaggtctcagtagcagcctcagaaacaaagtctacccatgactttctcctgccctcctgtctccagcggtcttgcacccctgaagtaagtcacaggaaccagaattcttcttccccaaggagggttatggaaacttagaaccttcaaagtaatttataaacttggaaatcttactgtaacattttcttctacctctctctgtctttgagacagggtcttgctctatcacccaggctggagtgcagcagcatgatcatagacaactgtagcctcctgggctcaagcaatcctcctgcctcagcctccttagtagctgagactacaggtgtgtgccactatgcccagctaacttaaaaaaawttttttttttgtatagagggagtcttgctacattgccctggctgagaatttacatttctaacaagttccaaggagatgctcctgctgctggtctggggatggccgtttgaggatccctgcatgaaggcatacacaggacttgatcctcagtgggggcaccaggagctggagcctggggagtgggaagcgagagcacagagctgactgaggaccacgaggtcgtcgtggaggacctaggctgaaggtccygaagaaatccccatagtttcactgccaggccagccaggtggacatctcagggctgaggaggtgagaaggcaagacagaaagtgaaacagcactttataggatagggatgggaaggtcatctgcatcatgggactccttggggaggggttcggtcattgcbccagatgaaggtttagtcttttcatcgtaaatttgctttcactgttgggaaagagatcttcacctccattttcttaacttcaaaatggaaatgacagatgcttttgagtggtctgaatacttgaaatttgagggaaaaygttaccagaaacacatacaactagagttaaagataaatacatatatcaaacgcatggctcaaaaatgacaacgcgtcttctttatctgccttcacgtagaacttaaaacagaccctggtccccacctcgggrtttcctcgcgcccacgggctgcgctgcgcagctgggccagcaggtggcgaggctcccgcactttttttcccgggcctggccgcaccgccaccgcccaccccgcgctccgccccgccccgccccgccgcactcgcggatcgtcacacggtcaggccaccgcgcgtcaccgccccgggctctgctagaaagtgccggggtccagattyctttcaggtgactgggttgggaggagaagtcgctcagcgtaattgtcggagccgaaataaacaragactccgcggccgggcgggaccttacccggaagtcccccagaacagcactacccttcgctgaaacctcgcccgccccctccaacccagagacgaaaagggaaagcatcacggccagaaaccgttggcacaactccacagatactctcccgggccgagccagactccataagtcccgcgcctggcccccggggattgcaggggctgaggagaagggcaacacggggaccttgaagcggggtcgcggsggcgccccagcccgggccagggagtcccggcagcggcacctcccagaaagggcggagcygacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgggacgccctgtggggacgtggcggggccgagagccggggaaggcgacgggcccagcgacggctcaggcccgggtcctggggaagttggtctggcgatggagagctcggaggttcctcacttgtcctgtttctgtctccggccacgctctctttcctgtggtctggaagagggtggcagtgggggcttgggtgacctgttctgagcttgttccatctgtggtcacctaatttctctgtgtaggatgtggcaccagaagaagggaggaaagtgggtagagtgggatagggacactacttgctttttaaaaaattctgctacatgcgcacgaactccaaaatttaggagctctaaccactttatttcctcttctcatcacctgaggatggaggtggaagcagaggtaaagagacacaaacttcctcaagcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgggattattgtgagcaccactcctggcccctcctagagttttagatcaggaccttaaataggcttcccttttttttggagacagagtctctgttgcccagtctggagtgtagtggcgcaatctcggctcactgcaacctctgcctcctggattcaagcaattctggtgcctcagcctcccaggtagctaggattacaggtgcccaccaccacgcccagctaatttttgtattttccgtggagatggggtttcaccgtgttggtcaggctggtctcgaaatcctgacctctagcgatccgccctcctcttttggggattacaggtgtgagccacctcgcccagccaggcttcacattattaagtagccatctcttaagtattttttaaatctcaagtacccaaggctgatggccaatgagtgcttcttttatgacatttgggataggtcagaggtttgttgtaagtctcttgcaaaaatgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgctamattatctacgacatycttgtcctgttsccctaactagaatgccttccctctgaagttctgaatctttatttaaactgctgcaacagcatttgctgcctcattaaaagaccttggtgtgggtcttgactcttctctgttcccaagagtgatcttgggtaagccagttatcctctggagcctcagtttcctcctctgtaaaattggattaactgtgccaactatgcttgtgaaagacaaatatttcctaattgaactaccgaattgcaggctccttaagagcaataactgttgctctccaatatcatctacaaatgtggccaggacacttgacttgggactctttttttttttttttttttttgaaacagggtcttgcactgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatcttttttttttttttcaagaccaggtcttactttggttgcccaggctggagcgcagtggcaygatcttggctcactacagcctcgacctcccgggctcaggtgattctcccacatcaagcctcccgagtagctgggactataggtgtgcaccatcatgccctgctaattttttgtatttttagtagagaaggggttttgccagcttgcccaggctggtctcgaactcctgagctcaagtgataccatccacctccgcctcccaaagtgctgggattacaggtgtgagccaccatgcctggcccactgggattctttgatcataagatatttgggccttgaaatggattttggggagagacttagaaactagtggcaatcaaaattggatttgcagttggtttctaggtgatggcagtgatcagctgcggccagccaggtttttcttcatctggactgtgcctctcactttcaaatttttggaacatttgctttggcarcaaaactttyaaaaaaccaactctctctggtgcaggtgttctgttggaggatttgagagaagctttaaaattttatcttattactgtcccttgcttaggtcacaagaggagctcaaaataatttcataaacatgaattggctkccctagacacaacaaaggataagatcaaaagaattaacccatttaaaaaaatcagtctaggctggtcctaaggtagtgtgttatcaattgatcaaagtcagttacagatcgaactccttgatctactctttcctcctgctcactactgcacttgactagtccaaaacaataagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctatggaggatgaattaatgtatcaggtggacaagaggaaaactagagaaaatagtcgggagagttgcctaattgttgccctaaactattgaactgttcacttgaaaagggtgaattttatggtatgtaaattacatgagtaaagctcttaaaaaaatttgcagggtgctatatactagattacataagactagagacaaaagctacccaaattttgcatagtactccattgctatcacatccgatcttgttttatcctcacagagcccctttaaggtaggtgtaatgctgtttttcctattttatagatgcagacatcaagggtcaaatttgtcccaaggtcacatagctagtagatggcacattgggtgcttcaactgccatcttctgacttctgtgccctagttttttgaaattcaaggctagattattggtgtttagcaagcttaattgaatgggtgttcagcagatattccacttggttagtagagcagtctcattcaaggcctggttccgtccccagtgtggctcttccagtagtccgtaatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagctaaaggggttatctgtaaaacgaagagttggactagctgagcacacctagcactcaaaatatatgacttaaacacccacatgcaggcaggcctggtgcacacacaaattatcctttgttatgtagatacgttcatgccaggttggctataaaacacttccagagatttccgtcaatagaagtcagaccagcccggcagcctccaccctaaatgccctgccatatttgtttggtctgcctccctgactccaaagaagcagcaggcagcttaatctctggacaggattcttcatgccactccctccactccagcctgtgttgtcctgactggccaggccagcctctgctctctggagaagcaatgaggtagggaagttaaccagcaagcccctctcctccatcgcctcactggagcttgagctgggtatctctccatgttttgccattagctttacccatccaggacaggggcacaagtgttggtgccaagccctgcactcccagctctggtggatggccaagtcctaccctggggttgaggactgtcagtgatactgagtaagggagtcattgcttgacaactgcctagagagatactttaaaagataggaatgggaggcattatttctacaagtgaacaagtttatattgaaggaacacttgtataggatcatcatggatgggacagttcatctccagtgcattctccaattctgaggatacatcactgcacaaactggactagagtttaaatggtacagaagctgggggtaggggaggcaggaggacaagggggatgggtggagaatgcttaacttggtgttcaaaatcatgttatttatgagccatgtgacctcagagtatctttgagcctgagttcacttacctgtaaaattctgctgtgctactgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgcttatggagctcctgaatggggtccaatttagcagttgctatagttgctgagatatagcacaaggggcatttttttttttttttagatggagtctctctctgttacccaggctggagtgcagcggtgcgatctcagcttactgcaacctccgcctcccgggttcacgccattctcctgtctcagcctgtagctgggactacaggcacctgccaccatgcccggctaattttttgtatttttagtagagacggggtttcactgtgttaggcaggatggtctcgatctcctgacctcgtgatcygcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaactctttagctgtgtaactactaaattctgggtagaagccaaaacaatcagcacttctcatttctgaacttagataatccarttgtactccctcagctcattgtgagttttgacaagttctgcatccatgaacaccagatgtaatacaatagggaatttcaaaggaaggattacacacctaggctctgccctctaggattttaccgtcttacaagggagttgagacaaaagtgagaaaatactctggcaacttctcccaacatcacaactttgcaattctcataaattttgcttgatcctagggcatgaccaaggcagaggcaggcaggtcctacttcatgtgggagagaaggaaggaagggtaggcagttagagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcactgaggctgttgggcagctagtggaaagtgctgctggagagaagctggagatcactgaagctgagagaggggtttgtggatataattagagcagtgtttctagggaggtgcaggtgaagggactgagagagagatgaggttaaaaacacagaagagaaagagatggaggtgtggaggcccctgaggtggagcagctgcagaggcaggcctgggggccaggaggctggctctccactttcagctgttggtgagaagggagtgaaggctgagcagctcccattgtgcagctgttgagtgcacaggtgctcgtgctcttgcacacggtggggtttggggagggtgtgatgctacagggaggactttcatgatgcagctgattctcttttattgagagtctgtttctggagtcacctgctctgttttgaatcctggctttgccactgtgaccttggacaagttgtttagcctcagtgccttcgtttctgcatctgtaaaaggggtataataacgcctccctcatcaaactgttgtaggattaattgggttaacatattgagaggtgacagcgtgctggcagtcctcagagcccttgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcaggaaccggggctgtgtgcggcacttgcgggccagctggagttccgggtgggcgtgggcttggtgggccccacactcggagcagccagccagccctgctggccccgggcaatgggggacttagcacccgggccagtggctgcagagggtgtactgggtccccccagcagtgccggcccaccggcgctgcgctcgatttctcgctgggccttggctgccttcccacggggcagggctcgggacctgcagcccgccatgccagagcctcccaccccctccgtggcctcctgtgcagcctgagcctccccgacgagcgccaccccctgctccacggcgcccagtcccatcgaccacccaagggctgaggaatgcaggcgcacggcgcaggactggcaggcagctccacctgcagccccggtgcgggatccactaggtgaagccagctgggcttctgagtctggtggggacgtggagagtctttatatctagctcagggattgtaaatacaccaatcagcaccctgtgtttagctcaaggtttgtgagtgcaccaatcaacactctgtatctagctgctctggtgaggacgtggagaacctttatgtctagctcaaggattgtaaatacaccaatcggcagtctatctagctcaaggwttgtaaayacaccaatcagcaccctgtgtttagctcaaggtttgtgagtgcwccaatcracactctgtatctagctgctctggtgaggacgtggagaacctttatgtctagctcaaggwttgtaaayacaccaatcagcaccctgtgtttagctcaaggtttgtgagtgcaccaatcgacactctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgtatctagctcagggattataaacgcaccaatcagcaccctgacaaaacaggccactcggctctaccaatcagcaggatgtgggtggggccagataaaagaataaaagcaggctgcccaagccagcattagcaacccgcccgggtcctcttccatgctgtggaagcgttgttctttcgctctttgcaataaatcttgctactgctcactctttgggtccacactgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgtgaagagcatttaaaatagtgcctaagcctaggacaccgccagtgctttgtaagtctttgggtcctgctggcttaggttgcttctttcggcaggatgactttttttttgagaccagttttcactttgttgtccaggctggagtgcagaggtgctatctcagctcactgcagcctcaacctcctgggttcaagctgatcttcccagctcagcctccggagtagctgggactatgggcatgtgccactaggctcggctaatttttggctgttgttgtttttgtttgttttgtttttttgtttgttttttgagacagtttagctcttgttgcccaggctggagtgtaatggcacaatcttggctcaccacaacctccgcctctcgggttcaagcaattctcttgcctcagcctcctaagtagctgggattacaggcatgcaccccccacacctggctaattttgtattttcagtagagacagggtttctccatgtcggtcaggctggtctcgaactcctgacctcaggygattcacctgcctcagcctcccaaagtgctgggattacaggtgtgagccaccgtgcccggcctgttgttgttgttgtttttaagagacagggtttcactgtgttgcccaggctggtctcaaactcctgggctcaagcgacccacctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaacctctttgccgaggtctcaagcaggtagaagacattaataataattccttatatttgattgcgtggtgctctgtagtttactgagtacttactatatatgtacagataggcccttatttgatcttcacaggaacctgtgaggtaggcagagcttatgagcttcatttcccaggtaggaaaactcctacgtggttacgtaacctgctccaggtgtgatcccaggtgcaatccagctcaacaagcacactgagcctcaggagctcttgggatcagaacccaggactcgatcccactccgtgcygccttctcacccacccctcttccaccaagtgggtggaaatagcacttgctttgaaataagtaacgaatgatctttgtgaaaaggaacctaaacagcagtgggccatctttattcacatctatagtaccaagtgctgagtaaggggattttagactccagacacccgtcctgtttgtcaggccagagctgcagtgtgttgactgcacatctgtctcttgtcactcctgctcctgtgggtaaccagccagagtgcccctgaggcagagacaggccaatccctggagagttctgcgaggtctagggaagagttctttgtatttaaaatttcatgtgaacttcagcagtttcctctgcctctgtagtcagcttttgccttttcaaactttagttagatggataatgacttttactcattaggacttttttccattagttggaaacccagagttgcaatacgtttcttttttccttagaatcaccgggtttatgggaataacaattgggattctctttatataaaaatagtggtggaatcttggcacagggttcatatgtggctttgttgaaggcttgttgtcacttccttatttgtataatttccctcctttgtggcctaaacatgactttcaaagagtcaagaggagttaagtcctaatttttattttagaacatctgaaaaatgaattcagagaaaagtgatattgatgccttggatttccccacacatacaaatcccaatctcctgctgactttttctcatgtttttgggcttcagggactgttgtgggatttgtattttgatactgaaggaccaacacagactgacttagcttcttgcctgtgtgcaggtcatgtgccactgtcactggagagaatttcatgttgtgacttctgttcagatttgttttttttttatggctttcccatcagggttcttgggagccatggctgcttcttgatatcttctgtttccctgtagaacagacgattgcaggcccggggccctggcaagctgggccctctgtggctttctgagtccattgtgaggcagaggatcaggtgcgttttgggcagcagccttcagagcaaggcactgacctgatgattcacactgacccctcccctccgctgaattttctgacaaccttgtgactctcacatgggaaatgtgagtggtttttgagaaatctttacataagaggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaamctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgttcgtttcttttctgtttttgagacagaaggagccttgctcttttatcctggctgaaggctagagtgcagtggcacaatcacggctcactgtgtcctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattgaatcaaacaaacaaaaaaccctaagaagacataaaatgattgtcaggagaggagagaaagcttccaaataaaaagaaaattagaaacatctctacttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactcygtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacatatttttatttattatatgtctatattatatgtatattatatatttatacatatatgtatacatgtaaagtaggtgaatatatatttatgtattaaaaatacatgtatgtataatgtgtatgcatgcgtgtgtgtataatagagacagagtctcactctgctgcccaggctagagtgcagtggtttgtggtgtgatcacagctcactgcagcttaaacttcctaggctccagtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaactcctgacctcaagtcatctacccrcctcagcctggttattacaggctgggattacaggcatgagccactgcacctagcctaatttttatttttttctagagatgagggtctcactatgttggccaggcctggtctcaaatgatcctcccaccttagcctcccagagtgctggattataggtgtgaaccacagttcccagccagttttttttttttttaaagtcagtttttgttttgttttaagaaagcactcttacaatttgtcagaaataaagagaaaaacaataattaccagacttggttcacttcccagttgcattcagagttgatgcttggtttcctctgcgatgttctcaccctgcagggtgtctgcactgcggccaggctcctttcaaacttgagctgtgcactgtggggaagagaggttcctaggggtcctgctcaggtgcctggcctgagactctcatcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtgaaaaagggcttggtaatagatgttcttctctaggcctagccagcaattctcaaatatgcaaaagagcaagctggtagtggtctttagaacagcagattgtggtatctttctaaatttttcagacttcagcacactgataaagatgtttgggaagcaaatattaaaaagggaaaatgcttctctgcacaaatatcactgcaggtggtgatagggcacaagttggcttccagtgaagaaattctgcttcttaccaaaagttaacaatagagaatggaaaaccaccactaaattgttttttcagaacaacaaaagttgaggctgtaattgggccagcatatcctatgaaaggcttgtgaacattgatggaaccaaattggagccttgtacactcagtcaaaacacatttatttaggatccaccgtaggtgaggcattatggacatacggacataaacataaaaagatagccaacctttctccatattatcagaggtaccaaagcttgatttataatagcaaacaggagaaacaacctgatatttggaaaaatatacagctgtcaaaattagtgattgtgggcattaaatgtagtaacatggaaaaggtttgaaaactgtgtaccccaagagtgattcctattagaataatacaattgtggtttctggctttgttgcagtaaagcagtggggctcctgaaagaaagagagtctgtgcttctctgtctccttcactagaacagagactcttgaaggccaggacacacttttttcattctttgtcttacatggtcactgggactgaatcggagtctaaagtaatcttgattgcaagaatgcaagtctaatgaaacagcttttgcaagtaacagtggaccaaagggaaaagagagctcttttatcatgtaacaagtcaacattaggagcttaaactttgaacctgaaggatagcaggcagcttatggttcttgtgcagttgtgtgctcctgaagtgcatgcagccagagaacaacattgctgttctctatctttacaaaccatggggatttctccttgtgtttcaggagggcctagtgattttccggggcttgaaagaaaacctttcaataggttataagatgaagattctcataattctcattattttattttcttcttaatcaaaactgtcagctggtgcagcgctcatgtcgataatcccagcactttggaaggccaaggcaggagggttgcttgagtttaggagtttgagaccatcctgggcaacacagacccacatctctacaaaaacattttaaaaattagccaggtgtggtggtgtgcacctgtagtcctagctacttgggaggctgaggtgggaggattgcttgagcctaggagctcaaggttacagtgagctgtgatcacaccactgcactcagcctgggcgacaaagtgagaccctttctcaaaaaataataataattgtcttcctgatgctccaaagtccctttactctaggtcagagaatgtatgtctctaaattataaagtgcagaattcagagaagcatctctctctttttgaaattataattggacacaataaatgcagaaagtaattagggcattttttaaaggtgtgcctttattttaacatgaagttttaagtttagaattgctggtttttaatatgttctcttggtaatttgtcactttacagtaagtttaaaatattctttgtctatttaaaatcgttcttgctggccctattatgtgtgagatcatgcagaatataatttacttttcctttagatgtccatcctgtttttataacctactgaacctgttttgtgagctgacaygtagccctygacagagtcagtttttgaatgttacagctactgaagattaygttgatcctgttacaaaccagaygaaaacaaatgtgaaagagttacaatactacgtcggacagagttttgccaatggtaagtaaacttttaattattcctcttttacagctggcatcaggacagcagagcaaattgttccttttagttgtcctgtcaactctggaaaatcacaattttcagttccattggccaggaaataagagttgttgctttgcttgtatcctaggacttgaactgcaacgaatataaaaatctccttaaagcgcttgctttaactccccctaactttaacttcccacatggaaaattttagtatgtgcaagtttgcatccatacacttcagtaaccattggatctttgactctaacagacatgagttgtgtaatgtcataaattactgcaagactgagaagatagaactgttaatagttggcagagaagaggtcatgacttgcaagaatcagatcaccataaaggaaagtcagcaggtctaacagatagcagaaatgatcccccagcattgaccaacatacaacatttaattataatgacaaagtaaaaaggtaacaaaaaaattccatagaaaaaaggtctcattcacaaaagcaacaaaaaataaggcacttaggaatccaaaagatgtgacatacaaggcaacctgactgaatggagagaggtcattttgtccagaaacagaagcctgcatgtatggaaagtggatgtgtaacacgtgtgtcattacaaatcattgagagaaaaggtgggctagttgataaatgagatgagaaaatagattatatttatctaattttaatttttacagaaaataaaaaaatcaattgtgtagattaaaaatcccaattggaaagttttagaagtaaatatggaaagatttctagacaggagaggaaaagcagaaaccataagaaaaatatttatgaatataaacaactgttatctagagcagacagcgaaatgcaaatttgaacagtaaactaccatttcacacctcatcagcttggcacaaattaaaaagttggtcaatttcaactgtgggtgaaaatgtgaagcaataggaatactaatgtactccaccacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagatacctcaccaaagaaggcatacagtggtaaataagtacatgagaagagatgctcaacattatgtcattagagaattacaaattaaaacaacgagataccactacacatctattagaatggcaaaaattcaagacgctttcaacaccaaatgctggcaatgagctctcattcattgatggtgggagtacaaaacggtacagccaccttggaagataatttagcggtttcttacaaaactaatcatactccttggtatttacccaaatgagttaaaaatgtgtctaccccaaaacctgcacgtggatatttgtagcagctttgtccataagtgccaaaacttgtaagccaccaagatttctctcagtaggtgaatgggtaaataaactgctacatccacacagtggaatattatttggtgctaaaaagccatgaaaattcagtgctatcaagccatgaaagtacatggatgaaccttaaatcctattactaagcaaagccaatctgaaaagactactcactatgattccactatatgacgttctacaaaaggcaaaaccgtggagacagtaaaaagtcagtgattgccatgggttaggagagaggaaggcataagtagagcacagaagatttttaggtggtgaaaatactctatatgatactataatggtggttacatgtttatatgacattttgaaacaaaagtactacatacttaaaacaagtacacaaacatgcatgggaaggataaacatcaaattcaggattgtgtttaccttagggaaggggctactgtcagggaggggtaattggggagcttcaactgaatctatagagtgtgtgtgtgtgtgtaagtatttttttawtttttkgaagagacgggcctcactgtgttggtgaggctggtcttgaactcctggccttaagtgatcctcctgcctyggcctgccaaagtgttgggactgtaggtgtgagccaccacacctggcctatagtgsattattatttttatttagtttttaaattatgccatagccagttgttytgaatagtgcagtactacaaaacagagtcaaggtctcatgctgtcacccaggctggaatacagtgatgcaatcatggctcactgcagcctcaacctcctaggttcaagtagtccccctgggtagttggaaccacaggcatatgctaccacacctagctaattaaaaacaaatttttttttgtagagatagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtgttttgtatgcttgaaacataaaataaaacctgaaaaccaaatggtgagctggaagatacgagggaattactcagaaaacagcatacagatacaaagacctataaatcattaaagaaatgacatataacatgagaagctccagagagttggggagagacaataataatcaaagggataatgaggattttccagagtggataagggatgaaccctgagaacttagagaaaattcagcatacaaaaatcagttgtatttctgtacacttgcaatggacaatctcaaagtgaaaataaaacaattccatttactttagtatgggaaatacttaggagtaactataacagaaggcaaaacactttaaagaacagccgggtgcagtggctcacacctgtaatccaagcactttggaaggccgaggcaggcagatcacaaggtcaagagattgagatcatcctggccaacatggtgaaaccccatctctactaaaaatataaaaattagctgggcgtggtggcgctcgcttgtaatgccagctacttgggaggctgaggcatgagaatcacttgaacctgggacgcggtggttgcaggagctgaaattgtgccactgcactccagcctggctgacagagcgagactccatctcaaaaaaagaaaaacagaaaaaacacactaaagaacattattcagcgaaattaacgaggatctaaataaatggaaagacattccatgtttatcaatcaaaagacttaatattgtttagatatcagtattctccaarttgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatgaaattgggccctacttcacaccatatgttaaagaaattaactcaaagtggatcgaagacctaaatgtaagagctaaaaactataaaacaataaaacatagggattaatttgcatggcctcatatttggcacttgattcttaaatatgacaccaaaaacaagagcaataacagaagaaaagattaattggacttcattaaaataaaaaagtttgtatttcagaggacgccatcaagaaaagacaagaaggccgggcacagtgactcacacctgttatcccagcagttcgggtggctgaggcaggaggattgcttgagcccgggagttcaagaccagcctgggtgacaaagtgagaccctgtgtctacaaaaaataattagccaggcatggtggcatgtacctgtggtcccagccacatggttatctgaggcaggaagattgcttgagcctaaggaggctgcactaagtacctcgcactccagcctgggtgacagagtgagactctgtctcaaaaaaaaggacaagaatatatttgcaaattgtatatttgataagggacttgtatctagaatacataaagaactcttggccgggcgctgtggctcatgcctgtaatcccagcactttggggggccaaggcgggtggatcacctgaggtcaggagttcgagaccagcctggccaacatggtgaaaccctgtctctactaaaatagaaaaattagccaggtgtggtgatgtgcgcctgtaatcccagctactcaggaggctgaggcaggagaattgcttcagcctgggaagtggaggttgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcacttcggacggccaaggcaggtggatcaccttagctcaggagtttgagaccagcctgggcagcatggtgaaactccatctctacaaaaacttagctgggtatggtggtgcacatctgtagtcccagctacttgagaggctgaagtgggaggatcacttgagcctgaggggcagaggttgccagtgagctgagatcacaccactgcactccaatctgtgtgacagagtgagaccccactttggaaaacagtttggcagttcctgaaacaaacatagaactaccatatgacccatcagttccactcacaagacgaaagtataggtcaacacaaaaacttatacacaaatgcttctagcagcattactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccattaaattatatagtttaagggggtaaattgtaaattacatgtaattatattgtaaattatatagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaagacacaaatcaccttaagacaatgataattggagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtcttgctctgtcacccacgctggagtgcagtggcgcaatcttggctcacttcaagctctgcctcccgggttcatgccattctcccgcctcagcctcccgagtagctgggactacaggcgtccgccaccacgcccggctaattttttgtattttcagtagagatggggtttcactgtgttagccaggttggtctccatctcctgacctggtggtccgcccacctcggcctcccagagtgctggaattacaggtgtgagccaccgtgcccggccaacagtattaggtttattgacacgtgacctctgctctaaaaccagttttccaagtaagttccataattctctggctgtgtagcttcctgcggcagaggttttctggaaccagctttgttaactgaagaagtactgaggctcttagctgcgtcttcctgggccttggtatactcttctatatagtggggatttgacttctccaagctgttgtgagagctatgagataacgtgtgcctttccctttcctgtctgttttttacttttaagttacttggaatcgggcctccatattatttgcagggtgataagccaatttaaagggaatctctgttcgtgcccttagttagtgtttgctgtccagcattccagcatggtgcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgkrtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactgaggcaagagaattgcttaagaccaggagttccagaccagcctgggcaatgtagtgaggccccatctctatgaaagaattaaacattagccaggtgtggtggcatgcatctgtagtcccagctacttgggaggctgaggcaggaggattgcgtgggtccaggagttcaaggctgcagtgagttacgatcatcccattgtactccaaccttggtgagggcaaagccctgtctctccatgaatgaatgaatgaatcttagttgaggaagcataatctacaataggaagataaacacattcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagctcctgagaatggagatgggacatgattgaagggttgccttggtatgtggtgtacttggaggattcctctatcagtgacaaacccctacgcgcaagtttattgaggtaacttaaaattccataggacgaagcagcaaaacataatttaattaaactaaaacctccaattctttttcttctttcagttgttttatgtatttcagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgkggatgaggtcacagcaycatgtagctgccaavactgctctattgtctrtgkccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtgtcctacagctattctatagtaaaccatcaaagttctgtttaacactgcaacatctgaaatgaattttactgatttattcaaaatgatgtgtgatttaaagcactgtgcattagccactgattctttttttttttggagactgagtctcactcttgtcgcccaggctgaagtgcagtggtgtgatctcagctcactgcaacctccacctcccaggtttaagcaattcccctgcatcagcctcctgagtagctgggattacaggcatccgccaccatgcctgcatgcctgamtaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtggctcacacctgtaatcccagcactttaggaggccaaggcaggagaatcatgaggtcaggagtccattgcaaacagccctggcgacagtgcgagactgtgtctcmccaaaaaaaaaaaaaaaaaaaaaaaagtcagagtcaaatgagcgaaatcagattcaaatctaattaaatggagtactatagtccttttagatatttgcatcttaatttaggacagtactttttttactttttattttgaaataattgtagacttaaccaaaaagttgcaaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgatgagttcatgtcctttgtagggacttggatgaaactggaaaccatcattctcagcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatggcacacgtacacatacgtaacaaacctgcacgttgtgcacatgcaccctaaaacttaaagtataataataattaaaaaaaaaactcatagtacaatgatcaaaaccacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtctgctggctatctccactgtgaagttactgcttttcccttcgtaattgataaatatcttgggggaagatgctttgagactatactaatattttgttcctcctgaaactcaaccactgattttagcattcattgttgggtcttgtctgcaacmgttataactaaggtgtttgcctgatagtgattttyttctctttccctctcttcctctgcatttactaacyggacttctgtacagaaagctatcccttctccctcatttatttactcagttatttacatcatggacttttaattctgtgggttgtatccaacactgtcatttatcttgttactcaaagttttccactttgggccattgggagtgccttctggctggcttctgtgttcttacatacacctcccatccccagctttatcttacatattccctgtccctgccctgcaaggagctctggttccttttattggagaatggtatgtagaaacgragatctgggcactaggtaygctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagytgacytctggtcagcccccagcagccagsctygcctggaaaaagagtactttgaccagcactttgggmctttcttcyrgacggagcagctcatcatccgggcccctctcactgacaaacacatttacyagccatacccttcgggagctgatgtaccctttggacctycgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagtgaatgatgttgaacttaatggaatatttatkgttgctcacttttgtatttacttcagatagtagaccttgcctttttcttgaaattgagatgagcagagaaagaagacttcagtggcgtttctctattgaggcaggatatatttattaggaagtcaccttaggaatttgtgaaatgttttctgttggtaactgaaagtaatatgcaaggacccagaggcatgaagcccttactgctgtcctgggggctgaggaaggagctgccagattaccatccctgatccaacctgtaggaatgaacttatcactcactgcctgaacatgggcacccagcctgtttttggtgagaggcgcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctcttycacygtataacacgaactgcaccattttgagtgtgttaaattacttccagaacagccattccgtgctggaccacaagaaaggggacgacttctttgtgtatgccgattaccacaygcrctttctgtactgcgtayggtaagtggcaagagacaatcattggtagacaccattcttgggtctgacttagggtacatgggcaaaagcttgttttatgagcataacccagaggtgagcaaacaacaagaccttgccctgtgaagtttacatcatctttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctctcgtggtgtgtgattgaggagtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcagctccgcagctttagattggagggccctgcagctgcttcccttaggaggcatgtctagctgggcagggtgcgtttataattgggaatagtcaccccaggaagcggtgctttggtgacctgtaggggaatcttaaggcttctcccagtaggggaagagtagcatgatgccggatgggcctactctccctgaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggagtaagactttttatgcagttgggctatatttactctgtttcaagaatatcacccctaaaaacatgagttatactcatgaaaacacaatagcttatgctccataccctaaaccggcattctccacagggtagacggtgcagacgagccatgggtaatttgaagaaacaaaaaacatttaatgttacataatttttataattggacaaccatttaatgttacataaattttatagtttactctctgtggcacaagataaaagtcaacaaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaacagctcatgacatttctttcccrgaaatctctaattgttccccagtgcctccagaataaaaatccaaactacttaactggcactgagtccttttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcctgagtacttgagattaggygtgccaccataccyggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctkcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttycccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactarccataggggaaacaattgactttgatctctgacttgttcatttcaccaaaataaattccagatggataaaagattgraatgtaagaactgggccaggcgtggtggctcacgcctgtaatcccagcactttcggaggccgaggcgggtggatcacaaggtcaggagatcgagaccatcctggctaacacagtgaaaccctatctctrctaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagtgagactccatctcaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaaaaaaaactggacaaaaatattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagccaagatcattccattgcactccagcctgggcgacaagagcaagactccgtcttaaaaaaaaaaaaaaaaagttgtgaaaaaaagatcaacaacctgaaagaaaagtgggtgaggtcatgtgaaagataacaaaagaagaaatacaaaaaaaaaaggtttttattttatttttcagagacagagtcttgctctgttgtccaggctggagtgcggtggtgtgatctcggctcactgcaacccctgcctcccaggttcgagcaattcttctgcctccacctcctgagtagctgggattacaggcatgtatcaccaggcccagctaatttcttgtatttttagtagagacacggttttgccttgttgcccagactggtcttgaactcctgacctaaggtgatccacccaccttggcctcccaaagtgctgggatcataggcatgagccaccacgcccagcctcagtaaatattttcttgactaaagtaatgaaaagggaggccaaggcaggaggattgcttgagcctgagaagtcaaggcttcagtaaaccatgattgtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattrattgagttcgggtggtcaaggccacaaaaagccgcgattgcaccactgtacttcagcctgggcaacagaacaagacactgtccccctgtcaggcccccaccccaaaaaaagaaaaaagatttatttctacaagtatgtgttttacacattaaaatatttataggctatttatagtaactttgtaatagaaaaaattgcaaaactactcatcagttgggggggattggctaaagtataccagaaaatactgtaggaaaagaataaggaaactctttatggagcagtctccaagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacacttttctgttctgtttgaaattgttaacatgcatgtactgtatcctttaaaaaaaaaaaaaaaaagagttactcttcctgaatgataaccatgcctacctcagataaaaaatcctttttattcattaactgaagtacataaagactatttcagcaaactcttgtttaattcttagagcccagagatacagtccatagctccagtgagaaatctgtgttgtgatttttcccctggtatgtgtctaattttctgcatgcttgtaatctgctttttgatgtcacatttttcctttctagatcaaaactacaataacgccactgcccttgtgattaccttccctgtcaataattactataatgatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaacacatttacctttgagcaggtgctttaaacagctctccctccacaggaatgcaaaagtgtgcaaaaaaaggttccttgcattgtttttacttatttcatttattttttgagactgggttcacttttgcccaggctggggtgcagtgactgaatctcagctcactgcagcctcaacctcctaggctcaagtgatcctcccacctcagcctcctgagtagctgagactacacgtgcatgccatcacacccagctaatttttgtatttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttcttttttttttttttttttttttttttttgagacagagtcttgctgtgtcatccaggctggagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcatggtgcctgtcatcccagcacttagggatgtggaggcaggaggaatgccttgaggccaggagtttgagaccagcttgcacaacatggcaaagaccccatctctacaaaaaatttttaaaattagccaggcatggggatacgtctctgtagtaccagctactcaagaggctaaggcaggaggatcccttmagctgaggagttcgaggctgcagtgagctgtaatagtgccactgtactccagccgaggcaacagagagagactctatttcaaaacaggaacaaaagcaaacaaaggatcctaatgcaggataaaggttaagaaaacatggcctttgagccgggcacagtggctcacgcctgtaatcccagcgctttggggaggctgaggcaggtggatcacttgaggtcaggagtttgagactagcctggccaacatggtgaaaccctgtctctactaaaaataccaaaattagccgggcctggtggcgcacgcctggagtcccagctactcrggaggctggggcaggagaagcactcaaacccgggaggtggagcttggagtgagctgagattgcgccattgcacttcagcctgggcgacagagcgagaatcagtctcaaaaccaaaaaaaagaaaacgtggcctttgtatcgtgaaagttagggagaagtttcttacttagctgtcagttagtttaactaaaaatataacattttgcttaccttttaggtttattaattttgtgaaaaactacaagaatcccaatctgaccatttccttcactgytgaaygaagtattgaagatgamctaaatygtgaaagtgacagtgatgtcttcaccgttgtaattagctatgccatcakgtttctatatatttccctagccttggggcacatsaaaagctgtcgcaggcttctggtaagccggggggkgggtggtgtatgttctagaggttaacagcagtgcacagtgtaacgtcatatttttgcctctttattcttattccatyatgtttaaaactgccataaattcccccatgttktaattgtatgtaacgtttctgttgcctacatctattttcttcattccaactttttgktttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattsgaaggtctcactaggcatcgcgggcatcttgatcrtgctgagctcggtggcttgstccttggktgtcttcagctacattgggttgcccttgaccytcattgtgattgaagtcatccygttcctggtgstggctgttggagtggacaayatctycattctggtgcaggcctaccaggtatacttccatattctcacagggctcagcatctgttcaagtttcagggactgtgaatggctcctgggctccgcattcgtgagtgtgacctgtgagggtgttttgtttcctttccctgtgtggctcatcggtcgtcttgacttgctgtggacatcttaggaccaagaatttcacccctctttttggttgttgaaatagtagatataaagtaagaattgtgttttaaattgtatctttaaatagtgtcttttaatagtatcttttcattttaaatagtatcatgtgtacaagaagggctaacacacttttggaaaagattttgggtacgactgctgttaaaatgatgttcagcatagtatagaatgttagattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataatttttttttttttttttaagagagatgaacgtcttcaaggggaaaccctggatcagcagctgggcagggtcctaggagaagtggctcccaktatgttcctgtcatccttttctragactgtagmatttttyttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattttgcaagtggcttccttctcatttaactgtcaggacagcattgatgttggggttcagggtgaaagagacctagagttcgtcttgccactttccccttttagtagccactgggaatgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgcagaaaaaaaaaaaaaaaagaaaaaactttctttttttcactactattataagaaaaccagtgcaagtgtgatgataatagcagcagagactgtgcctcaaggttggagtgaccttgggacagtaggagtgagtagggattgtggcaccccaactgcacgtgtcctatctaaaaagacagttatgtgtgtggccaacccagtgctacaaggtctgtgttgttgttgttgtttttcttccaagcaaagctgtgaatctagatttttgtgtaaaatgccattgttaaatattggcaacttataaaaaaaagttttttaatcttaagatgggttgatacagtgtgggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggyagtcttcattgactttcttctgcmgattacctgtttcgtgagtctcttggggttagacattaaabgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctattctccacttctgctaaaggactrgatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttccygtgagcttttatcagtccatataaacaagagttttmagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctcacccactgccctgtactccctattagcctgtcatttaagcttttccattttaaaaaatcctgctttttgtgtgtgcttaagattttatttctggtcgtaagcttatttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaacatgcacgtaggtgtttcaagcaagtgcctgcttctaactgcaaatggtgacagggtttccagggttaggagaactgtcgcagtgcactgctggtgtgggctgtctggcattctgactgagcccctctgggcacagctgcagaacacgaataactagtcttatgaggttactttatgagatgctctcctgaytgtgggkctagcaggaggagcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggwttatttcaaatccatcagtcagtacctgcatgcgggtccryctrtgtrstttgtcctggaggaagggcacgackacacttcttccaaggggcagaacatggtgtgcrgcrgcatgggctgcaacaatgattccctggtgcagcagatatttaacgcggygcmgcyggacaaytagtcagtaccaccttgtctygtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcractggrtgaagccacagtygtcttrctgtcgagtggacartatcactgacyagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtgtggtttccacataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggagatctacttcagggcagaaaatgatgcatagtatgcctaagatgaaaatggtatttcagattcattaaactgtgaaagtgacatgtggctgaagcttttagataaggggaaagattatccctcactagtraggaaagtaatcgatagagaagaaagtaatrcccctcactgtcagtattttaaaatgttttacaaaaaatctggagacctattcttctaacagtcctccctgcatgtctccgccagtggttgaccctgccygcgttygctgcaggcctctgactccggaargcaaacagaggcctcagbggggagacttcakgagattcctgcccatgttcctttcggataaccctaaccccaagtgtgrcaaagggtaagtgctgctgccattgcagataagcatccactgcaactttaatttgcagtagaaaactaggagaggactgggctaagacagttgcatgggaacgtctcttctccgccccaccctgtcctggtcctttggtggaagcaggaaaaccgaaaacacctttttaagaaaatgcctcatagtgttcaactgattctgtcttagcgtgggcattcacatctcatgctctctctgtgtcctggccccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccagcccatccatgtatagggttatgggctatctcactccccsatccagccaggcagccagttacccacggaagccagatatatggcccaaaaatagtgatgatgaccggaagtctctggccttgatttggaagctttkggaggtggaagatgagtatccccatgtatgttaggtaaaccctgaacttaggtttttcataagaacatacatctgaccagagtcatatcagtgaatcatttatatcatgcatgtgctttgagacctattcgaggtatcatgggatgactcctcctaaaagttaagtagaaatgaatcttgcagcttgatttactcactgactggatgctttggcctacgtaaaataagttgaagtagattcagtttttctgaaggcagtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacacctgtaatcccagtacttttggaggccgaggtgggcggatcacctgagatcacctcaggagttcaagactagccaggccaacatggcaaaaccctgtctctactaaaaaaatacaaaagttagttgagcgtggtggcaggtgcctgtaatcccagctattcgggaggctgaggcagggagaattgcttgaacccgggaggtggaggttgcagtgagccgagatcacgccactgcactccagcctgggctacagagcaagactctgtctcaaaataaaaaaaaaaagaagccagtctgggagagaacaagctaaacctttgsygttcccttatctgggggccttcttcatccctgaaatgtacagctgggtctgacctctgagtccagggtcaggtgattttgcttagcctcaagtgctcagattctgctgatattttgcaagacctggactctcttgacacccaggattctttcctcaggggacrtgctgcctatagttctgcagttaacatcctccttggccatggcaccagggtcggagycaygtacttcatgacctaccacaccgtgctgcagacctctgctgactttattgacrctctgaagaaagcccracttayagccagtaatgtcaccgaaaccatgggcattaacggcagtgcctaccgagtatttccttacaggtaaagcctgccctttttcaatggggtttacccagcaaagggcctacactgggtgggagtggggagggttcccttggcaagatgctgattttcaggttgggttctggcccctgctccattctgagcacagggcagtatatcaaaggaaatgggtgctgggcaaaggagttcagaatctaaagtctctgtgaaggcctgagggctagagacgcaaaacttgatctctgcgccactgcacagctgcaagagacacacactggaaaatggcttaaggcagggggcgcttggagagcaggcggctcagagcagggcccrgcccacattcttggccaacaatgaaccagaatccctaactgctggttatttgggatgctgcctgtatgtagactttttatattgttaggggttttttttcccaggaagaaaagtattatgtatgaactactgaatttagaaactgtagaaaggtaggagaaacaagtgatttatttttcctgcctccccatgatctcgcttaaagcaggaaggcctggatttgtttggaagaagttaagagccggttagctctggcagaaaataaatgaaagcatgttttcctcaggccttgcacggaccccgctgagcctgaggtagtgtctcaggatagatcaggattctttgtttttttgtgttttttcagaatgctgtggaatgctctctgtaaatgtctataaaatagcatagattgggcttataaacagaaactttatcaaaaatatacattttgcatcactgctgggcccttctctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttygggagtgagagcgagctttaatgagrcctcccctctcccctccagtgtgttttatgtcytctrcraacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcawcatgtttgkagttaygtrgctctggggcatcagtctgaaygctgtatccttggtcarcctggtgatggtgagtcctcatacagtctcagtttgtccctagctcctgtttcacttgggggaattggctgtcttagattccatgtaaaccctaaagatggagtaagataccaagtctggcgcttgctcttggcacacatggagaggcaggatgagtgctggaggagtgctggatggtggtgggacagggcatagagggagcgagcattgagttggacatctgggagcataggcacattacaggcaatttctgttcaattttttctcttgtcccattccttgcggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccrccccaggagctctccgaccagtgccttttgcctcctatgtggttatcaggtacttttaatcattaaagatgagagcactygagaaggtattcatggaaaatagaacagtgtatccgtactctcagatatgagccctgcttcagataggggagcactgaggtccaagaaaagaagttgtgacaatgcgccagctcggtgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcacccatcctcagaacggggtggctgcctagggtcttcaacaggaagagagccatcctaaaggaagtgctttatttcagagctgtggcatctccrtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcrgtggaatcacacttavaaaatttggagggattgtggtgktsgcttttgccaaatctcaaattttccagatattctacttcaggatgtatttggccatggtcttactggragccactcayggattaatatttctycctgtcttactcrgttacataggtaagagttctcatcttaaaagggtggcacaatrgaaggacattactgaaagggaattctatcctgaggcattcttttcaagtatttgaactcatactaatggtcatttgataatgataaatgatactgagtaaaaaaatttcttctaaaagaaaaaacccatccaggggattcatgatggtgcagactactttattaggaagttgtcgatgttttttctggaggcctgatctgtctgcttcacaaaggcctggagccagtccttgaatggatctgagtgtcagcaggcagggcagctcctccctgccactgagatgaaggagtccatctggcagccagctctcacaccagcagtgctgcagaacagctttttatgtccctcatggatttcccgtttcttagcaaagtgcttgctgcctttcttcatctcgagactgtccttgatccttttacttctatggccacttcaccttgcacaaaaatgacccacggttgaaagarcaatactgatttgcttcatttatagctttgtcactaaattgaascactgaagtagaagattaagaaaatgaggggctttttatcatctccgggggatagaaagtagttctattacaatctaatatactagttccttttaagaaaaaaaaaaaaaaaaaagagatgagcactttggaaggctgagacaggagaatcgtttgagaccagcctaggcaacatagtgaggcctccatctctacaaaaataaaattagccaggtgaagtggtgtgcgtctgcagtcccacctacttgttaggctgaggcaggaagcttgcttgagcccagaagggtgggcttaggatgcagtgagtsgtgttcataccrctgcactgcagcctgaggaagaaagcaaagagcccatctccaaaagagagggagagagatgtggtctcactctgttgtccaggctggtctcaagcaattctcctgcctcagtcttccaaagtgggattacaggcgtgagccactatgcccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagytgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcattagacagccctgatccttccctatcctaaagatgatgtcttaggttgtataactatttggagatgagaatgatcaaccagggccaggtgcggtggctcaaacctgtaatcccagcactttgggaggctgaggcaggcggatcatgaggtcaggagtttgagaccagcctggacaatatagtaaaaccccatctctactaaaaatacaaaaatcagccgggtgtggtggcacgcacctgtagtcccaactactcaggaggctgaggcagaagaatcgcttgaacccagcggaggttgcagtgaaccgagatcacaccactgcactccagcctgggcaacggagcgagactctgtctcaaaaaaaaaatgagaatgatcaaccaatgtatacttcataaaactgaaaccttaataagccccagaccctttaaaacccttagccaccatttgccgtcttattcctggctttaagagatattccaagatctgctataagagatgggctgtgcctgatctgggtcctaaatgtgtcttgactcaaaacacacctcctcggtgagttccagagcataattcagattctgtcagtatactgaattcactctactacaaataatgggccaagggctaggtgggctgttatcaaattgtgttgtttacaaaaatgctaacccagggtcctcgcccaccagctgccagtgccctctgctactctttgaggctatggttaccccaagtcttttcattgcattctcacctggtgtgaaattggggctccctcgcaaacgctggtttcgctgttcaaaaaagcggaatattgtatagaaaagcatgttgtcttcagtctgctttgcagcatctaaaaattttcgtgcagaaatgttgtcatggccaccaatgccccggataaaccttaaggcagctaacacttggtgtttggaaaggagaacttctactatttcatcatttgctgttgaaagtcgctagcagtaagggagagaagtccaggtcagtgcaaacaacaggaacagagttagtttccatagtctaaaacctcacacatcagagttaccttcagcatgtccagagatagctgatgagcaggaggatagaaactctctagggataacagcagacaagcctgaaagacatttttagacccacttcagttggaaagataacggttaaaattttccatttttaaccacaatggaagtaaaaatctggcaatgcataccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacacagtaaaagtctgtcattacaagaagtggtttcgtcatgcaggtaaagaccccaacttgaccktacacttcccattccaactaataatgtcaggagtcactcagcattctgagtcagggaggcagacctgtcttagcatatgagtcatcttctaagacagtgactgtgttttttttttaaattccttctgttttaacttgggcccagatgatttgaaggtacctgtactgcaatctgaaactggttaagagaacgaatgtattccatcagcacggctatcacaaatttatgaggcatctcctagggagaaaaaaatgtggtcttacaaataccaacgaggtgcaaaagaggctgcatataactcyctatccaacccccaccttgtttccatcttaaaatggcccagtgttcatctttcactggttttgcacamatcgctccagaaccacccgtcaacaattatgctttaggcctcagcattagaagccaaactaccagctctagggcctcacccaaggaaactccagtgattctaatcacttcaagtgactctaatcacatgaagtctcctcgttttcagcaacttccttgttttgagcattctcagtccagaagaggcggaaagctgcrgcccaccttcttttccacraaggctgacaggacatgggtgtacacatctgactggtccagcaccgcctgggtccgcaccggcctcttgaggagcgggctgcttcggytctgccctgcttccacygcctgaaagaaaaaaaccacaaactatgatcttcrgcatcttagaggaagggtgctgtttacagttcatccacaaggactgaattcttcgatgtggacccaggatatgagcggaaaacactttctctacttagatacaactttttcctgtgcgcatgcctgtaatcccagctactcaggaggctgaggcaggagaatcccttgaacccaggaggcagaggttgcggtgagccaagatctcaccattgcactccagcctgggcaataagaacaaaactccgtctcaaaaaaaaaaaagcagttcagatccgtgcagattatgcaatagctgtggggtgtagcctgagaacttgcatttccaagaaactccagatgctgctcatgtggctggtcagtggcccacactgctgagtcatgacggtttatggagcccagcagaccgtgtgggacggcacagaaactgccatttgggatcagacctactgattcccacagcccagaacacccacagcaatagagtccaaaaggactyrgccatccctcacgtctggcagcgtaggaatggacactgtcccagcaactggccctcttcagtgcctgtctcagacctcttacccttccatgaacagctaaaggggagtggagttctggggcttttgttggtttaaaaccattttcagcctaggactaatcagatcctggaattgaaataattcattctccttgtcctaaacttttcttctggcttcagaagatatgatgtacaagtaatacagcgggaattggtggcgataagccatggttattaccttgactacaaacacgcctgctaagtgctaacactgaatcgtcactatctcaacaggattctttcccaaaagggaagaaaggtgtggcaaatataaatatttctaatttaattttctaagtcctcactctggcataacagaaaaatatacaaaatattgcaaagcagagactgatttttctcatctataacagtagaccaaggatctacaggcaagatcaaacacagatgggaaaaacaaaaacagtgaaggtatgaagtgagatgcagccgccagctmgtgggatgcagggaccctgaatttactactcctccactatccmccactactgccaccttgccctatggcaggcggcaaatctcagcgaccttattctaatatataggaaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaaggcacaatgttcacacacggatcaaaccaacttcatgtcagcttcagaatttccacacgttgctatgataaaaactaatctcaaaaggttaccaatgcaaaagtacctttaaaggacactytaagaaatacaatactttaaagacctgacagctagatgtcattcgcaacccctttctggttacggttaaaaaaaaaaaaaaaaaaaaaagctatagcaggccaggctcagtggcacatgcctataatcccagcactttgggtaggccgaggcagaaggatcacttaacgctgggagtttgagaccagcctgggcaacaaggcaagaccccatctataccaaaacaaaaacaaacaccaacagcacatattggtaggggattattattattatttttttttggatacagggtcttgctctgtcgcccaggctggaggtacactgacacaaacggctcgctgcagcctcgtcctcccgggctcaaggaatcctccctcggcagcctctggagtagctggggccacaggtgtataccaccaaactcagctaattttttttttttttttttttttttttgkagagacagggttttgccatgttgtcgtccaggctggtctcgaactcctaggctcaggcaatcctcctgcttcagcctcccagagtgctgggattataagcatgagccaccatgcctggcctcagtaggggattcttaaagaagacacatatgcagtgagtggcttggattttgaaagaggtgtgtgtgaaggccaggggtggtggcccactcccctcctgtgtgcccactttcattcagaaccatcccatttattgttcttttctaccagtatctctacaaatcatctttccatttagcagcctttcctagggggtcacatagccacccctcacataaagaatgaggctgtgggtcacagacaagacacaacaatgtagcccacatcccgataaaaagtgttgggcagcacaggcctcacactggaatcagagcaagggggaaggattcaacttactctgtgaacagacagacaggatgaccatcttgcattcctttctctggaggagaaagtccatgagtcttcctttgtctggtaagagatttactatgggctcaagtttcacttggaggttccagaggtaacctggattttaagaggcagcaaataaaacagtatgatgcaaaccgtaacaaaagcccaaaagtggttcccctaaacatctgcggggcgggtggcaggtggtgataaaaagccgcaaagtacagtcagtgtagcttttccttcctaaccaaagcagagctgagccattcaggagcaattcaggagcgtgtctaccacaggaggatgacagcccaaccaccgcacacctggctgactcttttccaagtaacctctgcattcaggggcacatcaaaggtgtagctcctagtccttcattccaaacggggacttccctagacctagcccctcttttaacgtttaaaatagaaaaagatgtcaacacgtggcatcaacttcagtcctgtgctttggtttctcctacaacagctcattagtttaaaaggtaactccagaggctctcaatggaacatcataactcatccattcatcgacccataaatgtactgatcacccacactgccagcatctggtgtggcctttcccaattgggatgccacaggagaatgaagtgccacataaaaaatcatctgggtgacccccttttcagttggcccaaggcaggtacagagcagctgtacaggaaaacaccagcgagatgcacaggagagaaatgacttcattacatacatacagtggatgtcacatgaggctatgggttacagacaaggcacaacaatgcattacatacagtggatgcctacagcatcagggctaattctctcctcaagagttcttaggaattccagaggaaaggcaggaaaatacacagaggattaaagagtaacataggagattctctaataaccagcctggcgaggtattagagacacaggggcaacatggcaagaccctgtctctacaaaaaaaaaattataggccggctgtggtggctcacacctgtaatcccagcactttgggaggctgaggtgggcagatcacgaggtcaggagatcgagaccatcctggccaacatggtgaaaccccgtatctactaaaaatacaaaaattagctgggtgtggtggcgcatgcctgtaatcccagctactggggaggctgaggcaggagaatcgcttaaacccaggagt

SEQ ID NO: 13343 - DNA, 83528 bp, Homo sapiens
ccatgttggccaggctgatcttgaactcctgacctcaggtgatccacccgcctcagccttcacattgctttcttttttaaaaaaactccaaagacttgtcttttaatgcttggtctccatgtcacgaagcagtttttaaggttaccggttacgtggcttcgttggatagccagtcaccacatattatacaaagtgggctcagagaatgtcaataccctgttgcaatgagcttgtaatttaagtcagactcttggtattttcttttaaatgcagctttctttctgttggcagtcttagagccttctgctgtcacatcactcggtctttcccccttttcaaagaacctttccagtgacgtttgtttttcactcattttggctagggttagcctgtgggtttaccaaaactgtgcctgagacaagtatgcagtgcaggaaagaggcaaggaccaaagtggtaaataaaataatgggaaggccatgcatggactaaaataagtttcagagtctgacttaaagcctgccaccagatgcagcttgtcccttgccactcactgatagggttttggtatgagtctgcatgcaattgatttattatggtctctgtgcagccaaatctctctgccaatgttaatctgtatttgcagccactccccagcaccagtatctctgcctcagctccacttcagataatcaggcattagattctcatagggagtgcgtaacctacatccctcacatgtgcagttgacaataaggttaatgctcctatgagtattttttttttgagatggagtcttactctgttgcccaggctagaatgtagtggcatggtctcgggccattctacctcctgagttcaagagattctcccatcttaacttccagagtagctggattacaggagtgcgccaccacgcctggctaatttttgtatttttagtagagacagggtttcaccatgttggccaggctggtctcgaactcctgacctcagatgattcgccccgcttggccttccaaagtgctgagtttacaggtgtgagccactgcgcccagcctcctgtgagtatttaataccactgctgatctgacaggagatggaattgccattccagtggtaatatgcacagcaggaggccactcaccttctgagaacaataaataattgaagcgtggtgatctattcgagtgacaatacaatatttaaaaataaaatagccaaatgcaacaaaagccattggatatttctggaagttttgtatgtttgttattgtttatttgtttttaaaagtcaaggacacaagtcacctaaataattttctgtgctaaagcacaattaggtgacattagaatctgtcatctgagcacaaaagttagacagtaatctttactacctcttgtgaagataaaatagagtggttcactctattatttcatacctgatagtatgatgatgatctggagaactaataagattatttttgatgtactaggttttagaaaacagtaatttgtgcattttttgtgagattttcataaggaaatgggtttaatgtgattttcattatgaaatggttaaaagaaagacttccacagacattgactacactgatacctgcccttccataatgtagatgatgaacttagctttcaaaaacagttttckgtgatgaaaataatgcattccttcatttgtcaaaaaagaaacaaacaagcaaaccaacttactgaggccccacttagtgccattaggtccttgggatacagcaatgtacaggtcagaaagatctctgctctaagttttcttgtattatattaggggaaggaaactgataataaatacaaaaacaaacaagatacaattttagatgataagtttatgtgatagtgagtaattagttgtttgcataaaaaattctaccttccaaaatatcactacaaatactttagtgtttctcattctattatgtgtatgaaagcatattaaataaatgagatactattatacagttttgtaacctacttctttcaattaacaatatacaatattgcaagaatttttttcatgttattatatattctcccacaaaactgtttatttggctacatggaacgtactacttcgaatgaatataatgtaatttattcacattaatcacctagattatcccttatttttcctcattatgatcaaggatataatgaacatccaggttaataaatcttgtgtacatctataatcgtttcttgagaataaatttcttacatcaaaactgttgcctcaaatggttatttaaatttcaaaaattgggccagtcatggtgacacatgcctgtaatcccagcactttggcatgctgagactggcagatcgcatgaccccaggagtttgagaccaacctgggcaacatggtgaaacctgtctctataaaatatacaaaagattagccaggcatggtggcatgcgcctgtagtcccagcaaacctgggaggctgaggtaggaggaccacctgagcccaggaggtcgaggttacagtgacccacgattctgccaatgcacaccagcttgggttgacagagcgagaccctgtctcaaaaaagaaaaaaaatmaaaaattaaaactgtgatgtaccttttaaaatagttttcccaaaatgctgtataatttagcctccctctgactgtcgataaggtctttggttcacctcatccttaatagcactggatgatatctttttcctcccgactttatgggagaaaaaaactcattttcattttgacatctattatttttctttctctttttttgaagatacaattcatgtatcatgaaattcaccattttaaagtgttcaattcaatggttttcagtatattcacaaagttgtgtaataaccatcaccactatctaattccggaactcttttataggtcccaaaggaaatcccatactcattagcagtcactgcccatttccctctccttcagccctggcaaccactaagctgctttctgtttctatggatttgcctaccctaggcatctcatataaatggaatcatataacacctggccttttctgtctttttccactgagcataatgtttccaagcttcatccatgttgtagcacgtatcagtaattcatttctgtttattgccaaataacatttcattgtatggatataccacaattgatttatccattcatcatttgatggacatctggcttgtttccacattttggttattatgaataaagctgctatgaacatttatgtacatgttttcatgtgaayatatgtttccaattctcttggctacatacctaggagtggaattgctgggttgtctggtgactctgtttaattttagagttaactgtcagactgtttttatattgactacatcattttacctttccaccagcaatgtttgagggttccacttttaccacatcttcaacacttattattttttgttgttgttatttcttaattatagctatcctagtgggtgtaaagtagtatctcattgttgttttgatttgtatttctctaatgtctaatgatgttgagccccttgtcatgtgtttattggctatttgtatattttctttggagaagtgtctgttcaaatcttttcccatttgaaaattagattatttgtttgaattgtagggaatacaagttattttactgcgtgtagctgctccccaggtttctggatgccattgttaaaaaatatsatgacttagattttatccccgtgctcctggaatcctcaggtttctgtgacacagagttcaagtgagagttcaatcattctagggactactcagcaccacagtagcacctacagagatcatctggagggagtgattttgtctcaacagacggatcttcaatgaagatgaaacaaatccattttggaragagatgttagagaactgatggcgttcaggacatgctacccaaaaataatggtaccttggcacttaagaaaagagcagaagcaagagggttactttcactttccccagatcttctcttctgaggcagaccataagaccttcattccagaggtgccttccctatacctggaggaaacagacatccttatctctgaagacacacggacagggaaaagaatctgagcaaataggccttgctaagtaagtycccccagtttattaccattagatcacagatttgtccaatcatacttctccatgacttccacttctttatcaatcctagccttaaaaatacacaggcttccctcttaactttsggtcttaatttctgaagtctcctgttttgtgtaaaactcacataaataagttagtatgtttttctcttgttaatgtgtcttttgttacaggggcttcagccataaacctagtaatgaatggggaaattttttttttcctcctctatagaacatataccaactgcaagaagaaagaagaatatgcctggttttgggcctggcgcggtggctcacgcctgtaatcccagtactatgggaggctgaggcgggcagatcacctgaggttgggagttcgagaccagcctgaccaacatggagaaaccccgtctctactaaaaatacaaaaaattagccctgcgtggtggtggcgcatgcctgtaatcccagctattcggtaggctgaagtaggagaatcgcttgaacccaggaggtggaggttgcggtgagccgagatcgtgccattgatctccagcctgggcaacamgagcaaaactctgtctaaaaaaaataaataaataataaaaataaaaacagtatgcctggttttaaagcttcaaagaatttactcattctcctgtatgtaacattctagaawtgcatctggagttaaagccttcttggagacttaagaacaaatgcacttatgcatggccttttgaaacctaatgtttctacaaggaggcacgtccatacttgcaactccttctagaagcttccccaaatctcctgcctccccacgctgagttayccgatgtctgaaatgtcacagcacttagtcttactcttctatggcctactttctactgstatttgtgttactcatgctacccatcttatctccctcagtgtgtgagacgctggcatcagatttggcatctcccacacactcaacattatgtgttgcacacagtaggtactcaatacatgcaagttttctgaatagatattttcctagtcatctgtggcacctgctatatcctactgaaaattaccaaaatgcaattaacttcaattttacatttgggatttacagaaaataactctytctccaagaaatgcataacartttagctagggcaaatgccaggtccgagttaagacattaatgcgcttcgatcgcgataaggatttatccttatccccatcctcatctttctgcgtcgtctaattcaagwtaggtcagtaaaggaaaccttttcgttttagcaacccaatctgctccccttctctggcctctttctctccttttgttggtagacgacttcagcctctgtcctttaattttaaagtttatgccccacttgtacccctcgtcttttggtgatttagagattttcaaagcctgctctgacacagactcttccttggattgcaacttctctactttsgggtggaaacggcttctccgttttgaaacgctagcggggaaaaaatgggggagaaagttgagtttaaacttttaaaagttgagtcacggctggttgcgcagcaaaagccccgcagtgtggagaaagcctaaacgtggtttgggtggtgcgggggttgggcgggggtgacttttgggggataaggggcggtggagcccagggaatgccaaagccctgccgcggcctccgacgcgcgccccccgcccctcgcctctcccccgcccccgactgaggccgggctccccgccggactgatgtcgcgcgcttgcgtgttgtggccgaaccgccgaactcagaggccggccccagaaaacccgagcgagtagggggcggcgcgcaggagggaggagaactgggggcgcgggaggctggtgggtgtsgggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatcygtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacagtgagtgccgacccgctctctccgcctcatttccatttcgtgggttctcgcccgctctctcccctccagcctgcaccctcctcccggatcttcactgcgaccctagcgstccgtgtggtttctggccgcgcggccctcggcggtttcgggttcaccactcaccccctcctttccgggctgcggcgtaggcccgggtgtcccctgggctttggggtgtgccaatttgycctgtaaaccagtacccccggcccggagccgcggcgcgccggggcctcgcggactggctstcttcccgcggacaacctgtcgcgtcggggatgcccgcggccccgccatgcagctctggccgcttctatctgctgcgtgctgtcccggggacaaagacaggaaggaccgcagcagaacgaaacggtctttactggaaaaacacctttctagagtcctgcccttaaattccgactcgggacgacccgaggcatatggcacactactctcacccactctgttttatatttttccgaattgacgaaagctgaaagagcaaaaacaaaaaccaaccagccaaccagcaaaaaatccagatgttgttaataaagtgccatagctttgtttcagtagtgaaaagaagtgcaaacactttaatcttccacctgcagtgactagctttgagaccttgagccgacgctwaaccccagagccggtttcctcatcgctcacgtggggctaatayattactaccttgcagcaggcttgaggatgaaatgagaattgcagttttgctttctgtaagaaacaatgtttgtggttctagaaagaacactggcctaaataaggagtgcttggactttaggggattccctaagtctggagtgggggctgaagatttgcatttctaacatgttccccggggatgctgatcacatcacactttgagagccactggtctagaggaaagagaaagaaaggggcataagatgagccgatttacaacactgatggaatttgaagtgagagaaagaggactagaatatattgtaacctgtcctcctgtaagtgtatgtaaacatgtgttttaaaagctgtgtgttatggcgttccttcctttatgggttccaggtggagaatctgattctctcattgcctgagaaaagacccacwggggtcccagcgccactcccctgtagttctgcctttgtcttgggatgctaatgggatgtcatgaggggaggtggaggggggctggaagagaagaaaattctacaaccaaacgtgaattggcagaagaatgggcaatacactttcatatgagctgagtctttattgcttccaaaatagcaacctgcaagagaggcaagtatttaatktttttcaggcttgccataatttaaaaattttatcaatcacttaatcccgtaaaactgaaaagatgcttgtaacctattasatgggttagtgctagttctctattctggtaacttgaactcatctatttcaaaaaattatctttgtgattgaagtttgttctgcagttgtctgctacgccatctcagctgacaagggcaaggtgctgtgtgtcccaattggttttgttctttctagtatcacaaattatttattaaaaagcatgtattatgaccagaagacagaagaatttccctttaaattaaattaatatttggggcttcccctaatactctttttttttcagactctattagttgctgaatcattttttctttgaagattttgatacccgattygccttagaataaaactatgtagaggttagccagtggacataattttgaattgcataccacattaccaccgttgtaaaaacaaccgttaactttttcttcctaactgtgagttgggttttcatttttgtaatcttactttaactctgtggttctcaaatggggacgattttgcctcccaggggacatttgacaatgcctggagacatttttggttgctgtaacctggaagggtgctactggcatctggcaggtagaggccggggatgctgctgaacatcctacaatacacattataataccctcarcaaaaacatttttgaccccaaatgtcactagtactcaggttgagaactctgctaactttataactagctaaggacaagacattaaaagggaaatgtagaataactcatccagacttgtggagactaccaatttttttaaaattttttatttctatagggttttagggaccaggtggtagttggttacatgagtaagttctttagtggtgatttgtgaaattttgttgcacccatcacccaagcagtatacactgaatccagtttgtagtcctgtccctccccarcttcccaccctttcttcccaagtccccaaagagactactctttttttaaaggatacctgtaccaggcaatagactgacaagaatacaaatctaaaaatgacaaatttcatctatttctatgtagcccaacctggacataaatttaagtacagtatattattttctcacatattggatgtttactgatagttgaccaaaccatgaggagaccccccaaaacaaataaaactgaccagaaaacatggagaagagttaatagtagccacagtttcctactacattatggctcagatttctagacctgtttgaaaagttgaaaaatctatggtctcattcctcagactgttttgtccaactgacctgaacatctgtcactggaattttttttcctttggcatgwcactttgtgcctacatgttttctaaactgcaggtaacttttgaaaggccaagttcaaccattatcagattttaacatttagtatggattaaattgtgagtgcaatttcttccccaaaagctggccagaaggactggagtttggggagggatgctttgaagactgtgatataaatgwtggggtcctggagaggtgcaggggaagaggaggcagagtgggaagctgtgaggtaggaaagagaggaaaattttctaaaagaagaggtaggagaagatgacacaacacaaatgtttccaatttttcagtgttgctgaaggtcaactgtgcttcacacctgggcattytcctgaatttgcactcaaaagggcccattttctggcgtttttctcatagtcctggaataatcttcatttgacatgagagtcttgataaaaacaagatgttaaaagtggttagagagtttctccttctccagcatgtgcgctgcactcctgcctttcttttggcatccttaacttttggcaggcctctttcaatgcggtgggaatggataatattaagtatgtactctaaagtagcaagctgtgtaaaaacattcagaagagagaacactttatcccaagcagcacgtacaacatgtggtagagtatagtaagtgaaatgtatgctgcttatgtacacttagtattcaatttattccaggtgctcttatttacaaaaaaaaaaaaaaaaaaaaaaaaygagagtagttagaagtactgkatctacccttgggcttctcccaggaggtgactgcctgtgtgccacacttytttgcttgcaggctccagaggacgctgagacttggaaaggcagacctgcccaccccagtgtggagcaggggtggcttgtaggtgggcctgacccctgggctctttgctactgcatgtgttccatgcaaccccaagcataaaaacatggacttgtgaaatcaaagggaggcttcagaccttctggtttacccatctctttttacagaagaggatactgaagctcagaaaagtcaccaattactcaagttcacttgtgggtttcctcttyttttatcctgartgagcttcttaccacctggtcccttgccttctcttcctgccatccctcagcctcagtgcgctcttcattccaccatagagtgtgccctgctggaccccactttggttaggcttcctccatttcagggtagtgagctgctagcccctttgaagagttcttactagtttacgggtgcctcaggttgatttcctggggttttggataaagccacctttccatctcttcactactgcctttggggtaaayagaaccattgatttaataatacacgtactagattctctccccccacctctctttggtaatatctggyaartggatagcaataattttacttaatgaacktgatatttactgtaataaatattgggtgcagtaaacaaatgaagtcagaatctaatagctcatttaatcttggaaatcatgtaatcagtacagcaatgaaaggacaattcatgagtcatagatattaccacaccttaggagccttttaagatgagtttgatgccaagtgacttcagcctagaaaaggcaatatcccctcatgacatgccctgaggggtttcatttgtttataaaatgaccgttatgtaattagactttgacaatggtgtaacaattgggttttaagtattctcattttgatttatgatgccattttatgtggaaggacataattttaaagtttaattagaaaataaaatgttacagatgtaatgaacaaaacaagaacggttctttaaatatcataagcataaaattgactttcttcatctatacactgattctgagaactcatcatcagtgatgttgaaaagacaatttaaggtctcacattattggaactactattttaaaaccacgagatgcctgtacaagctggtaattacacatgtgctgtagtctttgcttgtttttccaattctagtgtttgttgattttccagataccctacttgggcccctatgtcccgtagcacacgtctgtaagaaggctggcatgggataaaagtctatgaccatgaaacggagcaaggcaaatctgtatctttggggcacatatctttttctttttttctttttgagacacagtcttaccctgtcacctargctggagtgcagtggcacaatctcagctcactacaacctctccttcctgggttcaagcaattcttctgcttcagctgtgattacaagcacctgccaccgcacccagctaatttttgcatttttagtagagacgggatttcaccatgaattttcctggctggtctcgaactccagacctcaggttatctgtccacctcagcctcccaaagtgctgtgattacaggcgtgagccaccgtgcccagcctggggcacaaatcttaacctcatcargatattctgtccaaacaaatgtattttgttctgttttatttttgagtttgtccttttctgtgctctgaaattaggatctggtctagtacttaatttgtatattgtcagtgctcaataaatagttaatgcttgattgtttgcataataatttggaataatgattatcagtgtagagttttagctggatcattagaaaatgcacttatggcactgtgattttaagtgtttccttgttgtatccactgttcagttagctcctgctttctcttttctccctttaataatgaccgccaacaaggccttttaagctaggttatgtatagccacaggaatttaggagaggaggaaaagaaaagtggcaacttccaggggaactcaccctttgagccatagactgtggttcttagaagccagaccagtctcattctaaacaccttcagaatatttttagtttgaagaaattggaagggcctggaggcaacagacagccaatattcagtgwttatgtctcatccagctgtcttctgtcactcttcctgcacaaggtgacttttgacttgaccggtgtatctttgatacttactcatttacagaaatgtataatggatgtgtgtgtgtrtrtgtgtgtrtrtgtgtgtatttgtatttttatagagctattgacttctgcaatttaacctctaagatgaattatccaatagaattctgaaatgaaaagttcacagattttcaaggtattttggagatttaaaaattgaagagaagctatgtgaatattaagtgtatgttccagatataattgaacaattgaaaggaatgatcctggtttaatttataattaagctatacattaatttataatgaaaacttgtaattaaatgataactcaaattagccaagaaaaaagtattttttaaaagaaatttgtacagagtagtaatgatctggctgcattctgtgaacagattattctctgttcataatttaggcaccttaagatgctggcaccttaaggtaggaaccatgacttctttatataaataaacatcataaaaagctcagtactttttactcagagagtgctcactaaatgtcagctgatgaggaaaacattctctgtggaacttgctgtgaaataactactcatgagscatatgctgtataaagcttggtcaaagtttmcagttttcttggtgtcttgacatctgtgtttagatacttggtcaatctttaaatgaagataattatatatagcaaagttatatttgggaaacatttcggaattttggagactggctattagtttttcttagaataatctagagaaagatgaatcatttttcaggaaaaattgtttagaacttttattggraattctgatttccttaaaagtatttaagatttttatcatgtactattgttgtaggaaaatcctggttcttgtcacacgcccaggaaagattaggctcwcagacactttggagggtgaggggttatggaatttattggtcagaaagaaaaaaggaaaaacaacacagcaaagcaataggggttcatattaacaggcccccatctcacagattgattcccaagttaccaccccgaacaggagagaccagtctcctccctgcaaagggcgtgaacttctgtggctccaccccattctcccagtgtgcaggccatttggaggttctccagggacccctttatacttggctgtcctgtctcactatgcaatataaaactttctcaggtatgctgtgcattgtttttcattcttattttcttttgtgaataatatcctggaatcagtacgttcttctacatcatctccttttctttttttgaactcttttaaattctagattctgccctcagtattccacttaaatcattcttatgagagcaccagtagtcttctaatttaatcatgtggccttttccaatttttcatgctactctgacatgtggcagtattgtctgcctctgacttcttgrtaattccttggcttctattacatcacatcaacctggttctccttttgaaactgcctttgcaaaagttatatctgagaaaattatgacactgccagagatatgacctagcccactcccctcctcttgcctttagctttcaagctgccttaatcatttctgggcttaggcccagataactttgggagatagtttaaaggataataagccttccccaaaactcaactgcctttataaagctaatgaaaggccctcaggcttcaggggaggacaggaatctgagttgtgctaaggtgtagacgtattaatagattgccactagtgcaccaatagtggtgcagataacaccactattgtagattggccttttgagatatcttttcaggttttttgcatgtctgacacccatggctccagctggacctgctaaaccactcctgtggccccacccaggaatggttccactcaagaggacaactttgaccccctattatttcatcttcagcccaatgaattatcagtaagcacccattgcatagcaatcctcaccctttcccccaaactgctgttgaaaaactcctatcccatgagctgtggatgagattggtttgagtactaactctatctcccatgtggctttgccggccttgtgtttattaaactctttctttactgcaatgctgtggtctttccttgtgcagcaggctggaagaactcctcaggcggttatacttttgcccatccaactgtctttttttccactttcttctgttttttttttgcatttgtattcccccaaggttctgtttttagcyttctactcttctttctgtgtacttgtattccttcagaagatcatgtattgtctctgtctctgtcttgattccccatctcaatttcccactgcttggagggcagacacactgccatagcttcaacttaacatacataaaacagaacttaacaccattttctcaaactagcaccctttcctcctgaatttctgcttgtagtgaattattattcttgtctccaaagctagacaccatggaattgtctttgatgcctttctctacttctttcgtatatatctctctaaaatgtttcccagccatagtgatttccttgccctgcctcttgatttaatgacctctactctcctgcaattttaagcactaaccagacctacctggctttccttcttaaacatgacctaccttatttcttactgtttaccatccataccttcctgaagctgtagcactctgtgctttaattatagtctctttaatgtgtcataacgattactgtcacaatgattggcctttcttcatgtgactcttgtttttgaaaaatccttctttttcttatcaatttctctctcacaactcctcccatcctcacctttctctggaaaaatcctttaagatccagcccaacagacttctttgtgaaactttcctctaccttcccagggagaattaatggtttttactgttttcccatatacttggtacatagtctgaacacagaacttcatgctttctgtaatagttagtggtttatgtgtctgrcttctgcactgggactgtgaactctttgtaggcaagcactggatcccatttgctgcatctatcctcacacacagtggccactcaaagaatgtttgttaaattgaagatgtactcaataaattagccaagtctcttaacttcctttctgaccttcccttcacgtctcctgtcttccttgtcatcttagcctttaaccaggcagttttccttaagctgaaatgtcctgtctgtcctcrtaccttatcccatttccagtcatgctttgggccttatttctttcacatcatcctgtatccatctttccttttctgtgtgctatctaaaaattctctctaatagcttgttgtattttaattttatgtcccccagttttactggaaattcctagctggcaakaaatttttatttttaaaaaatccagaccacattacccagtagttctttactctttyctattctgagggtctgaggctgaatttactcatcccagggtccttttggcttcattgctgaatgagtgaccagtctgagtcccatgaaaaggttcactctatatttgttgaatgggcaacaacttcaaataagtataaatactatagtatgaggcatataaaatggtaaattgaatgcaacagcactgtagttcttttctgcaaacacctttaacattattcaagggaagcaataaaggyaaagcgtagtcatttgttggatcactttttattttggaaacttttcagctgttaagtaacatattaatatttctagccaacattaatgctcagttctagaactggttatagtactctaattaaggaacgcagacctgggaattcatacctgattcagacacttcaatccttacgtcagtgtgtctctctcttactcaggtctaaaaccagtgaatcattgtaaaagttagtattggggactgtctggtaccattgttaatattttgggctgtgatgaaatggcatggatagtttcatctgaaaatttattcagatttatgacccagtattcatcacaacaatctgaaaaactcttaagaggatagaaattgtatgacaaagtgagtcacagtctttgtgatgtgatgtctgcaagggtgggtgggagaaattactgaatgaccagtctcattctactcctttctaagctgaatcattttgtaaatagaaaacaattcataagtttttaggtggccttacatcaataggaaatggaagagattaaaacggtcaaataatgcttccatttaaaaaattacttttggaaacatatcacttgataaacactttgcttttgaattagaaatgcaaatratctttctactgcctgctatatatcttttaatccaatacttgctgcatgtcttcatgtattcttactttttctattaattatgttacttttcttgcctagattttttttttattctaccaagtgtcatttgacctttcgtcttatagctatttctagtgttggctcatttggagatggggtgtgtgtgtttgtgtgttggggagaggtgtcatttactcactggctggatgactacttgaattggatggggactcaagagaaaaaggtccctttgattttggaaattctgattctgggatggtatcatcttgcattttgcattgtgggtcctcttctgttaacttttcatctaagcttttctccgagtcatattttacctttaaatgtaagacttattaacattatttccttatcttctttggggtaaggcatttatttaaaaaaagctaagtgaaaagagaaatattctattttgaatgtgtttctaagtgttagttctccttacatatttatatatatctacattactctgaactcagtaatgggagtataattsaagtgagattgggaagataattttgttaactgttttaattgagtgtactaatgtataaagacatagacagaaggtgttggattgaaaaataacgaattacagagacaccctcagctgttaaaggatgagaaaagtgagacatagattattttttggagggtggtatgaaagccctgaagtattcatgggatctgtccagctctgtccagacaatgagggagactgccatggtgactaggcagagtccctttgctctgtggtagaggaagggtcaggtgtttggcctttaccactgcactatgttcctaggaccctgatatttaccaagtacttattgaatgaatgagtgagtgaaatttttgagaacatgctctatgccagctttataaataatatctgtttaatcttaaatacaaacttatgaagcaggtgttgttatcttcatttgacaagtaagaaaatagtttttttcctattggcttttcaaaacatgatctctttgtccataacaactggtgattgtgcattctagacttcttagtgtttagaatacaagttcatggccagaattcygcatggacaaactagcagaaatttgaacagaaataatgatttaagcaaataatttaaactctttcagaggctttgccatgtccagcaaagttgaagtgtgtgccatctattcctctgccccttcgtctattccactctcctttgtttaggaaagacttctgtcatgatttagtatgagacaattcttctttagtatttaagggcttcttaagatttttgagtggcatatacaaaaatagcgtagcatgtaattaagaatgaataccatacagccatgcactgcatcatgatgtttcggttaattgcagacctcatgtatgatggtggtcccataggattataatactgtattttaactgtatcttttctatgtttaggtaacacaaatacttagcaccatgttacagttacctacagtattcagtacagtaatgtgctgtacaggtttgcagcccgggagcaataagctataccatcatctaggattgtgtaagtacactctatgatgttcacacaatgatgaaattacctaaggatgcatttctcagaatgtatccccatagttaagtgacacatgatcatgtaacacagtggtatttgtgtatttaagcatatctaaacattgaaaaggtacagtaaaaatatgacattatagtcttatgggaccactgtcataaagataactaaaaggatgttttcaaagtatagttaggctcttccagaaaaaatcgagggtatcttttcagtatttaaggacatgtggtgtaagattttaaaacaacaacaacaacaacaaaagcagatgggcttgggtttaattttcttcattgagtgagattgtccattaatcaataattttctgagtgtctactatgtgagggaataaagaccaagatagataaagagataccaagaaagcatgtagcaagacacgtccggaaaagtgtctaaaaattaaactcctctttcctttattgactctcctgtattttcaaatggtatcaccatcttccttgccaaccaggcccaggtgttrgagtgaatttctactatgtcgttttccccactcctcacttctcttctcaggccctgtccatttcatttctgcagcacattcacacttgtgccggtcactgcaatcttgctgcagcttgtctagttctaaccctgactactgcaactgctgtctaactgagctcatctgtattagtttgctaaggctgccataacaaacataccacagtctgggtggctcgaacaatagaaatttatcttcttatagttctggaggctggaagtccaagatcaggttttggcaggtttagtttcttccgaggcccctctccttggcttgtcgatggccactctctagctgcctcttcacaagatctttccactgtgcttgtgtctctgttgtctctttgtatgtccaggtttcctcttcttataaagacctcagtcagattggatgggggctcaccctgaaggcttcattttaacgtaatcacatctttagaggccccatctgcaaacaggagcacatgcagagatagtgggattagagcttcaacatgagttcggggaacacaattcagcccatagtatcccataataaaggatgttattctttgccagagtgagttaattactctgtctagttgttcagcagttggacattgttttttcctgaagaggaactctgatcatgttacttctcagaaactctcctgggcccttgcttccaaaacgcaaaagaaaagaaggaataatggtcatgccaaaaaaggccatagccacgtacagcctatttgtggcaggaactgtgcccgatgcatggccaagtacaaggctattaagaagtttgtcatttgaaacatagtagaggctgcagctatcaggtacgtttccaaagcgagtgtctttgacacctccgtgcttctcaagttgtatgtgaagctacattgctgtgtcagttgtgccattcatagcaaggtagtcaggaattgatcttgtgaagcccacacgaaccaaataccccgatcccgatttagacctgtgggtgctgccccacgacctccactaaagcccaggtaaggagctgagtccttaaggtctgaagaaaaactatcttctggaaaaaaataaaatgaaaattgtatttaaaaaaagagaaaaacatcgtggacttgaaagacttcaatctcctggtacgcacattgcccccagagctcacagatgtttcaagtctgtaaaaatcagaaaacataggaargttaccagcagatgtgtggttgtcatagatataaaaaagtgggatacagggtgtttttggaaactctaggtaagtagtaagcttgatacagatctctgaaaaaaactccaagaggtttgagaatactgaaaaagaagataacagagtaagtagtaactagggtgctacaatgggagagtcataatatatacatagccttcgtgtgttaatttccatggaatatttgaccgaatttctcatagcaaccttctgtaaaagatgtgtattttcttcaagagagtctagagtttttcgtatttaggattcttaggccaggctccaacagctaaataagttttattggcacacagccaccctctttgtttaaacattgtctgtggccactttcacactacaatggcagatacccctcaaggtgtaaaatatttacttcctggccctttaccccagaaaatgtgctgacccctggcttaggccatatttttcatgaggagtggacactccttagtcatggcatttctgctattccgcactattacatttaatactaatttcctgacacttgatgtcagaaactgtataatattgtctatggcttttatggatattcctccaacctttggacaggaattgttatttccaggctgatctcttatttaaaaatgtatttattaatgatttaatatcacttttaataaactggaattatgcttttcctctaaaagaaaaamaataaaggtgatatagatgcattatcataatctaaaactattttaatagacagctgatcctattttccaattactagtaaaacgtcatgcttcagatgattatgctaaaccaaagttatgttttttgctagaccgtccacccracttttaacagcaaagtaactaattcctgtgtagcaggaaaattcayttagttatttccatatatattttgcaactcaactaatttttcttggaagatactgcaggaagttacattattcaaagttagatattctctgttttagtgaaattttaaaaaattaacagtttggatatttggttacacctactttgaatattttcctcacttaaattatttttggctatgcttaatgatgtagaactgtagagcttttatgttaaagaattctggagaatattggctctgcccatgggtatcactccagaagtggatgaatgttcctgttggattcctctctttttctagaagaagcctaatgcccaccatggctgacagttaaagcacacagttctgctctctaggttaggtaggacagacagcagaacctttctaaagacctgttgggggaaatactatttatggaagcctgcctcaacgatgtatggagtgcatctttcctccagacagagagttttaacctgggagttcatggatttgctttaggtttcccttaaaaatagatgcaaaatgctaggttgtttttctgaggagagggtgcatagcattttgtcagattctcaaaaggttatctgtggtccaaaatgttaaggacagtatcactagaaacactaaaatatgtcttttaattaatctgacatctgggagagaaccaatttgaaccacatgacagtgaaaatgagtttactgaattgtgtgttggggtgaaactttagtttatggtgagtgattttgtgagaaacatctctgtgaagctcgtctctgtgtataattaacagaaacattaaagaaatgttgaggactgttgttgatctcattacatagtgtccactctgaggttccttaggagaaacttctctgtggtaactatgttgggtctagttatgcttttccttagcagccagcttatttttatcttatggtctctgggaaatttcttattgctgctggctactagaaagccaaatatatggcctgcttctagcaagtataataatctcactcctggcttcatcagttttaaacccttcatttgtatttgccttattaaaaagccatttttaaagttttttgttttggtatattgtcaatatctttgtaactcaccttaaatattacttgggatcaaacacattatacctcaataaaaataatatattgattaatttgytatttttaaccacaaagtaccactatattatacagagcattgggtgctggagatgaaaaagtcaaggcccttgtcccttaaaatgtgttttgtttggcacgacaagaaagagatataaatcaataagggcaataaaatgttttgcctgctttgcttgtggtgttttccatgggacagtgagatcatagcaaggatagcagtaagttctaatggggaagtcataaaaggcttcaaacaggagtgacactgaacagaatgtttggaatcaagtagatgtttgccaggcagacagggcggggaagggcaggaaggccaaggaggcagggccagktctggcatgttttgggaaccaaaagaagtttggaatggcaagaagtaagrcctgctagctaggcagggactggattatgatgggccttgcaagccatactgaacaattcgtctttatcctagaagtggtggggagtcaatggagggttttaatcagagaataagaggattaaatttgggctttgatgagatcactctggcgggtgtgtgtaatagattggagggtgtgaagctggcggcagggagtacagttaggaaatgatttcagttatccaattgagaaatgtaaatctctctcagactattttcctgaacatagtaagtgatgtatggrcatatcttcaaagaagatattgtgggtttggttccagaccaccgcaataaagtraatatcacaataaagcgagccacataaactttttggtttcctaatgcatatgaaagctatgtttacattgtactgtaatcggttaagtgtacagtagcattatatatgttaaaaaaccaatgtataaacttcgtgaaaagatactgtatttttaaaaaatgctaatgatcatctgagcctttagtgagtcgtaattgttctgctagtataggatcttgcctcagtggatggctgctgactgatgaaagtggtggttgttgaaggttagggttgctgcggcaatttcttaaaataagacaacagtgaaatttgcggcatcagttgacttatcctatcacgaaagatttctctgtagcatgagatgccatttgatagcattttacctacagtagaacatttttcaaaattagaggcaaactcttcaaaccctcctgctgctttattaactaagtttatgtaatattctaaatcctttgtggccatttcaacaatacatatagcatcttcaccagctgtagattctatctcaagaaatcactttctttgttcttccctaagaagcagctcctcatctgtttaagttttatcatcagattgtagcaagtcagtcacatcttcacgcttcacttcaaattctagttctctttctatttttgtcccatctgcagttacttcttccactgaaggtttgaaccccctcaaagtcatcatgagggttggagtcaacttcttccaaactcttagtagtgttaatattttgacttcctcccatgaatcacaaatactcttgatggcatctagaattgtcagttatttccagaaggttttctttctttctttttctttttttctttctttctttctctttttctttctttctytttctttctttctttcttccttccttccttccttccttccttcctttctttcttccttycttccttyctttctttctttttttttgactgggacctactctgtcacccaggctggagtacggtggtatagtcatggctccctgcagccttgatctcctggaatcaagtgttcctcccacctcagcctcctgaatagctgagactacaggtatgcaccaccacacccagctattttaaaaattttttgtagagacagggtctcactatgttacccagtctggccttgaactcctgggctcaagccatccttctgccttggcwtcccaaaattttggaattacaggcataagttaccatgcccagcctccagaakgttttcaatttactttacccagatccattggaggaattactatctatggcagctatacccttacaaaatacatttcttaaatcttaagacttaaagtagaaattacttcttgaaccatcrgctgcaaaatggatgttgtgttagcaggcatgaaaatgttaaccttgtacctctccatcaaagctcttgagtgactagctatgttgctagccaacagtattcttttgaaagggatgttttttttgagcagtagtctcaaaagtgggtttaaaatattcagtaaaccacgatgtaaacagatgtgctgtcatccaggctttgttattccattgatagrgcacaggcagagtagatttagcataattcttaaggccctgggattttcagaatggtaaatgagcattggcttccacttaaagtcgccagctgcattagcctctaacaagagagtcagcctgtcctttgaagctttgaagacatgcgttgacttctcctctctagctgtgaaaatcctagatggcatcttcttccaagaaaaggctgttttgtccacattgaaaatctgttgttagtgtagctaccttcatcagtgatcttagctagatcttctagataacttgcgctagcttctacatcagcactgkctgtgttaccttgcatgtttatgttatggagatggcttgttttgttaaacctcatgaaccaagctctgctagcctccaacttttcttctgtagcttccttacctctctcagccttcatagaactgaagagttagggccttgtcttgtatttggctttggcatgagggaatgttgtggctgtttggatcttctatccagaccactcaaactttctccatatcagcaataaggctgttttgttttcttatcattcttgtgttcactggagtagaacttttcattttcttcaagaattcttcttttgcagtcacaacgtggctgtttgtggcaagaggcctagcttttgacctatctcggctttcaacatgccttctccactaggcttaatcatttctagattttgatttaaagtgaaagacaatgagactcttcctttcacttgaacactgagaggccattgtaggtttactaattggcctaactttaatattgttgtrtcttagggaacrgggaggccctaagagtggtggagacaggggaacattcgtcagtggagcagtcagaacacacacgtttattaagtttgctgtcttatatgggtgtagtttgtggtccctcaaaacaattacagtggtaacatcaaagattactgatcacagatcaccataatacatgtaataataatgaaaaagtttgaaatattgcgacaattacccaaatgtgagacagacatgaaatgaacacatgctatttgaaaaaggtcactgatagacttrctcgatgcaggatttccacgaaactttaatttttaaaaatcatagtatctgtgaagagcaataatgcaaatcacagtaaaacaaggcatgcctgtatatgtgcaagaatggaagggtctccattttattaagtgaaataaggaaactattgaataatgctgaaaatattagtccatttatgaaaatgcacacacaccaacacaagatatatacttgtgtagtaaataggaagactgagatctgaaaaggatgtatacctaactgctaacaagtgcttacagctttagagaaaggaatgggattaraagagacgagatcaaggggaatggtcacttctttacctatgtatttgtgaattttttaaaagaatgtatccatgtattatttatgcaaaattttctgagaagaatgaatgggaagtgargaagtggatgcagatgttgaatacttttctctgaggtgcatgaatgtgaagggaaggagagagataggatagcagccagaagaagttcctgtttcgggaaacacttgtggactggggttttttgccgtcagtcacacgatggatgcacgggtgggctgtggagcactcctgggaagsgggcatggtcaggcctgtgcccgcgcattacaaggggcgcattcctcactcattcatctgccccttggcttatttcttttcaagtcccacacagagaagcaaggccttgatcattatcagcacaactgctttactttccttcrggaaatgatacttaattagtatttgaaagcagtacattatcttgaattcactgtctattctaaggcaaagcacmccaaaaatctaaaatcaaatatattctccatgatgtatttacttttctaaggtgagagaattataaccgtattctttgggaatgtcctcttatactcacggaacaatgacttgggagagacaggaaaggcctggatcagaacacagaggactagattaagcttaatggaagctaggagtctgtggagtgggagtgctacaggtgtatcttggactgaccccatggactgggtttggtctatgagcagcagtattcactggaagtcaacctggctttggagtctcatcayagaggatgaccttgctatgtggaataggctgcctggggctgggactgatgacctgatgacctagcaactcgatttttaggaggcttgtttcagtctgggctttccagagaaactgaatgaataggagatcactcyatctatctatctatctatctatctatctatctatctrtctatctaatctatctatctacctacctacctagagggatttattttaaggaattggctcatgtgattacagaggctggcaagtccaagtccaggccagcagtctggagacccagggcaaagctaatgttgtggttcaagaccaaaggccgtctgctggctgaattccttcttgctggaggaaagcagccttttgttctattcaggccttcaactgatttgatgtgggccccccacaatatggagggcaatctactctactcaaagtccactgattcaaatgtaaatttcattctaaaacacccttacagaatcatccagaataatgtttracctaatagctgggcactatggcccagccaagctgacacataaaattaaccatcacaaggcatttgttgacataaaccctagactggcctgactgtccaaagagggtggtgaataagccctggcttggrtaagaccaacttattcactatgatgccccaaggacacgggtcagagacttcctaacagaggtactagactggcctcctgttgacactgagaggttcagttttgctttgagcctcagctcaacactgagaccctaaggagtctccttcttccatggctagtgccttccaggggcacatggagtccaggttctttcttctggtttctcttgtctttcccctgaggtgtgtgggttagtttttcttcttcaggatttctgaaaataggaataataatcttattccagaagaaaggacatrattatgttaaacaaaaagggaacattcccaactwgatcacagtgatcgtgatgtggagatgttgtgggctgctgttgcctgtattctggagacttgtggtcacagcagtaaacaattgctgctgggcctgttgtctgtcagctgccatctgctccaaagcaccccctactcttcgcttgtccctttagttgacctgggcctcagagcctgtttctgaggatatgggccacagaggggaattgaggctgcaggctgattacatagcactggtggtagtttcttttaaagtcatgttctgatctgtggttgcaaatgtctgctgcttctgtcagagcattattcccctttcatgtggaagaaaactgccattgattagaagcaggagtatcatcgtcagtagaagcacttgtgctttaggttctttgagcctcatgagaggtccaagatgacactgaagtaaaggaaggtggataccagatgccttggctactttttagaatacatcactggcactgctaggagagagctgggattcatgagagtgggattaggtgctgggccaggagcagagagtgttctttgtactgtggatctcccttacttgcttcctggacaactggctcttccggactgggtctcttggtctatccttgtgtccttaggggcaaggtgcttctccactttgaagctaaaacaccatatcagaatcctaccaaatacatagacattttaacatgcagcaaaacaataaaatctctttggtggcttagttgctatagaaaaagacaaatgttcccaaccaaagtgcccatcaatgatagactagataaagaaaatgtggcacatacataccatggaatactatgcagccacaaaaaggatgagttcatgtcctttgcagggaaatggatgaagctggaaaccatcattctcagcaaactaacacaagaacagaaaaccaaacaccacatgttctcagtcatgagtgggagttgaacaatgagaacacatggacacagggaagggaacatcacacaccagggcctgtcagggggtggggggctaggggagggatagcattaggagaaatacctaatgtagatgacgggttgatgggtgcagcaaaccaccatggcacgtgtatacctgtgtaacaaacctgcacgttctgcacatgtatcccagaacttaaagtaaaataaaaaaaaaaagacaaatgttctactaaatggtgagcttagcttggctagcacagtgtgggtagatacattttaaggtataggaacattgagggacttcatgtctgtgatattcagtaatttctttgaagtaggagggaatgctgtctctgagagagttgtgactgctggctgggtagccttagagcatggtgtagagaataggaaaggaaattaaccagggatatgcccaagtggctaacacttgctgagggcccacttgaggctggagacctcatattgctaataacaccagtttggatgaatgtatcatttccagaacattgtgtatgttsaacattgtgtatgttcaasaatgtatgttcaagaatgcagaagctggctgggcgcggtggctcacgcctgtaatcccagcaatttgggaggccaaggtgggtggattgcttgagctcaggagtttgagaccagcctgggcaacatggcaaaacctyatctctactaaaaatacaaaaattagctggatgcagtggcacatgcctgtaatctcagctacttgggagactcaggcacaaaaattgcttgaacctgggaggcggaggttgcagtgagccaagattgcaccactgcactccatcctgkgcaacaaagtgagactctgtctcaaaaaaaaaaagaaaaaaaaaagatacagtaaaagttgtgagttgagcaaaatgttatatatttgtttctggtcttggaacaatgtacttgggagggccagactcctttctctgcctgagataagagatttcgattcagagcatcttaaacagaattaatttctgtgccttaaacttttccttattcttccagaaataacattgagcgatggtggatgactttatagatgtctgatttttttcttctcttacatagcctcatatattttttggaggaagcagaaagaaaaaaattaagtcatgggagcagacaggataagggaagtagaaagtagaagagggaaaggaagaaagagaaaaaaacaaaaacaaaataaagtgagaacaagcaagagaagatttaggttgaaayagacattcatattcaaaactcccaagtagctagttgtatgggactcttagcgctctcttcagagagcggttccaaatctcacaagaagaagggagcaaaaaaaccaacatgaccagttttttgtggcacaggggaaggaaacacattcaatagttgtgattttaggcttcttttttgggatggaagtgtmagtactggagccagaaactatttcctttactacctgtgtacttgcttttatgacgcttagaaaatgtatacactatagctattaactatgtctttttagtgtaagaaataagaacacatagtataagaagactttctttggggagagaagacttcttggtattttcatccattcccctacttccccygctcccccayccttgcatccaaccaattgcttggatcaaagcacaattttagtattatttcaacctgctatgtcttgttggatggcaaatgaagagatracagagtggcatgcttcaaaggggcagtgtggttcagcattcagcaaaagaagaggattaggactgctgatcttgaccctagattgctgggtaactttaaggcaaaacaatttaccaacctgtgacccagatttcttatctttagcagagaagtccagactagatgatttctcagggccaaattttaaggatttttgactcaaattctgctggaggttcagtttttggggaaggctgataatatcattagaagtaggtatggccaatagaaaagagtataatcccagaaaagagggtacttcacaccagstctgtcactggagatggtcagagactgtttaacaaccctttgatcctaaagcaaataggcatgtgaagctaaattctgttagccgaaatatggcttaaatgtggctctagtagatagtgttgtgagttttaaagtatatagatagaatgacaagcaggaactgactgtctaaataggggctagaattgatttcttagctagaatgtgttgaacagctattattaaaagtagagaaaatgcaaaagtgcaatcatgtggcttttcttcctggcyctaaccctagcctcagccctttctttctttcttctcatttctctggtgagctcattctcacagtttcatctttcacatatgtgcaggtaacaggtagacttgggtttatgtctcagctgtgccttactaattctatgctcttgggtaagttaatttatttaaatattagtttcctcatctattatatagggatactagctgataatagctactatgttggtattgttgtgatgattaacatgataatataggcagtgtgtttaggatagtactgtcaaataataagtaaccattttactgttatttattattcctaaatctctcaaagcttatatcttatctgtcctccactgcttcagttgtctattgctgtgtaacaaacatctcaaagctgtgtggtctaaaatagtgattttatattttatgattctgtgggttggcctgggtgcaactgcatagttcccctggtataatttagaatgtgtcatgcagctgcagtcaagtggtcacggggacaagaatatctgaaatggctttacttacatgtccaayaccttagcagggataactggaatcctaatgatatctttctccaggtgctgtctctctcaggttagcttgggctttttcagtggctggatctcaagaggaaagggttccaagagagcaagctccattgtgtaagccgctgkttgcatcctgtttgctaatatcaaaattgccaatgtcacatcagtcaacatgtctaggactagattcagtttgggaagagctacagaagatataaatatcaggtggtgtggtacattggagccaccaaaataagtctgccatcagataaacaattaattcctcgcttttatgagcatggaattggtgctagatcataaactgactatcctcattttaccaactttccsttaattgttttctgtgtcagtttttcatatttccaagttgaaaccccctaaacacaacatttttttccactgctcattttttaccaaaattcaaacttcatgaaaccctggcatttcatcctttgccttccatcctcatggccaccatcaaagtccacatctttattatcttacrtgtgaacagctgtaataacctttccagttattaattctttaaacaccacttttagcctgatgcatttcttttcaagaacctayggtatgtttatagtccagattgcattaaacctaacctttctgttatagggcccttttctgaggcccttatttatcttgctctgcaccatttatataactattttctggctgagcacagtggctcattcatgtaatcccagtactttaggaggcagaagcaggtggattgcttgagctcaggtgttggagaccagcctgggcaacatggcaaaatgccatctctaccaaaaatacaaaaattagccaggtgtggtggtgggtgcctgtggtcccagctacttgggaggctgaggcaggaggattgctggagccagggaagttgaggctgcagtgagccatgatcatgctactgcactccagcctgcatgacagagtgagatcctgtctcaaaaataaaataaagtgaaataaaaataaaaactattttttactattgtatgccctccaccctccagaatcagagtgtgatgaggcaagttatttaataagagagttttaagttcatgtatattataaatatcttaacacacagaggggaacagaggagacaatgctgaggtagagtaaaaaccctgaagacaagatgtaaggaggaagggattttgttgttgctatttgtacttttgagaattaggaaggagggaaaaggggaatcaggaaatatttcagggagttagaaattagatccccttcacggaattccccaatatttaaacatcttgaactgtcttttgttcaccacactactcctgctgcacttgggttacgcatccatacccacgtggtctgtttttgtagttgttactggaatggtgcgagggtgtatatactaatgctgtgcttgatacwcaatgagtgcttcataaatgcttgctggatgaagaatataagmaaaacttacctaattccttatcttttataaactaaaatggacaatattgataggagttaaatgaaagaatgaacgttcttatatattaaatggagagagatgcagaatgcagttttgttaattatcttcactattaaaaatagacatttgtaaagcatcagtatatgtgctgtatttgctgcgtctagagaggagctgggatggatgaaggcttagctggttatactgcacaatgagagtacctgtttcttctgtagatagagcatagaagatatactaggaacatggggaaaagccattatatattttcytttttagatctgcaagccttttggatgtgagaagattttttaaaaggacattaaaaaatagcttctttttcacataaggatacaatattttaaagtagtaaacatagaaaggcattcgcctacagaattctaatgagcatattcgttattcactgatactcttttgatggctgtgcatttcctttccaaaaacacaatatttttgtgaaaccagtggtagtattcgaccctggcaatcaagattgtgtaaggaaatggtaaacattttttggagaagagtctcccgcacctcacaggcttttaacaacaatttcaaatagcatattttaaagaactcagctctggagtctgcctaattattaacttctacttagaggcagctgcattcttgagggtggagccatgatcttcttttactgtgatcctgttttattcctttaaatactcagcacagctgaagaagaggtcctgttttcttactgaagactttcaggcaaagragccgtttccaacttcctactaagtccacccagcatatgtcatgcaggggatgcggggaagaattttccttgcaagggccttctcagaagttttggagatgggccttgagctcttggctggaagcgtggttttccaaagtggaggctgcagtaatgctcgtcattgattgagagacgtgctgccggggctattttcatgggagtcaaataaaactctcttgtcttaagcctgctttgaaaggtgttttcctaatgattttacagtcaaatagaatgactgtgtgggagagtgtattaaataactggaacactctgggcagcttcccttccccaccctgtgcccctacttgcctttcccccaaagctcctcctcctccgggcacacacatgccgctctgttttctgttctggagctgcctgaattgtgtgatttttgtggatgaatgtgaactctttaatccagaaagaggtgccaggaacacaaacagcccggctaattggcattcacccctagggaaagtaacatggccaacaagctggttgcattatctccatgaggcacttacttaattaactttgaggagaaacctcaagctctctcaaatcacccaagaagcatttcgaaaaggaagaatttgccaagaaaaggctatattcaggaggtgttccatctcttgagtatgttggattagttgcagaaatacttacttaaggcagcttatatttttgtttaatctctttctgagctgcttatgatttcagcgtactgagaggaattttcaagaattgatttatattgaagaactcacatttcaaaatatcagcagttttgttgaagtatttctcagttgtttttgtgaaagtattgccaaccctgactgaaggtctgacttccaacaacttgttccatatgaagatactgacttcctcaaaggcctgtctgctgctgcctcctcagacaacagagcaggttgtctaaaccatggcacttccacctccagctttggaaggcctctgctagaagacattttctcataagtagtgcagatggtgccctaggagctgatgagcttcctgtttattcagtaagcgttgcaggaaatacaaagaaatgtcaggtgaccaaatgttctggggtcaccagagaagttcttaacattcccttactaatggaaatgagaaaaatctgtagattttcagctatctgaggaacaatttttgtctttaaataatcctctcccctcttctaattactaaaagtgcaaccaacaggtagcaaaagtgatatttgagctycatccttcttttcttctgtccccgtaccctcaccttctagtgaaattactcagagactatgaagaatagggattggaagaaattgagagctcatggtggcaggatagcccacagaccatatgtgtctctgaataagggagaatttgataagtagaataagccatcagaaaaaaaaattttcaaatagtgattcctcttcaaaacattttacatattttctctaatataattattagaataaaatcattgaaatttagtattaattgaaacctctcatcagatttttatattgtgttacattgtgttatattgtgttcaagacacaatattcatttggctttaagagactgcactagaatgtaaaatccacaagagcagagacagtgtctggttcctttcagtgctttatcccttgtacctgaatgggacctagttcaggtactcagtcaacaatgaattgtaaaatgaaaaaatctaaatacagtggaggctatttggtctgcgggctcttctgcccttgggttctcaatttcttccattttctgttctaacatggaaatggaagttacactaaaagtaatatttaaaggaatcttatttatattgcttagcttctttctctcaagtaatttctagatcttaaagcacagatttaaaatattaattattaagctagaagtagagactttgaactagttggctggtattttctaaattaaattttaaaattttgagataattatagattcattcacatgcagttgtaaaaagataatacaggcagattccttgtactctttacccaattttcccccattgtaacatcttgtgaaacagtagtacagtatcataacccagatattgacattgattcattcaagatacagagcatttccatcatcacggtgattcctcaggttgcccttttataggtgcactcactccctcagccccaccttgggaaactacccatctgttctccatttctataattttgtgggcaacttatttttagaaacatttctccaacagctggcccctgagaagaaaagaccatttaacacatatagggttgatgcgttttgtaggtggaagccaggtatttatagatgcatgtcgtcagtgttgcctggtgttgctgtgccaggagtcagtgtggggtcctgaaatccagattactgaggtgttagtactgtaattattcttaccagaaaatgccccagccaaaagtggatggaattttcccacctgaattacaatacctccacaaaccaggccaagaagtgtcctcagtggcagagcatttctagcctttccgtgatgctcagatagtcagataatgtctgtaatccctaatagctacagaacagatgagggaaggtgtcctctctacctgtcaacttgtgactatttactgatgagtactgggactttgaactccccttttctctctatctctgaagcttatctttgctgctgtgcagttctttgcccctgtattgcgcctggagcttctggaatgccacaagatgctaaatagttcctaccttttccttttcttaccatcaatctgacttaattatctgatggtgtcactatagaaataaaagccattggcattcttaaacaagcagctgtgctgttagaagaatcaggagtcacctgatatttacagctatttgggcattgtgttacagttgcttgtattggtagctcagccagcccaaacatatctcttttagaacatgaggtaataaagccagtacataagatattggaggaaattgtaagtttgtatggattgaaattgtttctaacagcctacctttggcataaatcagctgtacatctttaaattttttaaattacataagttaaatggtatggcttagaagtaaaattttggcaagagatttartatttcagacattgtatgttgcacttatttttaattaaattgttttaattattttgtcatcatctacaatcttaagtttcataataaaaaccatttttactttatggctataagagttgatacacagaaagatttaatggactcgtaaagccatgtcctgattgggtagtaatgaaggaatgcacagatttctaagctagctcccttcctttctttctttaatttttctttctttcatattatgcccaattttaaccttgtttgctagctgaggagttgctaagaattttaatgaactatctgggtgtctaatgttcttatttataaactttaattagccagttgaattgtgaagagaatggaatgtgtggttttgggcttctgggatgatatgcaaaataaaatagtaaaaaaagaaagtttactgagaggggcaatatgaaatgtgttagtcatatttgtatctgatctttgtaatttatctgattattaccatgggtactccatatacatgtatgaagatgtaaagtttttcattttcagcaaatgagttcctttttttttttccttttactttgttttctttttggagacagagtctcratctgtcacccaggctggagtgcagtggtctggtctcggctcactgcaacttccgcctcctgggttcaagtgattctcctgcctcagcctcctgagtagctgggactacaggtgcatgccatcatgcctggctagttttttgtattttaatagagatggggtttcatcgtgttgcccaggctggtcttgaactcctgagctcaggcaatctgcctgccttgtcctcccaaagtgctagggttacagacgtgagccaccgtgcctggccaaattagttccttttgttacctagcctcctttgtcagttatctatgcattaaacggttttcagtgcctggtcttcagcattggattggatgatggctgatggaagaaaaaaaaacagtggttatacmttggaatttagttttcagttactggkgaattttagatccaaggagactactaaacctggctcagttatttttggacaccaaaacataattttattggaaagcgaacacactctatcaaccaattttaaataaaaaaggtcttttgaatcagccagaagttaaaatgtgagcattgtgttctgagctgaagatgtcaggttatgtgagtacttgttctctatagactaatatagtgagccttgaaatatagtattagacaactgctttctgattatcttagtacsctaaattgagagtttcagtttgcttgggtttcaaattacttaaatgagaaataatattaacactggcccaactaatgaaaaattatgcaattgccactaagccccatgagggtggagactttgtaggtctttgtcactgttgtatttctagatcctagaatagtttcctgacacataagagacaccaatatcaattactgaatgaatgaataggataatagattgagaaattatataaggtcttagtcttttttgcagtatttcccttgggaaataaaataaaactaaaaatttatttattctgtaggtaaagaactgggctcgctatggtaagacattatataagcataaataatatactttaaaaagatgcctcagccacattcatacttgccctcttctagatattctcatctttgataaaatacaaggattcctaaaaacataatttcctgaatctcaaaacaaagcaggtagggtgcaaagccaacatatttgagtgctatatactaaaagtttatatatgggtgtgtacatatgtatatacacacacacacacacacacmaaaagatctataacaactgtttcccatcktacaggtgagaaggtaagctcagttacttggagatgaaggctgattttgaatccaggtctgactccaaaattcatgcatttgacaccatgttatttactctgagtactacagtttaacatctgcggtttacttcacaaacttcttgaaggagttgttcgcatttactgttcccaaattgttactgaggttaatctagtgaatacttttcagttttatattacctgtcatttttggtaccatttgatactgaaggtcttcttgaaggtcccacttgagatcctatctgcatttggtttctaactcctggtttcctacttctgaccactcttgtggggtttcattaaatttgtaaactatttggttggggtggaaatgacatcttacctatatcgagttttcccatctgtaaacatgcatagctccccttttaagtcttttaaaaatgattttcaataaagttttaaaattttctccataaaagtcctagatactatttgttatcatcataaatatttttttaataactaacagttctaataatgtgttgtaggtgtaaataaaccgaatttttatatattcttgtatcaagcaagttgctgaattattttcaatagttcatctgtatgttctcctaactttaaaagaaactttttattttggaataattttagatctacagaagatttacaaagactttacaaagttcctctatacccttcacctagatttccctaaggktaacttttttttttttttttttttttttttgagacaagatcctgctctgttgcctaggctgaagagcagtggcccaatcatggttcactgcaacctccaccyacccaggctccagtgattcttgkgcctcagcctcccaagtagctgggattacaggcatatgccaccrcgcctggctatttttttgtattttttgtagagacaggttcttgccatgttgaccaggctggtctcgaattcctggcttcaagcaatccacccaccttggcctcccraagtgmtaggctacaggcgtgagccactgcacccagycttacttcttacatatctgtggcacctttgtcaaaactaagaaattgatactggttacaacgctggttctaaagtatagatttatttggattttgccgctttttccactaatgtcctttttctgttccgagatccaatccagaatatcatggtgcatttagtcccttgattttttaatggagaaaatggtactgtctgcaaataataactgttagataccttagtttccaagtattgtgtgtgtgtaggtattaggtgtgcatatacgtatcttcctgcactagctcgtactgaccactccatccaggctcttcttgctctacatcctatacttctcccataaatgttggtgcttccttggattatgtcctttgccctttaatctgcgctggctacacacttttgagaagatcgcagccactttacatctccctgtagggattaggcacagcctgcactcccaaggcagccactgttagctctgattattacctctttatttctaatagattccttttttgaactctggattcatatagctgactgctttctggacatctctgtctgaattttccacaggcattgcaatttcactgtgtctgaagggaacatatatcattgtcttctcttgccaactttcccctcctgctgctccaacmacctccaagttatccaagacagaaaaacctgggacctatttctgaactatttgctttattctttcctcccttcttctctccttcctttttgccctctttttacctccctcccttccttctcctcatagcccctgtgaatcctgcttccttcatgtctcccgtatttgttaccttctgtccactcccacagttggtgcttccttggattctgtcctttgtccccactgtttcattaaaagctctcattctttcatgctattacacactaccaaactccttaacatagtattcagagcctctggtatctccagcctcatttagtcccccwtacccccttccacaacacacacatacatacccctacactccatgctacctaattgctggaagttccttagatgtgctaggctttctctccctttctcctttggaagttatataagatgctttctttttgttcccrttctttcttttccttactattgctaattctttcagtctccaatcatttgtcactgcttccaggaaacctctctrttcaggctgggttagatgtattctctgagtgctctcaaagtagcctgtgtatatttttctcatggcacttacagtattgagctttagtyatccgtgtaccagtcctcatcrcctcaaccatgctgtatgttccttaaggctaaagaccaatgttatattttcctttgggcttcctattgcttagcacagtacctggcacatagctgttacccataaatgttaattgaattaatgagtaaatgtattcaccatttatggaaacactgacttgtctgtttccaraaaccatrttctttcaccagggacagatctctctaaatatcagcttccttatttctaaatagggaaggtgtactggatgatcccttacactgctgataaattggtatkgtatgattctaagattcatcatcctggggcatatacaaaagaaaatgatgtggattgtggaagatattccaaaataggagttccaaaatattttaagcaatggtggtaatgttgaaataataatttggctttttggtcctactgtttaactaatgtgttgagtgccaatgatctgaacacttgaacatttaagtgatttacttatggtgatcagagtttctattcctttgctgacatatctaaatcattttagaaagattgtgtcaattctcctttgctgaagattttcaagtcaaagttggacagttgtttgtcatggatattgtagatgtgatttaagatataattgtgtaatgataaggctaagtgaccactaagattttgctttatgatgagatgcttcaattttgtagtttagagcttttgcttttatgttacaatattttaaaaaattgaatttaaagcttggataacatactatttatttgtctaagtttaggtcttagtggatttaatatcaacattagaaagttaccagaagtctatgtttatcaaaattgttgacttccatgcatccaaaaactgactctagggagtcatctccggcttgttaaaatgagctgggttaagtcagtgtctaaagtccaatttagaaaggtctcttagcacagccttttaaaaaatttataaaaatgtaaaatacaaacacagaaaatcacgtttaaaaatttgtactttagggaattattcctatgtgaacattcttataactgttgctcargtcataaaacagaactttrccagccacctcagaagcgttctatgccctgtctctatcacagactgtcttccccaatgaaagtgtagacttatttcagtcacttctttatttttcttaatagtttttrtcatagaaataggtattctaaaatagtctactttagtttggcctttgaaaatatatgaatttttagctgttttcatgtcatgtcttccttccatccttttttctcccttgcaattacttgctaaagaaattggattgtttgatctatagagtttctcagcctgggttttcttgattgctctaggtgtgtaggacttaagtgtttagaacaggcatggctgtttcatgcctcagtcctggaatgacattctacccagaatatcattctcttttgtctctcccttgccaataccttgctcatgtggttatcttctatctrtactccaaaacttagctcaaaactcacccctcctagaaatattcccagccttttcatttaataatggatatgtcctattctgtagtctcctagcacctgtaaaaaactccagtatgacaccaatcacatggctgcaattctttctttttctaaaaatatatatgtttagagatgtattggaaggagttggcttacaccatagtgggggctggtgaggcaagtctgagatccataggcaggctggcagaactggcaggctagaattctctggcataggctgaagtggctgtccacaggcagaatttctgctgggaagcttcagctctgctcataaggcctttcaactgattgaaacaggcctgcarcattttcaagaataatgttctttactcgaagtcaattgttgaaacaggcctgcaacattttcaagaataatcttctttactggaagtcaattgattatggactttaatcacatttacaaagtaccttcacagcaacacatagattagtgtttcattgaattactggggactgcwgcctagccaagttgatacattaaaaaaaaatcacactgcatcttttgattttcyttctgaatctctgcttttctttttcctaattttggcctctgtaaacctttcatttttttcatgctttagcattgtgagggacttaatactgggatattttttcacaatatcttgttcaccatcttacctgtcaytcttttccctgaggtactttgatccaacagacattcactcgattctgttgtgtgtcgggcagtgtgccactgctagggatacagaaatggataaggtatagttccctaccctcaaaaagctcaccgtcagttggtgggggacagacaggtatggtataaaattactgtgagtggtataaaattacctgaaggcataaaatatccagctagtgttaaaattttcctgatggtctcatattttctttacagttggtttattctccatcagaagttgaacaaggttcacatatcccttttgggtgatacgtctccaaactccctttataattgagaaattctctctttttccttgaactcatgaatgtgcgtattttcagtcatgtttaatatgatgcacagttggtatttttattctagattgctttaaagttttaacaatgctaacattgttacatatggatgtaacawagttaactccctttttaattgagaaattctctctccctccttgaactcactcatgaatgtgcttattttcagttgtgtttaatatgacacacagttggtattttattctagattgttttaaagttttaacaatgcaaacattgttacatgcttattataaaggtaacatgcacaactgagaaaaaaatttaaatatcrcaatgcatgtggaagtaaaatatcatttttatctcattatccccaaataattggtaaccctttgggattgtttcctactaatctgtacatattcaaatgtacagtttttacatattaaatattccctgtgctattactttgggtttaatttgctcttatttttctagatcataatgtagaagcttagatttttatgttttgtttatctaatacaaatatttaaagctgtaactttcccattaaacatgctgagttttcattatcataaaactagaaatattttctaaatttctttgtgatttattttctytgtttttktttgtttgtttgtttgttttgttgttgttgttgagacagggtcttctctgtcatccaggctggagtgcattcgtgctatctcggctgactgcaacctcygcctcccaggcccaagcaattcttgtgcctcagccttctaggtagctgggattacaggcgcatgccaccatgcctggctaattttttttattttttgtagagtggggttttgccatgttggccaggctggcctcgaactcctgatctcaagcaatccacccatctcccaaagtactgagattataggcatgaaccaccacgcctggccttctctgtgttttatttggaaatgcattgcctaatttccaaatatttggggattttccagatatcatattgctaacatttctactttaatacrtcatatgatttcagtcatttcaaatgtattgaggcttgttttatggtcaagcatataatttattcttgggaacgttctatgtgcccttgaaaagaatgtagattctgcagatgttgggtgtagtgatctttaagtgtcattttgggcatatctgcatgcaaaagaatgaagttgtgccacataccacatacaaaaattaactcaaaatgtattaaaacctaaatagaaggggtaaaactaaaacttrgaggaatgcataggtgtaaaccttcatgaccctagattaggcagtgattttttagatatgacaccaaaagtacaagcaacaaaagaagaacattgataaattggacttcatgaaaatttaaagtgtttatgcttcaaaggacaacatcaagaaagtgaaaagaggccgggcgcggtggctcatgcctgtaatcccagcactttgggaggccgaggcgggcggatcacgaggtcaggagatygagaccatcctggctaacacrtgaaaccccgactctactaaaaatacaaaaaattagccgggcgtggtggcgggcgcctgtagtcccaactactcgggaggctgaggcaggagaatggcgtgaacccaggaggcggagcttgcagtgagccgagattgcgccactgcactcccgcctgggtgaaagagcgagactccgtctcaaaaaaaaaaaaaataaataaaagtaagtgaaaagataccccacaggatgggagaaaatattctcacatcatatgtctgaacgggatttgtgtctagaacatataatgaactctttcaactcaataataaaaagacaatctaaaaatgaatcaaagatctaagtagacagttcttcaaagaaggtaaccaaatagccaataagcrcatgaaaagatgctcaacattattacccatcgaagaaatgcaaatcaaaaccacagtgagatattacttcacactcaactaggatgcctataattgagaaacaaaaacagaccataacaagtgttggcctggatgtggaataattggaactctcatatattgtgatgagaatgtaaagttgcattggaaaacagtctgacagttccacaaatgattaaacatagagttaccatatgacccagtaatttgactcctaggtatatactccccccaaaagaaaacatgtctacacaaaatctygtctacgaatgttcatagcaacgttatttacgtagccaaaaagtaaaaacagtccaaatatccatcagctgctgaatgaatgaatcaaagtctagctatacaatggactattatttggtgataaaaagtaatgaagtactgatacatgctacaacatgcataaaccttgaaaacattattctgagtgaaagaggcagtcacattttgtttatatgaaatgtccagaatagacaaatctatacagacaggttgcccagggttgggatgagtggtattagggacgtgtaaaatgactgctaaagaatgtagggtgacgaaaatgttctataattgattgtgatggttgcmcaatgctgtgattatagtaaagcacattgaactgtatgcatgttttaaatgagtgaattgcatggcatgtgaattatacctcaataargctataacaggtaaaacaaacaaaggaaccaygggtaccaacagttcagaataagtgccttcgatattacttagtattatggtgtctttggaaaaggaatttctcagatggagttaattgatttgaacaattcaagaccagtaggcaaattgccatagatggcttcccaagctggcagttaatttttttctgttaaaaatatatatttttttaattttttagagacaggatttcactttgttgcccaggctggtctcaaaccctgggctcaagtgatctgcctgccaaggcctcccagagtgctggaattacaggtgtgagccactgtgctcagccacaattaatgttttggaacatagttttcaaatgactatattaggaggatgaagtcttaggtaaatgaaacttacctgatttaaacaacagtatcatttaaatcacgattggtaatgctgttcacaccttccatattcttaatgatttattctcttgtcagtttttgcttcagatattttagagttctattattagctgctaaacatttaagatgattatggtgaccctgtttatttctggttatactacttgccttcaaagctatattgtcagatattaatatagccagatcagctttcttatactgaaggtctgcattttacccattttttccacagttttactattaacttgcctagtaaattaaggtgcttttcttgtaaacaacatagttaggttttgttttttcatcttgttgacaattgtttccttttagtgrtgtgttggacatttatattcagtgttattattgatatggttagtttaaatctgacattttgctatttttctttttttaaaatttcttctaaaaaaatgggatacatatgcagaacgtgcacataggtataygtgtgccatgctggtttgctgcacccattgacccatcctctaagttccctcctttcactccccaccccacaacaggccctggtrtgtgttgttccccactctgtgtccatgtgttcttattgttcaactcccacttacgagagagaacatgcggtatttggttttcttttcctgtgttagtttgctgagggtgatggcttctagcttcatccaygtccctgcaaaagacatgatctcattcctttttatggctgcataatattccacggtgtgtgtgtaccacattttcttgatccagtctatcattgatgggcatttgggttggttccatgtctttgctattgtgaatagtgctgcaataaacacacatgtgcatgtgtctttatagtagaatgatgtatattcctttgggtatatacccagtaatgagattgctgggtcaaatggtatttytggttctagatccttgaattgccgcactgtcttcaacaatggttgaactaatttacattcccaccaacggtgttaaagtgtttctatttctccacagccttgccagtatctgtygtttcctgactttttaataaccaccattctgactggtgtgagatggtatctcattgtggttttgatttgcatttctctgatgatcagtgatgttgagcttttttccttatgtttgttggccatgtaaatgytgtcttttgagaagtgtctgttcatatcctttgcccactttttgatgaggttgtttttttcttgtaaatttgtttaagttccttataaattctggatattagacctttgttagatgggtagattgcagaaattttctcctattctgtagattgcctattcactctgctgatagtttattttgctgtgcagaaactctttagtttaattagatcccatttgtcagttttggcttttgttgcaattgcttttgttgaggtctctgctctgctccattggtctatatatctgttttggtaccagtaccatgttgttttggttactgcagccttgtagtatagtttgaagtcaggtagtgtgatgtctctagctttgttctttttgcttaggattgtcttggctatacggggtcttctttcattccatatgaaatttaaaatagttttttctaattctgtaaagaatgtcaatggtagtttgatgggaatagcattgaatctataaattactttgggcagtatgtccattttcacgatagtgattcttcctatccttgaggatggaatatttttccatttgtttgcattctctcttatttccttgagcagtggtttgtagttctccttgaagaggtccttcacatcccttgttagctgtattcctaggtattttattctctttgtaacgattgtgaacgggagttcattcatgatttggctctctgcttgtctattgttggtgtaaaggaatgcttgtgatttttccacattgattttgtatcccgagactttgctgaagttgcttgtcagtttaaggagtttttgggcagagatgatggggttttctaaatatacaatcatgtcatctgcaaacagagacaatttgacttcctctcttcctatttcaatacsctttgtttctttctcttgcctgatttccctggccagaatttccaatactatgttgagtaggagtggtgagagaggcatccttgccttgtgccrgttttcaaagggaatgcttccagcttttgcccattcaatatattggctgtgggtttgtcacaaatagctcttattattttgagatatgttccatcaacacctagtttattgagagtttttagcataaaagggtgttgaattttatcaaaggccttttctgcatctattgagataatcacgtggtttttgtctttggttctgtttatgtgatggattacatttattgatttgtgtatgttgaaacagccttgcatcccagggatgaagtcgacttgatcgcagcggataagttttttcatgtgttgctgaattctgtttgccggcattttattgaggattttcacatcagtgttcatcagggatgttggcctgaagttttctttgttctgtctcttcttggtttggtatcaggatgatgctggcctcataaaataaattagggaggagtccctccttttcaattgtttggaatagtttcagaaggaatgatatcagctcttctttgtatttctggtagaattcagctgtgaatctgtctggtcctgggctttttttggttggcaggctattaattactgcctcaatttcagagcttgttattggtctatttagggattcttcttcctggtttagccttgggryggtgtatgtgtccaggaatttatcagtttcttccagattttctagtttatttgagtagaagtgtttattgtattctctgatgatagtttctatttctgtggggtcagtggtgatctcccctttatcattttgtattgtgtctacttgattcttccctcttttcttctttattagtctacctagtggtctaatttgttaatcttttcaaaaaaacagctcctagattcattgatttttttgtagggtttttcgtgtctctatctccttcagttcttctatgatcttagttatttcttgttttctgctagcttttggattagtttgtkcttccctctttagctcttttaattatgatgttagggtgttgatttgagatctttcaagctttctgatgtgggcatttagtgctaaaaatttccctcttaatactgctttagctgtgtctcaaagattctggtacattgtctctttgttctcgttgttttcaaataacttcttcatttctgccgtaatttcattatttacccaggagtcattcaggagcaggttgttcaatttccatgtaattgtgtggttttgagtgagtttcttaatcctgagttctaatttgattgcactgtgttttgagagactgttatgatttcagttcttttgcatttgctgaggagtgttttacttccaaatacgtggtcggttttagaataaatgccatgtggtactgagaagaatgtatattctattgatttggggtagagagttctatagatgtctactagatccacttgatccagagctgagttcaagtcctgaatatccttgttaattttctgtctcattgatctaatactgacagtggggtgttaaagtctcccactattatttcataggagtctaagtctctttgtaggtctctaagaggcacaccccctccaccaagagagaaagtgcttcatcaaactggtcctattacccgtgccacccaattgggtgagaccctctaacagggggttgtcagacaccctatgcaggagcgatcctactggcatcaggttggtgctcctcgaggtcagaggacacagaagaagcaggcacccatctttgctgttctctagcctccttgagtaacatctccaggwgcaggagcaaatcagatagaatagggcctaaagtgaacccccagcaaactgcagaagccctcagaagagggacctgaccattgaaagacaaaaaaaaaaaaaaaaactagcagaaagcaacaacarcagcawcaacaacaacaaaaaatcccccacaaaaaccccattcaagggtcagcagcctcaaagactgaaaatagacaaactcacaaagatgagaaagaatcaacgaaaaaatkatgaaaacccaaaaggccaaagtgcctcttctcctccaaatgatcgcaatgtctctccatcaagggtgcagaactgtatggaggatcagatggacgaattgacggaagcaggcttcagaagatgggtaataaaaaactacgctgagctaaaaggagcatgttctaaaccaatgcaaagacgctaagaacctttatgaaaggttagaggaattgctaactagaataaccagtttagagaggaacataaatgacctgatggagctgaaaaacacagcatgagaacttcgtgaagcatacacaagtatcaacacccaaatcaaccaagtagaagaaaggatatcagaatttgaagaccaccttgctgaaataaggcatgcagacaagactagagaagaaagaatgkgaaggaatgaagaaagcctccaagaaatatgggacttcataaaaagaccgaacctactatcgattggagtaccagaagaagacagggagaacagaaacaagctggaaaacacacttcaggatattatccaggagaacttccccaacttagcaagacaggccaacatgcaaattcaggaaatacagagaacaccaccaagatactccacaagaagatcaaccccaagacacataatcgtcagattctccaaggttgaaatgaaggaaaaactgttaagggcagccagagagaaaggccaggtcacctacaaagggaagcccatcggactaacagcagacctctcagcagaaactctataagccagaagagattgggggccaatmttcaacattgttacagaaaaaaattttcaacccagaatttcatatccagccacactaaccttcaaaagcgaaggagaaataaaatcctttccagacaagcagatgctgagggattttgtcaccaccaggcctgccttacmggagctcctgaaaggagcactcaatatggaaaggaaaaaccggtaccagtcactgcaaaaaacacaccaaaatataaagaccaatgacactatgaagaaactgcatcagctagygtgcaaaataaccaaatagcagcatgacgacagaatcaaattmacacattttgctatttttctaattatcctatctgtcctttaccttctgtctttccctttctgccttcttgggttaattgagtagttttaaaatatttcattttgcccttataactcagctgccaaatgtttgggttggtggggagctaaccttgctcttgaactgtactcctggctttccacatcttggaagatctctctttatcctgctggtcattggctttgcatttggtgaaggctcagtgcttctcagaaggatcactttcagccctttgacctgctcccagccttcagtggactgctgccttgcattctgcaarggcccagtgtacttgaagaggatctcttagcccttctgttctgttcctagcctttggtgtgtggtacttgtgcactgggtggaagctctatgggaaagaactggcaggtggatatggagttgctctttgatcagggctcttcagaattctaattcctcacatcagcagctaataaaagtttcttaaaaattcagctggtttcttcgtggtcccatttttggcaagtttattcctccttctatcagagatgaagcagctatgcrtctcttttttgggaagaggtcatctgtatatcgaatttatttaggagatgaagcagctatgcatctctattttgggaagagatcatctgtatattgaatttagtttatttaggttttttatgcatctcagctcagatagtttttatagaaaatctatgattttgtgacttcctcaacttcttgttgtagactctggttatttttaaaacttgtaatttaaaaattatatgccaatggaaacactcttcaagaatcttacatgtaatgcttattgcttagtggtttaatgaatgacaacaatccctgagtgtgggaatagttgaggtctacaaaaggttaatgagtaaatgaattatgtttactttgggtattgagtcactggtactgatctggccatacacgaatatccctaatcaccctcatgactagtaatacacatttataagatggtggaccagagctgggctagcgttgattgataagggacagaaagaaagtatagcgattgattattcagccttgsctcatgggcatttgtacatccttatgagttaaagtgagatgcaaatgcattcttcattaaawtggcttatctgaatcattttagagctgtatgcaataatttgcttatactcattaagataagtttggttatrttgattaaaaacaaagcttattttctgcattttcyaataatattgtaaaaaatacttcatacccttcattgtttgggtttcatgtcttcattacattccytttacttcgtattatcttttaagattttgtagaagaatttcacttgggtaactgtaggcttaaatgatgcaatgctttctggaatccaggggtgactgacacacagaggtgactcagacatgaaatgttcaacaaaattctaagrttgtcttttttttaaattgtaaattcttaaacattcataaaagtagtgagattagaataatgaaatcctgtgcttctaatgactgttaacacaagtgaatcttatttatcctatccactttattaaaaatttagttatctattatttaaaataatatattagcttattttaaagctaatcccagatattatgtttcattttgcatgtctgttgctgtcttggtaggaaaawttttaaaacataaattactatgacataatgatatctaacaaagttaattatttaagaaactttcaaaagttgctttttcatgccgtttccctagctacctataaacacctggaaattatatttattttatatttctaatgttattcaaatgataatatgctgatttctaaaattgcatttttttctgttgctctcaagaatatcctaaacatatccataggatgtgggatgacctatgaaaatagtctggacaaacatttatcttgtttatcttatgataagcagagttctgagaagtttggtaataaagagttaacttggtttaactaagattttcctaaattatttgacaccagaacctattttttatttaacatctgttagcaaaaatatatttgggggaatattgttctaggcaggagaatgctgcctctgaatagcaaaataatctttacttcatttttatttcaattaattaggtaattatttgtccatattacattatcatcataattaagtaatttttttttgtttttctgtaatctgcttaatattgataatgtggtgtgacaagtcatctttctcaggatcttattttatgaaaatctttcatcacacttattttatgaaaatcatttgctgtgtaagcaaattaartataagcattttgtgtttccactagatagatatttgcacacaaaaaaatagacatcaaaatcccatatagaaagctaaatgcatctatagttcattgaagaggaagctagaaataagatgtgtagaagtcaaagaaatagggccgggcgcggtggctcatgcctgtaatcccagcactttgggaggccaaggcaggtgggtcacgaggtcaggagatcgagaccatctggctaacatggtgaaaccgcgtctctactaaaaatacaaaaaattagctgggcgtggtggtgggcatctgtagtcccagctacttgggagactgaggcaggagaatggtgtgaacctgggaggcagaggttgcagtgagccgtgattgtgccactgcactccagcctgggtgacagagagagactccgtctcaaaaagtcaaggaaatacagctcaaattataacagtgaataactagattttgtttcatttgtgaagaattggcaaataacttttaaatagtttcaacataggcagtagcatgggaattctcctacacttttatgtacccttaaaatatgttcactttaaaaaatgtaaatagttaacaggggcgattgaaagctaactgcccaacaaaggaaacaattctccgtgtgtcccccttctctgctcaccctgtgacaccttctctgctcaccctgtgacacaggagcgacaaggaactcacaaggcactggtgccctagtagttctgcatctcatcctctctcatacagtttagttgacatctgctccctgtcactcacccatacccccaacctcaccaatcctccaaagtggattagttgttgcttaggtgtgttttgtctttatattgcgtaaatattgtgaagaagkctctttcctctgtggtgctacaaagataattttttttcccgttacagtcaagctacaacttcaagcagaagagagaggagttgtgtctatcaaaggagtgtgtgctaaccgttacctggctatgaaggaagatggaagattactggcttctgtaagcatactttctgttttcacaygttttttgttagcttttattgctgttaatttaccagcattgttgtttatcaaatctttataaaggattttacgtgtatcatcgtcatagtcaccctgtaaaatagggagtattttctttatttcacagatgcaaaaactgatgtgctgagggagtaagtaaagtaagaaaacacagctcatataaagtagagactggattgggctggaggcattcctgacctctaagtcactgcttttactctgcaaaactattaagctataatttaaaaaaaattttcttctattatgcagttgtttgaagatcattgggaataaatrtatacaattttgattattrgtttttaagtttcttctttagaatgtgacgtacaaaacactagcaatgtagaacactagttgagaatgtaagctttctgcctggtacagatgccgactctgccacttatgagctctgtgttcttgggcaaatgattctgagttagttctcttacctgtaaaatagaaacaatgatactatctcattgggattttatcagaatttaattagatactacacatcaagtgcccaaatcagcatytgacacgtaatagatcctgaaaattgttacttcttcctcacattacttctcatttacatatatgtcaggagagggactttttttttyytttttttttttgagatggagtctcactccactgcgcagactggagtgcagtggcgtaatctcgggtcactgtaccctctgccttctgggttcaagcaattctcctgcctcagcctcccgagtagctgggattacaggaatgcaccaccatgcctggytaatttttttgtattttttagtagagacagggtttcgccatgttggctgggctggtcctgaacttctgacctcaggtgatccgcctgccttggcctcccaaagtgctgggattataggcgtgagccaccgtgcctggctgtagagaggaacttttcttttttacatgttatcacagcttatcaggggtcctagttcctggctagtattctttccactagtacaggctccctgtcaacttcaccattattattagaaacgggactgcatatctgttgaacatatgatgtataaagaatggtgcaggaaaataaatataaaagacagatctcattcctgtctccgtgagggagtagataggacatgtatgtaaatgtttgtgcgtgtgtgtgtttcacagctcttacaccaatgccactggccagttatgacatctctatataacctccccacagaaaggatctaacagtactaagaaattgtggtattttgagctatacaaatagtttttgaaatttcttctgaatgaagacctttggatttctaaaagcaccaaaacaaggcttacagagaaaaagggtatctaaactatcccaatttcagactgactgtatgacaaagatatacttacattgatattaccagtttatgtaatttttgcaggataaatcacaagtttgagtgtagtggctctcaattttggggggaggtagttgaataaattttagaattctctttaagaatagccaatacttattaagtgaaagtgtgccagatgctatggtaggcattgagcttataaaattgaatatcaaattgtctctgcccttaatgagtgacaatccaggggaggcagaagtgtaaataagtatttataataatgtataagggttttgatatgctacttctatattttgcatacatgcatagtaatataggaaaggataagaagtattatgatataggaagcaatatagaaaatgaggtaattacatttttctagaattgggggagatgacctataagtagaattttagacgttgtaaaggaaggagttcagcaggcagtcatggggcagaagaaattgagatgaaggtatagataactctaggacataggacatgaaaaggtgtggataaaaaatctacttgatgtatctctagaattacaagtaattaactaatgctggaatgtatagtgcaatggagtaactaggtggaagggaagggagagaaggctggggaggtagatagactgtctgctgaatctgttgaagggctttatacaccatgctgactataagcagtggagagccatgaagagttttaagaagagatctaattagatttaaatttgagaaagatcatcctggcagaagtgtagagaatggacttgagggggccaagactggtggagagagatcagttagaaggccactgtaatagtccaagcaagtcatgttctgatcctggcaataacagtaggtcagagaggagtgaggaaagtgctagcacttgtgattgattagatttaggactgaagatgaaagaaaagtcaaagrtggcttttaggttgctggtttgggtgagaaggtagacgagaaaggggaaggaagaaaagagcaaggtttgggaaaaggtagtaagttcgaatttagacctatttagtttgagttgcctaagggaaattcaggtaaagatgttcagtgagtagttgaaattataaatctggagcttagaggaacagtctacattgattgttagatagatttgggtatgatcagcatataggtggtagttaaattgggggaatgtatgcagtttcctaggtaaagaatacagctcaaaacattaactacttgggactttcacttcttctactctgtacttgccttttattctgccaatctattgtcagctcaagaggtgatgtaatagtttgggaatctaccaaagtagcattttaaatatctcccatgamagtgaaccaataagtaattttggatgactgacattttattagtgagaggaagatgagtttccaaccctcctgcccctttcactttaggatgtgacaaatcactatgcttctgcagtagaattggtttggctactgtcagacagtgagggtggtagaggaaaaaaaaggagttgcacacaacatttgctcctgttataactaactatggacagcactaataaaatggttttaaagctccagccttttatatgtctgccataatctgggtcagtgaatgccttgagattagttgttaccctgtggtgttgttgagattagaagatgcagtaacctagtgcattagtccattttcatgctgccgmtaaagacataccagagactgggcaatttacaaaagaaagaggtttaattggacttacagttccacatggctggggaagcctcacaatcatggcggaaggcaaggaagagcaagtcacatcttaaatggatggcagtaggcagagagagcttgtgcaggggaagkcctctttataaaaccatcagatcttgtgagacttactatcacaagaacagcatgggaaagacttgtccccatgattcaattacctcccactgggtccttcccataacacatggaaattcaagatgaaatttaggtggggacacagccaaaccatatcattccacccctggcccctccaaaatctcatgtcctcacatttcaaaaccaatcatgccttcccaacagtctcccaaagtcgtaactcatttcagcattaactcaaaagtccacagtccaacatctcatctgagacaaggcaagtcccttctgcctatgagcctgtaaaatcaaaagcaagttagttacttcccagatacaatgtgggtacaggcattgggctaatacagccatcgcagatgggagaaattggcccaaatgaaggggctacaggccctatgcaagtctgaaatccagtgaggcagtcaaatctttttttttttttttttttgagatggagtctcgctctgttgcccaggctggagtgcagtggcatgatctcggctcactgcaagctccacctcccgggttcaygccattctcctgcctcagcctcccgagcagctgagactataggcacccgccaccatgccyggctaattttttgcatttttttagtagaggcagggtttcaccatgttagccagggtggtcttgatctcccaacctcgtgatcttccccccttggcctcccaaagtgctgggattacaggcgtgagccactgcacctggcccagcagtcaaatcttaaagctccaaaatgatctcctctgactccatgtctctcatccaggtcatgctgatgcaagagctgggttcccatcatattgagcagctctgcccctgtggctttgcagggtacagcctccctctcagctgccttcacaggctggcattgagtgtctgtggcttttctaggtgcatggtgcaagctctcagtagatctaccattctggggtctggaggatggtggccctcttctcacagctccactaggtggtgctgcaatagggactctgtgtgggggctctgaccccacatttcccttctgcactgccctagcagaggttctccatgagggccccaaccctgcgcaaacttctgcctgggcatccaggcatttccatacatctgaaatctagcggaggttcctaaacctcaattcttgacttctgtgcaccctcaggctcaacaccatgtggaagctgccaaggcttgatgcttgcaccctctgaagcaacagcctgagctgtaccttggccccttttagtcacagctggagcagctgggaagcaaggcaccaagtccctagactgtacatagcagagggaccctgagcccagctcatgaaaccattttttccttgtaaacctctgggcctgtgatgggaaggactgctgcaaaggtctctgacattccccagagacattttcctcattgtcttggtgattaacatctggctccccattacttacacaaatttctgcagcccacttgaatttttcctcagaaaatgggattttcttttctattccatggtcaggctgcaaattttccaaacttttatgctctccttcccttataaaactgaatgcctttaacagcacccaaatcacattttgaatgctttgctgcttaaacatttcttccgccagataccctaaatcatatctctcaagttcaaagttccacaaatctctagggcaggggcaaaatgccaccagtctctttgctaaaacataacaagactcacctttgctcagttcccaacaagttcctcatctccatttgagacctcctcagcctggatttcattgtccatatcattatcagcattttggtcagaggcattcaacaaatctctaaggagttccaaactttcccacattttcctgtcatcttctgagctctccaacctattccaacctttgcctgttaaccagttccaaagtcacttccacgtttttgggtatctttcagcagcaccccattcctagtaccaatttactgtattagtccattttcatgctgctgataaaagacatacccaagactaggcaatttacaaaagaagaggtttaattggacttacagttccacatggctggggaagcctcacaatcacggcggaaggcaaggaagagcaagtcacatcttaaatagatggcagcaggcaaagagagagagagcttgtgcagggggactcttctttataaaaccataagatctcatgagacttattcactatcataagaacagcacaagaaagacttgtctccatgattcagttacctcccactgggtccctcccgcaacacatgggaattcaagatgagatttgggtgggggcacagccaaaccatataacctagtaatcatggtgactctgtaagataattgcyggtggaatttttcatctcctcaggagcactggctgaatattgattcattgacaatgataaaaagacccattgttgttaaaagtgatgaaaacagaaattgctctatcttcaagtgtatctctgaaactactagggtacataaaaagatgagacaagttaaaagaatgtagacctgaaaagagaattctgactttttctcttggcaaataggtattaagcttcccaaactgttgattctgtaccatcagaaatgtaaaatactcaaaataaagttttctagtttcattcttagctaagcaggaacttgtgaaagttagtcttaaatgtgtttctatctctttggatgtattaactctttctgatggaacagatttccaccaagttggtgcagtaagaattaatttaccaatgcttagaaatgtatcacaaacactctgtagagacaaagccatggctattaagcataaattaaaaattcaggatttcttagtctcctttgaggaatggcatgaccaagatccagttgtacgtttcagctctcgtcatacgacctgttcacaagttaatctctagtcttaccatccaatttgtgtggcttgatgtcatgccttttcagcagcaatcctgtctctttcaaatgttcttggtgggctgtgtcaatcttcagatgaaaaagtaagcgtgccccacctcaacaccaaagatatggtgttggtgattcagtaagtggcacatttctctccgagtcagatccatagacattaaactgtcaacaacagcagcttttggtatgagttcagtgttctgaccagtagccatcatctggggatgcagatgtgcctcgtaacttgaagaaactggaatttatgaacttgcacttgccagaggcatagtccttcccactcttctacctggccctttttcagactactgtgttatgacacatccctgggttcttctccattttactctgtgattcctgcagtgatttctaaagcagtctagtttcctcccagaaagaagagtgctgtggatacaaaaaacattttggtttttaagagttatgttaggttgattaccaattagagtatgaaaaaagactaatttgtataccgttttttccccaacaccttcacatattaatggtatgcatgttttcaggttaccgattttgtgttgtttgaaaacatttcttaagggtctttcctttccttttgaagctaggaaataggaaaattcaaaaaataactatatttaattgccaaagcctgtatttggaagctgaagttaaatagttctttaatgcacaacagacttcttactccattccatagcaggataaattttgttgctatgagcaacagaagtccagaacaaatattagaattgatgatttaagtgttcacaaaattacagatttttaagaaaattgcataaagtgaagttaattgtagttttaagtttaaatcaccaaatgacctcaatgttagcattggtatgaaaaaactttactgatcttcatctgccagaaagttgcacattgttttctatataatgctatatagatcatgatataccctgaacaaaatattaatatctcagtattagaatgtaatttgcattgatccacaatagtgaaatatgaaaaaatgtatattctctgaggatatacatgtaatttctgtaaaagtaaaatacattttacctacagaataactttcttaattgaggggccttcacaatgacatgaaatctataataaagtaaagtagagaaaatagatatctgagagcccaattatccagactgacaatctatactgatgaaatttgtgagaaaaatacagtaattgaagaggaatatatatcctttttaagagataaaatactagaaaaaatacaaaggttattgcataatgagaattactgttcttttataactcaatcttaaaactgttatgcaacctataggtattacaggtttaagatcaaatttaggcctggcacaatggctcatgcctgtaatcccagcactttgggaggccaaggcaggtggatcacttgaggtcaggagtttgagacaagcctggccaacatggcgaaaccccatctctactaaaaatacaaaaattagccgggcatggtgatgcacacctgtaatcacagccaacttgggaggctgaggcaggagaattgcttggacccgggaggtggacattgcagtgaatcaagatcacgccactgcactccagcctaggcgacacagtgagattccatctcaaaaaaataaaaaataaaaagatcaaatttaattttaacttttcactatttggatgtttcttttttttctgaaatagtcaacattgatacttacatcatgtctgtttttaattctcagaagtggtataagcaaaagcacttttggattcctattgagcaagctccctcaaaagccaaaactgaaaaatcaatgtactgtaaaagaataaacaacccagtaaacagagcatggggaaatggtcataaggttcaaatctaaaattaggagtggactagtattgtgaggccgatgcataaggaagggagagttggggtgagaggaggtgctggggggatgtgaggagaacttggctcatgtgcttatttctttccttattgtgtactaaggctactagagattaggagggattctaaagaccatctaatccaatcttcttattttacagaggaggaaagtgatgcctagagaagttaaaggacttgattgaaaatacaagttagttagggatcaaggcgatattagaagctaggtttcttggcccttcagagatcctcacagatgtcaagtttggatagtcaactcttggaaaggtcatctggtctattttccttagggagtaaatagttcataaagttaaaccatattctgtatttcagttcctagtctggattttccccagtcctagttctctagttcttatttagattttgtaaatgtcattgaattatatttttattgtaagctatctgaaaaagttccatttgttcattaatttagcaaatacttattgatgacttactatgtgccaagcactgatacagcagtagacagaatagatgaatatcttcacaaacatgctgttgacagtctggtgaaataaagtgatatgtatatatgaatcatctgtatttgggcatagtagagcacaggaatgcatgaggtgcttttatttttcacattatagctagagttgctgtatctagtgacttgagaaatccttttttgtgatggtacttgtagccctagagtcagttttgtaaaaaatatattttagttttacaatggtattagacttacagaaaagttataaagatgacacagagagtatctatatactccacactgagtttcacttttattaacatcctacattagtttggtgcacctgtcgcaactaatgaacccatactgatatgttattattagctaaagtccatactttattcatgtttccttagtttttcctaatattctttttctgttccaggataccatatttagtcatcatgtctccttagtttcctccagactgtgacagtttcttagactttccttatttttgattactttgatagtttgaggagtactgttgaggtattttttagaatgtccttcaacttgcttgattttttttttcctttttttttttttttttttttttgagacaggttcttgctctgtctcccaggctggagggcagtggtgtgatcatagatcaccacaatcttgaattcttgggctcaagcgatcctcctaccttggcctcccaagtaggtgggactacagatgcatgccaccatactctactaatttgtttttatttttagtagaratgaggtctcactataytgcccaaattggtctcgaactcctgggctcaagaatcctcctgccttggcctcccaaagtgctgggatgacaagtgtgagccattgcacctgrcctgatgtttttttcatggccagatagggatttgagtgtttgagaggaagactatagaagtaaagtaccatttttgtggcatataatggtatatgttatcttcatgactgataactcatgatataatccttgcttacctggctgaggtagtatttgtgtccactgtaaagttactctttcacttcctttccatactatactgtttggaaggaagtcaccatgcatagtccacacttaagagatggagatgatggttatgctccacctccttgaggggtagtatctacataaatcgtcattcttttgcctgggaaatgtgttcattttcctccatttatttatttattcaatcatttatatcaatatgtattcacagatatttattttatactttgagttacaatccaatactacattatttattttgttgctcaaatagttccagctttggccattgggagctctttcagttggctcctgtgccctcctctttgacatactctcaacaatgcatttattttaagtacttcattactttttggcctacaagatgctccaggctcattttgtatattccctactccaccctagaatgagccatttctccaaagagcattggtttcttttattagagaatggtattagaaaccacaaactggaatgctgggtgtgcttgttgctactgaagtatctttgcttctaagccctctaagcttaagctgacagagcaagaaatggtggtacatactagcctgggtatatacatgtatttataaatatttctatatttggccatctgtatcaatattaatatgaggcagagcatggtggctcacatctgtaatcccagcactttgggaggctgaggcgggtggaccacgacgtcaggagttcgagaccagcctgaccaacatggtgaaaccctgtctttactaaaaatacaaaaattagccaggtgtggtggtgcgcacctgtaatcccagctactcaggaggctgaggcaggagaatcacttcaacctgggaggcagaggttgcagtgagcctagatcgtgccactgcactccagcctgggtgacagagggagactctgtctcaaaacaaaacaaaacaaaacaaaaacatctaaatatgagttcattcatactgatatctccaaccttaatccatcaataacaaatgaatattttagcagtcccccccacttgcttgtgtgtaacctgccacccccaacagtgagaaacatggctcccgccatctcctgggatcagtttttcattatgtagaaatatctcacataaccttattttctttttgaaattccaaagtaaattaactatccagacaaaaaacaaacttttaaaagtgttgattatgctttttcatgctacattagagtctgctctattcaaatactccctacaaggggtcaaactgccagcactatctttaacattattagcatcattatcaatatcaataaatggttattgggcccctcttatagaaccataaactaagctggtttatgtggacagcctccaggggaaccttgaggtgttgccccatcactaacacatgacaaatttatatcactatcatatgtatacatctacatttcttttttaggtttataccttttagacctgagaatacttgtttactggcattattgtatataacacacttcctggtattccaaataaattagtactttttaatttctagttctgtggttattagcattagcaaaaaagaaggaaaaaagttaaatgatgtgtctgttgcatagtaggtgctcagtaaatactgtctccatttggatgtctgatattcctctcaaactcaacacatacaaaactgaattattaaccttttcctataaaatctgttcctactcatagccctccccaccgcatttgatggcaagtttatcattctagaacagaaacttcagtgccattcttaattcccctgtttttctcataccatgcaaccaatccatcaggaaaccctattaagtctaccttcaaaatatgtacaaaagcagacacctccttaccatttctactgctacctccatgatctgaaccttcattctctctgcctgtattactgaataaccctttaactggtctaagtctgcttttggccctctgtagtcttggcagcgagaataatcctacaaaaagatgtcagatcatgttatttttctgctgaaaagactccagtggctctccattttcttagaataagagccaaatatttacaatagcctacaaaactatgaggtctgccccctctcccatcccattacctctctgatctcatttcctgctactcttcccacattggcctacttgctacccctcaaatactctggatatgatcctgttgtaaggcttttgcactggcttttcctctgatgggaatgctcttctctgatagctggatggttaacgccttcatctccttcaagcatttgctcaaatgtcactttctcaatggagcctactgtgaccatgctatttaatattgcacctagcttctaccactcaccattcctagtccctcttaccctgttcaggtttacatttttctaagttttcttatattctaacatagaatataatttattcacttaagcttattgcttattgtgtgtctcccccagctagaatttgagtggcataaaggcagggatcttgttcagttttgttcattgatgtgtcttagatgcctagaagaaaaaaatatatagattgaatgagtaagtgtattatttaaactctatgcttcctgtacctctaaattattcttcaattttaaaaaagcaacacataaacaaaaacttaatttgatataaaggtatcaagtagatgtaagggcaaaaggtatccaaaatctgaaatgttaccaaaagcactgagttttaaattcctcatttgttaatgagyataataatgttaaaatattgttgtgacttttaaagtatatgcataaaagcagtcaataatcatgcattaagggatttctcagctcttaggcctatataaaataaggctttggaaacaaggtacaagttgttataagcccttagaagccactttctttgtggtggcattcctctgaagacccctttttatccgaagtttgaaatggtgagcaaacactgataataggaaaacagttctttaaatatgtttataaagattaataaaattataatgcaccagtttttaataggcacactgagatcacagtcactgaagatgacttggaaactcagaatggagacaattgaaaattgtacatatgttgctctgttagacatctacttttcttgaccactaaattttggcsctactactcatttttttaaaaaaatgcagtttgttttcaagagcaaaacagttgtttagtaaatttgcattgctgaacattcagcacagatgtaagtttccttccctccactgttttttttcaaaagtagaaataacttttgtaataaataaataagtaaattaattaattaataagctgtgggttctatcatgtatccacttagtccctggtactgtttcttttctctgaaatattaggaactggctgaaaaggcaaatgttatwggaatagttagtattctagtatgccaagcattgtagggagtgccagctagcaaggtggggcatccgggaagctgatagaacaccaacaaatgaacatatgactaaatgctgttgtttaaatttacctctggggaatcagtctatgaagttccatggtgacctttcatgttgtctttatggttactatgaattttcctttcactctttgtttcccttctgcttctattcttgatcataaacctggaatagagaaaagggaagatttttttttcttttatcagtggcaatgaagatgacagaataaagtaacaggttaacttcagttcacacgagaggggtactaaatttcactagaggtagagtaaaagtattggatttggaatatattggtctatattactctaagtttaggtgtttcactcttatcacatttgaatctttatgaacagcacaagacagtcctgtgtttcatatagctgggtcctgtcaatgtgtgcttctctgtaaggctgtgatttatttgcatcatgaagaattgagtttctttatgagtaacgtattacataataggcaaattagttaagtttgtatttcagtttttaaaaatccatttaacagtggtcaaaatattaaaaccaagtaaatatccagtaaaattcttatctctagaagattacaggatctaataccacacccttactttagatggctgagacacattagtcacttttagttctttcccaggctttactttacatttttgttattatgccagctcttttccttgttttgccaattaatttatgtttttgtcacagtttgtgccattgtttgccttatcttagaaccaaggaatctgggaaaaggttcaagtctttttaatgtgggcttttccaaacctgaagtttcctagatatgagtatatagaaataaactggaatgtggtattaatacaaaaccatatatttatgtctctgtatacatcttatatttatgtgtttagataaaatttacatgtgttttctatataagtttatcattcgattgatatatatacacataattataatgtaaaaatgatttttccttttgaagtgaataaattaatttttcccctttgaggtcagtaagtatcttcagtgctaccctgtgaagttgctttttgaacaatttatcttttttttttttttkttttgttttgktttgtwtttttgagacggagtctcgctgtgtctcccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccgaacatttatcttaaataatgtggtagctattaaattccattacttggagtattatttccaggtctttttgaaagccagctatccttttttttttttttttgataaatagttgaattgaaattaaaaggcaaagtccctccctcctgaaagagactgccagaaatcagtatgatacttacttattcctcattgtctaacagtgtttggagattgttaatcatatgtaatataatgttccaatattatttttggcattatataccaatagctattttctgtacaataaactattcattattatsccttaaaaaacattagccacttaaaactttttgttaaaatttggggaattaactcttcttgtgagtaaagtattaacaaacctccttctgtatggaaagattacaatgggttagccttctactgctgcttctgataaaagtaaaaatgatccctgattggtaacctaccttgggactgggaagagtgtggatggatcataaatactgctggragctatagctttgggcttcccatagcatatttcttcttactgggtatgtccctccttgtgtttaacacctgacctgtctgttttggagctggagaattgtctctgaactcctactgaagagacatacttgatgctgtcctgctgacatgctgtgttcctggcctgcatccttcttcagaactagtctgtgtcacattttggcccattgaatcttgttagtttgattgccctgctgaacccaacatcactgctgctggttgagcagaataggcattatactatcataaatatttaatatgaaaagtgtaataataataatgataataataacaggtaattcttcctttatttttcagaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggrtaattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgcygaatactcaggacggacctgaattctgattttataccagtctcttcaaaaacttctcgaaccgctgtgtctcctacktaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttrtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattygtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcacyggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttckctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttcyagctgctttcagggttttatgaattttcaggcaaagctttaatttayactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattyatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacaytgaatttgatscaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactwcctgactattaaaaataaatagtagawacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcmttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataacttycactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccatttctttgtgtcttcttgtctatgaattcttttttctttttttttgttggggaggggcaggtggaaagatctgatcttggaatagggataaatatagwaaaatggattaaaaacaattatgagatgacatggacaatattcttatggctgacatgattacttttcttcctgttagagttctatctatccatcacgtgataaaagaaaagaatgagaaattataacatactcataagggagctgtacctttggctagtaccctatattcttcattcataaaataagttatggtccttttactggtttgctttgtgacacactcatttcctggatgaatgcttcttaaaagaatgtgtcatttctcaactatgctaggttggagaccagtggcatggttcccagagtttccatagactgttgattatgtgggtacagaattcaggctttcagtgtctgggctaggcttgacattaatttataaaggatattatgctttactttattaatgtagaaatatatctgtaaatatacctctatatcaatgcactgtcttctagattccatttggaaatattcccagaaggtttatttctccagaaactatgcagtctttgtcttgacaagatgttgaactttaccaccataaattccatttactttttgagacagggtctcattctgctggccagcctggagtgcagtggcaccatcagagctcactgcagtcttgacctgcctgggctcaggtgatcctcccacctcagcctcctgaatagttgggactacaggtgtgcaccaccacacctaattttttttttttttttagagatgagatttcaccgtgttgcccaggctggtcttgaactcctgaggttcaggctatcctcccacctgggcttcccaaagtgctggggttacaggtgtgagctaccataaccagcctgcaagttctgtttctaacaaaagaaaagttataatggagcagaccaatgtttcctaaaaacaataaaagtcaactttaaaaatctttgaccataaatgattagagattgttaattaaatctggagatgaacttattagaagggggaaaatgctagacataaggattgaaaacagctcacacaaatttgattttgactatttcataaaccttttatatggaaatattaggtatatgtttatgctggtaagtattttgtgacattttatggcaccacttaggtttttaaaatgcttacttctcccctaaaaaagtttgagcctgagtatagtcttaagcagtagacagtcctaagctatgtggtttgtgaaaaatctagttaatgtcctagatatgatcagtagtgagatgagcatgtcttcccacttttttttctttatatcaaacaattcccattagctgtgtttggcaatataacaacaacattaaaatactaatgctgggcacagtgcctcacatctgtaatcccagcactttgggagactgagatgggaagatcacttgagccttggagttcaaggctgcagtgagttattgtgccaccgcactccagcctgggcaacagagtgagaccccagacgctatgccaggtctgacccacagtctctgactgaatgacggatgaaaaaatgcactcaggcacagatcacagatatccaatgaaagagcaggctggggactgggccactcatagaaagagttgcagtagccacggccctgacaagccagtgctgcgggcatttactcagtacagatttaatgacaaaggccttgagtcaacacagttgtgggtaattaacatggtcatgcacccccgccaccccccccccggcccccaccaccactgccccagagagattagtcctgtgcgccaacggttaacttacctagatcaggttctttacatccccatgttacctaaactaagctttcaggcaccaggtaagagaatctggctgccttcatccaaatccttttccgaagcttttgtaaaccttccagccttccaagaaggtttgcatctttctacaatttttgccaccaccctgaccaatctcctacactatgctaaatatttgtataagaattatgcacatttaaacttcctttttttccttcggaaatccttttccgaagcttttgtaaaccttccagccttccaagraggtttgcatctttctacaatttttcccaccaccctgaccaatctcctatgctatgctaaatatttgtataagaattatgcacatttaaacttcacaatactcccatgagaggctataatttgttcccactttagaggtgatgaaacacttgactggggtcacacatctagtatgtgataaactcagtgttaaaatccaggcaggctggttctaaccatcttttaagaaattgtaaaagtcgatttgatattttctcactaatccttagtgactgtccactgctttttcatataccttttaatctcttcctgggacctaattggaacattctatgtaaatccaattagattctgtgtcttagacttacacttttccagggctcacgaatgtggactacagtttagtgccaaatgtctttgtatctatctgttgcttgtgatttccccatctagaatgttctgattggcatggaatttatttcttagctagtgatcttttattattctttctttccagtatattgttttatggcaaaaaaattactgaggattggttttgaaaatgtagcctatgagattatgttttcatctttgttctcccttcctataaaagaagatgatatctctatgcctcaagtgtaaaattccatgatccttttttttcctaatctcaaaaaaggaactttccactctcttgtgaaacaagtattctaaaatgctcttgtgcttagctgctttgttgggtgctactcaacattcacatatatgacccctccctgctttgagttggtgaggtctagttcctttaagcatatctgattttcacatactacaaaaggtatagtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattacaagtctgatgttctttgtgtgtgtgtagcagtaaatggaaaacagaagacagtgtggatgatgtaagggtggtctcatttatcactctgcaatccttccttccccactgttagaaattgctagcccaagaaataatcattttggctactaagaaagggtaaattttctgatgcattttttagagatattaacagaatgtaagatactttctctgttaaagcatgttcaagtttaaaaccactatttctttgaaaacttatcctgaagataaactcgtttatttgagggtttctagaatgggtgaaaggaatgattcattttctgattctttttctgttttccccgttccacagacatctgctttcctaagcagaggattcattttaagaccttccctaggcatggctactgaaatcctaaccagaagtttgtataaacacaacccttaaaagactactaatttctttcagccatatctccagaactcagagcaagggcacagacctgctagccttttccctttggttctcatatatatgtgaccctcttgttctgtctttactccaacttggtcagatgccagaaatttggttatcttttatttttcattgttctagtctttaataatcctatcgccttttataattcagacctactgtatttagataaatctcattagatacaatattatcactgttaccaatgagacagaagctaccacagagtgtctcataagtttgttcattcattcaatagaaatttattgcttgttaggtgttgggcatacagaagttaatgtatatggcaagcataaagaagttaatgtatatdgggcataccgaacataatgtacatggcaaacccagtcattctttttatcttggcaccatgtgtttttcttaataacacttatctccaccttacataacatttattcattttattatttgtatcttacacatttgaatgtaagctccatatgtagaaactttgcttaactccatatgtggaaactatacatctgttcactgatgtatacctagtgcttagtgcaccatgtatttttcttaataacacatctycaccttatataatattcattcgttttattatttgtatcttatgcatttgaatgtaagctccctatgcagaaactttactttgttcactgatgtgtacctagtgcttagaacagtgtatacagcagagtatgtataagaactcagtaatattcagtgaatgaattaatgggtccctacccttaactcttgaayacccagtttatgggtttaagtcactgttaggtcctttattacctaaaatattggggtagggatgaaggactggaatatgtgtgtagggaaagagaaaggacatgtgaatgtcrrtttagatatgtgtttgaatttgtgcatatgctcgtgttgagggttaaattttcctctgcaaaaaacacttgacattaatgcctggggagagtgaggtacatamagaaaggagagcaactggcttggatatctgaaaagaatgccaattagttgtttataataagtaaataagtatatataatctacatctaatttattaaayattaaatataaattacatatcattaatagctatcagttatattgaaatatcacctaacaccaaacatttacagaaattaaattattcctcttatttttattacaacattgaactatatgttaattcttaattttcatatttttttgctctctttgatggatctctgtttataacttaaaaaaatcaaaaccctacttaggagtgtcattcctacttaatccacaaataaactttcttatataatttgaacttctttagcttctaccagtaccaactgcctaaaagtgtagggkgaacatgactagattctgaaaagcatcactttcttggtcttaaaggaccaattattggcaggtttgaaaatcagcagagccaggaagctcaatgtgctagtttagtggttctcaaactttacatcagaatcacctggagggcttgtaaacacagaattgctgggctttatcctctagagcttcagattctacagatctggggtggggcctgagaatttgcatttttaataagttgatgctgttattgtctctcagctccgaatctgcccttctgtacttgcttagtgatgctggagctgggattctgctaaccagtttctgctttgccagctgaytcccttttatgctccaccattagactgcaaggctggaggaggaagggactagctccttaatgtgggccttctgtgtgctcgtggttcctgtgagtatcactgcttcaaggctgcttcactctagcagcagcatttccttcccatagtatcagcagaatccagtttgaagttttcctaacatttgtaaaagaagcttcattttgcatccccttcccaagagacaccagcaagctgatgcctcattctcagagatctgggtccagataaaccagcaccagctgaasagcaagaggtttgagttttaactgtgcatggtcccacatgaagggacccacaacccaccagaatggcataatgatgactctaaactgaagatatttaagatacagcagatgcagaaagaagcatttgtgagcttcccttatctgactaaaggcaaagctttctgagaatgaagctgccattaatcccctgagtaggagtgggggattgagggggttggggaagctttcagccaggaaggagactgaccattagcacctagatgagaaattgcataacaaaactttgtcagaagctac

SEQ ID NO: 13344 - DNA, 14943 bp, Homo sapiens
  misc_feature (1)...(14943): n = A,T,C or G, or insertion/deletion polymorphism (see Tables 1-2)
gtgggatgttgaagttcccaaccattattgtattggagtctatctctctcttttgatctaataatatttgctttatatatctggatgttcctgtgtggggcacatatatacttagaattgttatatccttttgatgaattgatccctttaacattatataatggctttttttgtcttttttaatagttttatacttaaagtctgttttatctgataagtatagctattcttgcttgcttttggtttccattagcaaggaatatctttttcctttccttcaatttcagtctatatgtgtctttgaaggtggggtgaatgtcttgtaggcagcatatagttgggtaagtaaaaaaaatctattcagctagtttgtatcttttaagtgaggaagttaatctttttacattcaaggttatcactgataggtaacgacttatttctgtcatttggcttattgttttctggttgttttgtatatcctttgttcctttcttcctctcattgtttatcattgaactttggtggttttctgtagtagtaacttcaactcttttctctttcatttatgtatttgctctactagtgagttttatactttcatgtgttttcataatggtagatataatcttttcacgtccagacgttctactctcttaagcatttcttgtagggctcgtctagtggtgatgaattccctcagttgtcgcttgtctgggaaagaatatttcttcttcattatggaaggacagctttgatgggtatagtcttcttggttgacagtttcttctttcagcactttgagtatattatcccattctctcctggcctatagtttctgctgaaaaatctgttartctgatggggagtctcttctatatgacttgactttttttatttcttgctgtttttaggattctgtcttagtcttcaacttttgagagtttgactgtgatcttcctcagagagaacatttttgaattaaatctacttgggaatttttaagcttcttgtatctggatgtctatacctcttgtaagacctggaaagtttttagctattatttcattaaacatgttttctatccctttgctcatctcttctgcttctggaactcccaaaatgtgaattttgtttgcttaatggtgttccataggctttctttattcttttttattccttttttttttttttygcctcactgggttatttcaaaagacctrtcttccagttcaraaattctttattttgctcaatctagtctactgttttttaatttttaattttatatatatatwtwttttttgagctggagttttgctcttgtcacccaggctggagcatagtggtgcaatctcagctckctgcaacctctgcctcctgggttcaagcaattctcatgcctcagcctcgcaagtagctgggattacaggtgcctgcyaccacgcccaactaatttttgtaatttttttttttttttagtacagatatggtttcaccattttggccaggctggtctcgaactcctgacctcaggagatccacccacctcrgcctcccaaagtgctgggattacagttgtgagccactgcacctggcctagtctattgtttgtacaagctcttgattatatttttttacttcatttattgacctctgtagttccaaaatttctgttttgttctatttttaatatctatttctttgttgaatttctgactcagatcataaattatttttctgatttcttttattatttatctatgctctcttgtaactcactgagtttctttagtatcattattttgaattacttttcaggcattttatagattttctttttgttgagatctgttattagagaattattgtgttcctttggaggcttcatgtttccttgcacttttgtatttcttgtgtccttatgttgatatctatggatctgatgtaatagctgctgcttccaattttatggattggctttgatagggaaagacttttgcctctaggtgtttttatagtgttagttgagtatagggtgctttggctttgattctgagtgggcacagcagtgtagtttctgtatgatttcttcacctgtcatcagtgtcagtggcatttgggttcctcagtggcttaggttrcagttgtcagcagacactatggcaaggctttgctggggatggggacaccaggcaggcctgttctcaggcamcagtggtggcagcagtggcctaggcttgccggttctcaggcccctgtgtgaaatatgtgggcactcgtggtgatgggtccttgagcctccaggagatttagttggatgcttgcagtggcagtaatggaccaagtgggagggcaggttcttgggcccctgcacaatttgtgtggcattaactgtagcagtaggaaaagtggaccaaccctctggcccccaagtggtagacacaggcagcagcaggctgggcaagccagtcctcaggaccccgtgtggcatgcatgtgccacaccctgtgtggcactgccctgccatggcagtggcaggcaggcactagcagcaaagggcatggtggacctgtcctcaggccccttggaggcatgtgtagatgtgtcgtagtcctgctgctagggaagatggggttgctgtaagtggcggtggccctgggcaggtaactctgaggctctggggaatgcacactttgactccctttgtcccagggaaagccactaggtgcactgtgcttcctgtttcctgggatgcggggcattgcatgggctagagtgctggggacctagctgcactgctgatcttagctggcattacaatgctgtagccctctaggtggacgtaggagaatatcagtggggcttcaggggtgtggagattcagggttgttgggccccagaacaggatgtgtatggtgagggctgggctcttaaaagagccttatgctgaagctgtttgggtctcagggtatggggtatgtgggacccaatgtgaagtcccattgtggaacaatgtgattgcatatattccagacagccccagggcatgtgaaggccaaggagctagctcatggctaggattacaggagtccatagtggaaacattgacctctgaagatctctcagttaaactttccctggaatgggaagttcctcctggttctgagctagtcccagctgggctggctgcttcacttccctcttctcccatgcctcagaggtgcactgtcacttctccgctgaattccagtgttctctcttagatgctcattcaatgtgtgattatctgctcactgttttggtccttctttgcagagggggtgagggctaggtgcctctattcagccattttaatgcttctccggctcattttttaattgttcaatagtattttattgtgtgaatgtaccagtttgttaatatttttatctattgagggatatcttgttgcttccaatgtttgacagttatgaataaagcttctataaacatccacatggaggcttttatgtggacataaattttcagttcttttggttaaatacccaggaatgtgatttgctggatygtgtgataagactatgcttagttttataagaaactgcattccatagtggctgcaccattttgcattcccacaaacagtgaaagagagttcttgttgctccacatcctcaccaacatttgatgttgtttttggattttacccattctcataagtgtaatgtaatttcattgctgtattaatctgcaaaaccatgatgaaatatgatgtcaaatagctatgtatatgtgtatttgctctttacatatcttctttggtgaggtgtctgtttagatttttgtgcccatttaaaaactaggttgtttgttttcttattgtggagcttaagagttctttgcatagtttggatacaagtccctatcatatatgggttttgcaaatatcttctctsagtctgtggtttgtctttttcactctcttgcagtgtcttttgcaaagcaaaarttttaattttaatgaagtccaacttaacagtgttttctttcttggattatgtttttgatgcgtatctcaaaagtcaycaccaaatccaaagtcacctagattttctcctatgttatcttctggaaattttayagttttgcattatacatttaggtctatggttaattttgagctgatttttgtgaaaactgtaaggtctgcgtctaaattctttctcttcttcttctttttttttttttgcatgtggaggtctaattgttccagcaccatttgttgaaaagactatccattctccactgagttgcctttgctcgtttgtcaaacagcagttgattatttttttgtgggtctatttctaagctctgtattctggtcatttgacctatttgtctattctttcaccaaaaccacactgccttgattgctrtagctttgtagcaagtctcaatgttaggtggtgtcagttatctggctttgttcttttaatttcttttttttttttttcctgtgaatgaacaatactttctgtttctttgcatggctaatttttttaaacaaataaattaragattcctttaatgccaagttacacaatcaaaaagataacaatctctttccatttgctttttgcaaggtttgtgttatttcagggcaaaacgtaragcaagtccactggcaaatctgggggctagtgattattttgttttgatttttatttttttaaatcagacattttaaacactacaatgaggtamctctaraaatcaaattctgtccccctttcccagaggtgttttatttatttatttatttattttttgacagggtctcattctgtcacccaggctggagtgcagtggtgtaatcacagctcattggagcctcgacttcctcggccccaaacaatcctcccactcagcctcccaagtagctgggactataggcacacgccaccatgcccagctaagttttgtattttttgtagrgatggagtttcactatgttgcgcaggctggctttgaactcctggactcaagcaatccacctgccttgccctccccaagttctgggactataggcttaagccactgtgcygggcctccctttcccagggtgtattgttgcttcttgtggcttatagttgcttgtttaatgacttttctaaataatttttataaagattattctttgtcatgtgtggctattacattttctgtccagttagcttagtggtcagccagtaacttgagatttctttaaacatctggagcaaaaacaaaaaccaaataaactagcaaaagcaaaaacaaaaacacccctgatctttgcaggttggctgtgttggatcactttctcaatgcttagccagtctattcacagctctgcyttagccttcactttctgcatgcatggaagctaaagatgagccagaggtgaagtttaggattttctcaggtctcctctgaacatgcgtccagccttgggcacgtgagtggacttctggactccctggtatatacagagatttcctcagccttttttctcccacatatctttytccatatatctttgcatatttcccagactttttgatgtgtctgctgcttgccccctctgttagcccttgctcaggtggctgcagctagtatrtttgcctttaattgtttacagcaaacaccagccagaaggctgttccagccctgagaaagttctaaggtgtacaaaacaaaggcaagcccctgagtgtgaatccctcaggcagcaaccagacaggtcaaaacacacaaccacaattctttgataacaaggcctatattgccccttctggcatgagcaagctatataactggttataaaaagtattacattaaattatggggacagaaatgactctactagtgaatgaagaaatcatttagattttatggttagtaagtggaggtttgagagtaaccatccgatctttattaatcttagtgtatattatatttctagaatttggactcatatcaagatgctctgaagaagaacraccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatattkggatttatctcataatcagttgcaaaagatatcctgccatcctaytgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattcygaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccaraggtycaaccttactgaattttaycctcaaccacatagaaacgacttggaaatgcctggtcagagtctttcaatttctttggcccaaacctgtggaatatctcaatatttacaatttaacrataattgaaagcattcgtgaagaagattttacttattctaaaacgacattgaaagcattgacaatagaacatatcacgaaccaagtttttctgttttcacagacagctttgtacaccrtgttttctgagatgaacattatgatgttaaccatttcagatacaccttttatayacatgctgtgtcctcatgcaccaagcacattcaagtttttgaactttacscagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataargaaaactgcacttgggytgagagtatagtggtgttaaatttgtcttcaaatatgcttactgactctgttttcagatgtttacctcccaggatcaaggtacttgatcttcacagcaataaaataaagagcrttcctaaacaagtcgtaaaactggaarctttgcaagaactcaatgttgctttcaattctttaactgaccttcctggatgtggcagctttascagcctttctgtattgatcattgatcacaattcagtttcccacccatcrgctgatttcttccagagctgccagaagatgaggtcaataaaagcaggggacaatccattccaatgyacctgtgagctaagagaatttgtcaaaaatatagaccaagtatcaagtgaagtgttagagggctggcctgattcttataagtgtgactacccrgaaagttatagaggaagcccactaaaggactttcacatgtctgaattatcctgcaacataactctgctgatcgtcaccatcgktgccaccatgctggtgttggctgtgactgtgacctccctctgcakctacttggatctgccctggtatctcaggatggtgtgccagtggacccagactcggcgcagggccaggaacatacccttagaagaactccaaagaaacctccagtttcatgcktttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaatracttaatcctcatcttactggaacccattccacagaacagcattcccaacaagtaccacaagctgaaggctctcatgaygcagcggacttatttgcagtggcccaaggagaaaagcaaacgtgggctcttttgggctaacattagagccgcttttaatrtgaaattaacactagtcactgaaaacaatgatgtgaaatcttaaaaaaatttaggaaattcaacttaagaaaccattatttacttggatgatggtgaayagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaatagcttatttaattttttatcctgctacacaaatatgtaattaaccaatgaggactcatgacttgatagtgtatgtatgtaaagggatatatggacttaatcataagctgttgaggtgaaagacgtggatccacctgctttccaagaaaactcggccaaatttatttgcagctggatattgaatgggacttttctggttgtcttagaattctggctaaaggctcaaagctgacgaaagacagtaactgcaccaacatgatactagacacagccagtctggacttatcaaaagagcagaaagagaccaatgactcccagtccgtattatccatctctagaagactagagtcaaaagcgtgattaaagagtcattaagcggaggttctaggccatagggagattgctttgaatttcttgcagacaagtgtgagggactcagcatggtagaaggtagcctggcatcccactccaagactgaaagcttgcagagtaacaggagcacacaggttcagtgcagcagatgtggtgtggcttgagaattcttggaagagcttgatgagtgtttgctggagtnbgagggtgggcactgggaacacagagactggtaaatagtgtttggcaaatacaagtgcttgatgaatatttgttgaatgaatagatgagttcttcccccctggggaattcagraggtraaaggttggcttgagcacccaaaatggcaggatgagagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcagtaagaggacacggggttaggcagaagaggggtttggggtggaggttgctgcaagaggtcagccagataatgtggccctgcatcatggaactgtgcaatgtggggtacactcaaggccctccaataactcacagatgtgccctatgaaaaagccagcatttggactctgccatagcagctggcaggatcatgctggcctgtctgccttattcaatagttaactacaggaagatctgctcctctttgtgtaataccctcttcccttgcaatggcatagggacatctagratatagagaagacagagacaatggaggaagagtaaagaaactgactatatgccttcktcatttcactgcaaggaaggccaagcagatttttgaatgaggtgtgagattgctgttaaattggactggcctggacattttaatcccttaaatagaggtgcaatgaytaaagtgagatttgtcactaaaatttatggtatctgcccaagattcaggagtgatgwtgggaggagatccaacagaactttgttgtaaggcaatggttagagaaaaatgaagccctcgctttctggacttagttcattcaataaaccagtttcggccaggcacgttggctcacatctataatcccagtactgtgggaggctgaggcaggtggatcacttgaggtcaggagttcgagaccagcctggccaacatggtgaaaccctgtctgtactaaaaatacaaaaattagccgggtgtggtggtgtgcacctgtagtcccagctactcgggaggctgaggcaggaaaatcacttgaacctgggagacagaggctgtagtgagctgagacagcgctactgtactccccgctgggcaacagagtgagactccatctcaaaaaarttaaaagaaaaaaaatctggtttcataatagctgtaacgaaataagccttaatgatattttattagcatcatcttctgtctgcattagcccttccttgctcttcaggagaacaacatttgttttcctccctaggctctatcccaaacggcacattcttccacaacccctgttgaacagattttttaaactgttgcctaatctaaaaacaataaaaacaacaaacaaccacagtaacaacaacgacaaaaaaaactgccacagattctaaataatcagatctttttaaatggtatcaatgtttcccacaaaatattgttgacattgaaaatatagaattttagcattaattttgttaaacctacatcccctcggcagaggggcctccctgcatcccagtggaaagtaggttcctcacagtcctctccgtcacattcttcccatttcttttcttcacagaacacatcactgtctaaaattatcttgtttgcttagttgcttactcatcttcttcttctctcctctgaagtctaagctccaggaaaaagggagacttctccacctgttccctgcctctccccagtgccgaggggacactgtgcaccccattgtagatgcgcagtaaaaactcgtgggatgagcaaatgactctgaaacggtcccatgcgggaaatgtccatgaagtcctggattttatctaaaaagcccaggcrggggggggcgggggcggcggggctacagttccacgctgagctgcctcctggccgctcgtccccgccgcagtgcctgggcggcccgggcgcccgaccttggccgtggacaccttcgcggtgsgtgctgctcctccccatctgccactggaagatgctggggcgaccyggctccaggtttagcaggacactgagaaaagggaatggctgcctttcggaggctgggtgagcccttctctgtgcctcacctgcccgccccacagcggccctgcacctcgtcccacggggcccattgccccggtaggatgcgcgcttttgttttgagggtcaggcatcttccctgccgtcgtttctgggaggttgaaaaattgatccagaaagacctaaaacaaaaaacaaagaaaaacaaaaaagcgaaaaggaggcaaaacaaaacaaaaatccatacaaataaagtatctcctccatccatgtttgcactattccttctcattcccccgtccaatgccacaatttggtaagtttgcctcaacacgttttcagttcttaacactgtgataagaataaacaatagatcccrtagtaagatgacctgttaaaaggaatggggcatggcagagatgagtttggatgaggaaaggtgtcagtccgtttgggctgctctaactaagttctgagatgtgtgttaggtaattttgactttggttgaacatcatagagtgcactcacacagacatagatgacatagcttactacacacctaggcttatggtatagcctgttgcttctaggtgattgtaacacaatgcttagtatttgtgtatccaaacatatctaaacatagcaagggtatggtaaaaatatggtaaagaagataaaaaatggtacacctgtatagggcactgatgtgggttggctgtgtccccacccaaatctcatcttgaattcccacgtgttgtgggagggacccagtgggaggtgattgcatcatgggggcgggtcttttcctgtgctgttctcctgttagcgaatgggtctcatgaaatctgatggttctttaagggggagtttccctgcacaagttctctctcttccctgctgacatgtaagatgtgacttgctcctccttgccttctgccatgattgtgaggcttccccagctctgtggaactgtaggtccaataaacctctttcttttgtgaattgcacagtctcagatacgtctttatcagcagcatgaaaatgaacgaatacaggcacttaccataaatggagcttgcaggattggaagttgctctgggtgagtcagtgagtgagtgaggggtgagtgaatgtgaaggcctaggacattaccatatcctactgtggactttaccatgtcccactgtggactttataagtcccattgtacatataggccacacaaaaattattaaatttgttttctttctttagtaagaaaaattattaaaattgttttctttctttagtaagaagtcaaccttagcttattgtaatgtttttactttatcaactttttgccttaaatttttttttggctctttagcaataacacttagcttaaaacacacattctacagctatataaaaatattttccttctttayatctttattttgttttttctatttttaaaatattttatttttatttttcactttttaaacttttctgttaaaaactgagacacacacacagacacacacacactagcctaggcctactcatagggtcattatcaatatcactgtcttctacttctacctcttgttccattggaaggtctttaggggcaataacatgcatgaagccatcatctcctgtaacaacaatgccttcttctggaaaacctcctgaaggacctgcttgaggatttttatagttagcttttaaaaaaataagtaggagcacactctaaaataatgattaaaattatagtctactagatacagaaaccggtaacatagttgcttattatcattatcaagtattatgaactgtacataattgtatgtgctgtgcttttatatgactgtcagtgtcgtatgtttgtttacagcagcatcaccacaaacatgtgagtaatacattgcactgcaatgttactaggccataggaatttttcatctccattattatcttatagggccatgactgttgagtgaaatattgttatgcactgcatgactgtaccacaaattgagtagcttataaacaatggaaatttatggcttatagttctggaggctgtaatgtccagggtcaggctgctgacagatttggtgcctggcgagggcccactttctggttcatagatggcttgtcttttcactgtatcctcacctgggggagggcactaatgccattcatgaaggctccacattcatgacctaattgtctcccaacatctccaactcttaatacagctctttctccgtatccacaggggattggttccaggagccctgtagattccaaagtctgtgaatgctcaagtcccttatgtaaaatggcatacttccaacctgagcatcatagtgagaccccacctcctcaaaaaaaatacatgcctggcggcacatgcctgtagtcccaactactcaggaggctgaggtgggaggattgtttgagcccaggaattccaggctgcagtgagctatgatcatgccgttgcactatagcctgggcaacagagcaagacactgactctgaaaaaaaaagtgtactatttacatataacctatgtacatcctctcatatacttaaatcatctctagatttcttacaatacctaatacaatgtaaatgttatgtaaatgttatgtagttgttaaactgtatggtcttttatttttattattttgtattattatattkttattatttatttattcatttattgaatattttcaatccatggttgtttgaatctatggatgtggaacccatggatatgaagggctgattgtattatccccttgggggttaggatttcaccataggaattttgrggggsacacaaacatccagaccatagcaaaagagataagaaacctaggttagtgaccagggagggctgctaggatgagccttgatgaaagatctttcatcaggaggatcctgggcatgtggctgggaaggrtcctgggcatgtggctgggaagacccttcaaaggggagggcacagtgggtgcaaagttggaagtgaaagaataccatgagcgaagaaagcatcaaattggcagtgttgctggatgtgttagtttcctgtggctaccaaaacaaattaccacaaactgggtggcttaaaacaacagaaatatatttctcccagttcaggaaggcagaagtcagaaatcaaggttgkcagggttgttccttccagaggctgtcagggagaaatcatccctttcctctctcctagcttctggtagttgctggcaaaccttggcgtcccttggtttgcagatgcatcagctg

SEQ ID NO: 13345 - DNA, 53323 bp, Homo sapiens
tctatatataagatcatgttgtctgaaatcatagacaagttcttgtgatttggatgtcttttatttctttctcttgcccaattactctggcttggatttccagtactgtgctgcatagaagtggcaaaagtgaatatccttgccttgctcctgatcttacaggaaaagctttcaacctttcactattgactataatgttagctgtgggcttatgtatatggcctttattttgttgaagttactttctttccacacctgagggtattattccttcctattgcctgagggcactattccttctttaccaattgttatcataaaattatggtaaaatttgtcaaatgctttttctgcatatattgagatgattatatggcttttgtccttcattctgctaatgtgtgtatcacatttatagattttcttatgttgaaccatccttgcatcccaggggtaaattacacatgatcatggtgaataatccttttaatgtgatgttgttgctttgtagttactgtgagacttagataaaacatataatagttataacaggctattttaagctgataaaatttaacttcaaggataaaaaaactccacacttttactctccctccacatttwataggtttttaatatttttcagactttatgyttttgatgttataatttacatcttttatattgtgtatctgttaacttattgtggttataattatttttaatagttttgtcttttaaccttcattctaaagatataagtgatttatacagcacaattataatattggaaaattctgaatttgactgtatttttatttttacctgtgacttttatactttcgtagattttcatgtaattaattaacrtccctttctttcagcttgaagaattccctttaacatttcttgtaaggcaggtctcgtgttgatgaactacctcagcttttatttgtttgggaaagtctttatctcttctttatttctgaaggatgggactcttggttggcagttttttctctttcaacactttgaatatatcatctcactctctctgggcctagaagcattctgctgagaaatcttgtgatagccttattgcaattcttgtctgtgatatgcttcttttctcttgctgattttaggatcctgtctttgtytttgatttttgatagtttgattattatgtcttggtgtagtcttttttggattgaacctgactggagatttttaagcttcctgtacctgaatattaatattttatttcagatttgggaaattttcagctagcaatctttaaatatgctttctgacccccttttcctctattttctccttcttaaactactgtaatgtgaacattagctctcttttttaatttttaatttaatttttgtttttattttttgagatgcagtctcactctgtcacccaggctggagtgcagtggcatgatctcagctcactgcaacctttgccttctaggttgaagagattctgctgcctcagtctccccagtagctgggattacaggcatgtgccacaatccctggctaatttttttgtatttttagtagagactgggtttcaccatgttggtcaggctggtcttgactcctgacctcaggtgatccactcaccttggcctcccaaagcgctgggattatggcatgagccactgagtctggctgaatgttagctctcttgatgctgtcccataaatcttgtaggctttcatcatttcttttcattcttttttctcctctcactgtatattttcaaaaacctgtcttcagttcacagattctttcttctgcttgatcaagtctgctactggtgatttctactgcatttctcacttcattcattatatttttcagctccaatttcttttatgatttcaatctttctgttacatttcttatgttgtgcatttattgtttctctgatttcaccaaattgtttctctgtgtttgcttcaaagtaactgagcttctttaaaaacaattatcttgaatccattgtcaggccatttgtagtactccatttcttttgggtcagctactgggaaattattgtgtttcttaggtggtgatattttaatttgggttttcatgtttcttgctgccttacactgctgtctgagcatctggtggatctgccccaatttcaggctgtatgggctgactttggtggagaaataccttcttatgtggaataatgygaggatgctggctgggtgggatgcaaaagttctgacttcagtaggggcaaagctgtgtggtctccatgcagatctgtcagctgaggttggtgttagtgaatactacagggatccttagaggccaacactgtgggtatctacagtggcaatgaggctgttgaggttttcaattgtgacaagtcctccatatctctttttttccccacctgggaagtcatgactgaggacatccctcttggaattaggtctaacttgcaggcctgctcctggtggtggtgacactggtgtctgatgaacagtgcccatggagtggccaagagccaaggcctgaagcatgggcatgcatggagggaccacagcaccagattcaattgtagcaatrgtaccagtgcccaaggcacaggcatacttactatcacattgataatggtgtgtaaaatgcaggtacttataaagcagctaaggagccagggactttactgcatgcatacgcagagctacagtggctccaggatccagggtgtgggctagctctccttggtggctgagctggtgactagagcatggacaggcacagagaaaccttgactctaggacccagggtgttcactagctcactatagtggtggctctggtgttggaggtgtgggtgtgtgtagtacagcctcagagacagggtctggagcgcaggtgtgcacattactacagcagctctggagttgagaatatgggttacctttctacagtggctgaactagtgtctggagcaaagactttcacagagagaacttggcttggggtyccagggtgagatctagttcacaacagcagtgactccagtgtctgagacatgaggaggtgcactgcagccacagagccacagtccagagtgtgaatatctgtagagcagccacaacttttggggatcaggaacacacatagacttgtgagaggtggtaaccctggccccagtcctggggcagtgcaacaatagctgcttcttggtgagggggtgtgaggggtagtgcaactgtgtttccctttttagcatcctgctatgggaatggctgttggayaaaagatgccagtgtcctctgtggagcaggacactgggggyctcagtggctctgtgtcacatgactgacacagatagcctacaaatttctttattsgtagctatctcctggtgtctcatatatgccagtctcaccggtgattcttctacatggatattctttcttttctccattgtgttgttccaaattctttaacaggctcttgagccccatcccccaactccccacccttgtgagggctattttggtttgtgtataactgtctatgtttgtttttttgttggggcataaggctgacatctcctactccaccatcttgctaatgtcacctgcataggaatctttttatgctttccttatattcactaaaatttaacaatatcaaacttaaaaacatatgatcaattgaacttattaatatcaaacttattataaataagaaactaccaggctgggcatggtggctcatgcctgtaatcccaacattttgggaggctgaggtgaaaggatcacttgagcccaggaattcaagaccagcctgggaaatatagagagaccctatctctagagatttttttttttaattagccagtagtgatggcacacatctatagtcccagcyactcaggaggctgaggtgggagaattgcttgagcccaggaggtcaaggctgsagcaagcagtaatcatgccactgcactccagcctgggccgcagagtgagaccctgtctcaaaaaaagaacctactagtctacataccacacttcytcatccccatctgagactatatatattttttctaacatgaggcaatgccaaaaagwggrgctggtgagtgaaagtaagaacagaaagacatggaggcaagtcttatagaataatagccaacacttaaacttacacttaacagcgtgataggtattgttccaaacacattaaattcatttaatggtccttacatgtctatgtatttggtgaytattatccttattattcacattgctgagtgtattattctgttctcatgatgctgatagagacatacccgagactggataacttattaaaaaaaaaaaggtttaatggactcacagttccacgtggatggggagtcctcacaatcatggtagaaagcaaaagacacgtcttacatggcagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcrctaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccaraagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccatttctctctatttttttttgtgctactaattttgcttctttccctcagaaggctgccggaatagtaaacattcactgacatgtcataattactggaaaatgggcactggaaaatcacattgtaattaattcaaagcatgttttccraatgtactactttaaattggagcttatakcataatccaaggaaacctttgtgtgtgtactgttcccacattgctcagcctgggatatccaggagtaattcaccttgcgcctgcctccagaccatsttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacagaggagatggtgagtttatttttttctgcatgggaagtggttgaagtgagttgragtggtatggrgtaaagtcaggcaggtaaaggttcagaaagtgaggaacagcgatagccatggagttttatgttgaattgcctattagattttgtgagtacttttaaacttgctgtccactttgaccctcccaacacccttgtgagttgaggttgctatttctattttacaaataaagccatcgtggtttacagaggctgtgttttatctaagcttcactgttaggctacatgatgttgggatctggggcctgtcctctggctccgcagstgctgttcctcctactagaatttataggggmtctctgagaatagatcatggtaaacctgtcaccccattttccaagactgtacttctctctgggataaatgatggaataaatggaagactgggtaggtgcyctgggacaagcttacaattgaatagtttctcatccccatccctcccatttctttctgtgagcctatgaatcttctgggactgatctggaatatccacatagtttccttttctgccctaagaytcaatcttgttaatgactcagtttcttcttctataaaatggatatagtaataatactctatagtttcatcatgaggattaaataagattttgctgaaaagcatccagatctgagcctgacacatagtaagtgattagtaaatgttagccattattgttacaataaaaagaaaattcttaggaatagtggggtttaggattcagggaagatcyaaggatagctaggcattttgaactcagcaatgttatatgctcatggataagatgcacgtggttaggctacttctaattcagggaagatccaaggatagctaggcattttgaactcagcaatgttatatgcacctagataaaatgcacatggttaagctacttccaattttcctcagactttccaagagtatcccacatagtcccagggtccgaaatcctgcagtcygtggctatggaggaacmaggcaggtctctgtttttgagcacctttctgtgggactccagaaaaaagtaccgcatacacctgattcatcctactgctttgctttactatagcacacttttcaagtacttataatgtgggtttctgtgttggggaaaacaggaataagagtatgataaagagaagaggaaggagtttgagcctgtcttaagtttgaaccacaatgacctaaggatatgaattacttttgtcctgtctttttgcatgtcatacttctgaattggttaacttaaatgagcagttattcctctcttccttctactctccttggcatcctcstctatttcaaaggtatgaacttattggatcagagagttctttgagattttgatgaaagttacaacttgtctttcccagatgaaagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaatatttcaaagacaagacctcttccttttcctctgagcacatttggccccaaagattcagaaacctcaaactgcctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcatgcctgtaatcccagcactttgggaggccgaggcgcatagatcacttgaagtygagagttcaagagcagcctggccaacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaaaaaaagttttagtgggctaaggagcaggtctggrttttcgtccatttataccttttaaccaccttatgtggcttccagkccttactcttcttttcattacctgtttttcaaaatgcaactaaaatagttcagactctcctgggctagccaccagctcttagaatgtgcatcttcagagatctttaagtagaagcttattgatcaaatcctcaaaaatcaaaatgacttactacataaaaaactgtgtttagaaaaaaccctggacctaaacctagagagtaggcacacagtggttttataaatgacattcattatattgtcttcaaggtgtctaatctttttgattaaaaagtaaatcagaaacttcatgaagtcaaatacagagcaaatcctcactatttgtagagatataactcatctctgatccaatagactttttaaaaaattttaagtgtcgtactttatttttaatgctaatattttactcaaaataatggcaattggtagtctaaattaaatatatgcttggattctaagtgttgatgtcctgggtcccttcttgtctatattcataatttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcactactctcacccctataatatcagcatttttggaggccaaagaaaaagtattgcttgagcccaggggctccaggccagcctgggcaatatagtgagaacttatctctacaaaaaattagccrggygtggtgaygcatgcctgtagtcccagttactcaggaggctgagatgggaagatcacttgaggccaggaggtrgaggtttcagtgaacccagatcatgccactgcacttcagcctgggcaacagagcaagaccctgtcccccagccccacaaaaaaaatcataccaccattaagtgcatgtgttcatgatacttctctgttcagaagtatcccttctgccaactggtatttgtgacccacaagatatggtctcaaactaccttttcagttaacctctaggatctcccaatcttcagcaggctggagtgcagtagtgccatctcagctcactgcaacctctgtctcctgggttcaagcgattctcctgtctcagccttctgagtagctgggattacaggcatgcgccaccatgcccagctaatttttgtattttttagtggagttggtttcgccatgttggcaaggctggtcttgaacttctgacctcaagggatctgcctgccttggcctcataaagtgttgggattacagatgtgagccaccgtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatatttttcatgtttacttgtttagtactgttgtgtagttattagtatttgtttcattgtcttctctaccaatagaatgtgcattctatgaggactggaattatgtctgttttcaccattttatttgttcacttagctattatcactactgtaaaagtaatgcattcagttataattattatgtatttttccaacattttcttatttagcatatttttgtcttactttcagttattcctctgccattattcattcatatatttatccataaaatgtttattgagtattgagtatgtgccctaccatggctggggattcaracctgagtaagtaatagtccttgcccttgagaagcctctgtcagtagcttcctcagctgtatgctcacatgtttgttgcgcatttaaattgtggacctcctgctcaagagaatattcagaaacggagatgctgattagaggacaytggaaacagatgaccataaggaggtcatctttacttcccaggaaagcagaagaatgagaagagaatagggccatggaggtgggaacctagagaaacacttacctctgcaagggaaggcagaggattgaggtagattcagaagaagactcagaaaagtttctcaaacattagagcagaagaacaacagaagagctaagggaagcattttaggcaaaaggaagtagtggtatttactgctacagaaaggtcaaggaagataagggtggaaagtcttcatttggtttggtaatgaggatgtcagcaatgaagtttgcagggacactttgataggatggtcgggcagtgggctggagagtaagggggaggcaaggaagttaagaaagtttagctataagaggaaggagagaaacaggcagatgtgggcaggaggacaaagggtcaagggagggacattgtttgattccgcctttctaaaagcacaaagctgtggtctacaatgtagacaaaaagaacaagatctcctttctgtggcactattcttgccaactttgtaagccacctggaacgtggcaagccatgggacacctactagcctctggtacctccttgtgtgaaaagttaggtcaaggcatttgcttcttccactttctctctgcttttctcttcaccctgcaatcattawtagtttttttgcttgtttgtttgttttgttttttgagaaagagtctcactctgttgccaaggctggagtgtctcggctcactgccacctctgccttctgggttcaagcgattctcctgcctcagcctcccaagtagctgggactacagacatgtgccactatgcctggctaatttttgcatttttagtagagacgaggttttaccatgttgccaggctgttctcgaactcctgacctcaagtgatctgcccaccttggcctcccaaagtgctgrgattagaggcatgagccactgcaccagcccagttytttattaaagtaaaattaaasataatcatggtacttaatgaaggcttacacaggcacaggatgttattctaatgacccagtctctgactcctttccagcaacttccagttgaaccagccttccagagaacattaaagactagcagagcatgtggatgcttctagagaggaatttcctcttgttttagtatttaacttgcttagtaacacaggacagagcagcatcctgcagactataatgcagagtaggagcaggtatgagaaggcctgcccaccccaagcaggtttcagaggaaaactgttactcaaagaagatttttaaacatcatccattctccatacctccacacaaaatccctatcagttgccttacagttaacacagaatcttgaacttgggccacattaaacatggacagacttagtaggtcatgaaccatctgagattctctaaactactgcaagcatgcatttgttttgaagaaatctgaccacggcttttatcagattttcaaaattcataagccctggaagaataagaataactgtgttaaccctatgcacattcatgtgagcaagcttgggcaaaycatttacgctcactgagtctcagtggtggggagtggtggctgccccatcttaggcattcgaagtctgaaagacttcctgcagaacagcagataaatgctaagttggcttggaagtgacctttatgktctccyatagctctgaaataacctgtaagaggtgaatcttggtatttggtgatgcatagaaacagaaaagtaygtcagattaaagcaggggatgcacactgacttgcattttcctttcttagatgttgtgccktcatcaaaagcactgtaccagtcctctaaaaccttcaaatgtttaaaacaagttgtctcgctctctctcactttgttttatcttgtgtggtagagaatttgctgatgaaattttgcttaaaaaaagttcaaacaaacaaacaaacaggttaaaatgggaaacatctctttttggaaattttgtttaaaccaaatcttatttaaaagtttaaacaaacaagtcaaagcasgaaacagtgggtagggttggccactgtgatgggagactgggagcctcaccgactccttcgccctacacactcttgtgagctggccccaaagccagggaaatccctagaaatamkctgttcagggagaaaaccacttccacaggaagagtaccactaaatttaaaatcgttgcactccttctgcaatctgtctgaatagaggcaaagcccaggttcaaaggcaagyactcaggtccccttcatgaaggctgcagagttgtgctcttcagcagcaatatttttgctcctatacctccaaaaatatcctggaacactatgttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggctcttaagaaattttatattattcatttttctctccttgaatagttatttctatcccacttctacagtatttagcctaagattacacattttaagcttaaagtattttcttgattattatacttctttgcaaaataaaaatataaaatttcaattttctacaactgtaagtctctatgtgttaaaatgtttttcttttctattgagttagcatkacaactactttcagtacacaattaaataaagtaaatatactrcaagttttgacaagtaacttaaamctttatatttaaattgctattaaagattcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatttacaatattcaaattcttaatacctataccaatatttcgaatcatctctggcatacgaatgtatttatatccaarggcaaagctctggaataaataagaaattagtaaaaggtayaatttttctcttataaagtggragaaaggtgtattttaggywgattgkttttaagaaagtatatatgtgaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagyggggttaggttcrcaccaaagggttatcgatcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacacacacacacacacacacacacacacacaacctcacactgtcccatgcaccctacatcatycatcactgggtgtgacacacacatacacacaatcccacactgtcccatgcaccctacatcatccatcaccaggacatgatacatgaacacacacacaacaccacacagtcccatgcaccctacatcatccatcactggggtgtgacacaaacacacacacacacaactccacaccatcccatgcaccctacatcatccatcactggggcatgacacacgaacacacacacaaccccacacagtcccatgcaccctacatctcatcactggggtgtgacacacacacacacacacacacacacaactccacaccatcccatgcaccctacatcatccrtcactgtggcatgacacacacatacacacagaaccccacactgtcccatccaccctacattatccatcactgtggcatgacacacacacacacacacacacacacacacagaaccccacactgtcccatgcaccctacatcatccatcactggggcatgacacacgcatacatacacaactccacacagtcccatgcagcctacatcatccatcactgtggcatgacacatacacacacacacacacacacacacacacacacacacaaccccacaccgtcccatgcaccctacatcatccatcactggggcatgacacacgaacatacacacaaccgcacaccgtcccatgcacgctacatcatccatcactggggcatgacacacgaacacacacataacctcgcagcaaattgtcacagaccaaattgtggtctgaggcaatttgagatttctttacaggaaaggttttaggtagcagtctggctgggatagtgacaaaactgcaaatgcatagcaaatgcactgtttttatgttgatagtaatgttgagtggctttagaggggaactgatgtagcagctaggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgcaacatgaggaagtcggacaagatgagcatcactagaacttagatgcccaaaaacattttttgttgtttttttgagacggagtcttgcactgtcgccccggatagagtgcagtggtgtgatctccgctcactgcaacctccgcctcccgggttcaagcgattctcctgcctcgacctcccaaggagctgggattacaagcacccgccaccacacctgtctaatttttttttaatgtacttttagtagagacagggtttcactatgttggccaggctggtcttgaattcctgacctcatgatccgcccacctcagcctcccaaagtgctgggattacaggcatgagccactgtgcctggccccaaaaacattttaaaaatattcatagatttgatgaaatcccaacagaagagagttcatgagaaataatagttgctatagatccaaggggaacaagtttactgcatatattaagaaatattaaatatatacatacatatgtatattaaacattgaatagtattgtagatgtgtacagaaatgaaaaagcaagaagataaaacaaagatccatagtacaaaatagatggcatagcataacacaatttgttgatgctctgcacctcaaagtataggttagacattatttgtgtgggtcaggaagttctcatgtgactttctgttattcttgggtatgacataccacttcttaaaaagattgttttataataataatgacagccatattaatgtgtttagctttcttccatacacattaaaaatgtatcttaaaataaaaacattggtggcacaaactactcaataaacatttgttgaatgaatgaagaaatgaactctgtccccagccttgctacagtgtccatccagggtagaacttagaagcagggcaatgagaagcaagaaggaagcagagggcttgaaccactcttccagtggaaattggcacaattatacttcaacataatgattgttaactagaattatttttggccatgttggtggtgtatggatactaaaagaaagttttctcttcttgtttcaggccaactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattasgcacagtagacacagacgcacaaaattttyaaagacccacacaygtctgaatttcttttataattattttctttgaagtcaaagaaaatgttttaatatatagtgatatattcatcttygtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggcagcagaggagagggttggatagaaacaagcctttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacctgggaaagccatggagaataggtggagtaaagtttatcagacrtaagaagagaggacagccaggattgtggggagagcatgtgcaaattcaaggaagtaggaattctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaarttagatgacttcyagggtccctcctaactttgatatcttatgattccaaacctttaacatcaaggatcctcagaagatgacattttcctattctgacatcattcacacttttaagtgaaaggtggaaaccactctttttccttcaaacaactacattagacataaactagtcgttgttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccrtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaaaaaaaaaaaccctgccttctctggttggccaacataaccaccgagtcaacacaaagatacaaaggcaggacatgaaatcaaggggtaaattgttagtcaatcagtattattgagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgtagagcttttttttcacccctgtgtcttgtataacagagagtgtaaattggaaggaaatttagccctgcccctaggtgacacagctgtaactaatagctactgaatgtcagtatgctctaggcattgtgttattagtttatttagttcatgtgtcatttgctcatttaatattagtcaaatttagtcctcatgacaactccatcagtcaggtttttctattactcttactttgctgatgagggaaaggctcagagctattaagtaatctgcccagggttctaagctagttgatggtggagccagtttcacactcatgttgattccaaagttggtgttttttagccatgtaaactaccacattctttgctstacatttttatgagacaatttgagaatataaccaaggattgtaaatgctttatagtttctcttcaacaacaacatatctttagatccattgaactttggtgggagggtagtggtggggagtrggcaggaaaggaaagaagtaattgaaggtgaaatacttcgagtgtattttaattctcaactttaccagtgccagagtaagcagacattcctgaaagcttggtcttcctctagtcacgagcctagtgtcagagctgattccttctttctgatgttgcttccctgtccagaggggccggttctgtcctttgtagcacacgaacactgtgcctaaggatggtatggactgccccgagcaggaagtttctaagtactctgaagcttctttgataaatcatctgccakacatattctgaattctttagattttaaacacctctccctcagaagccctcaacagtacaggtatggaacagaatacacagaataaagcaagccttctacattgtccctcttctccccaagcctcctagctgaggcaaaacatatccatgaatgcattatcatataatcagatctactttayaaataatgcatttatatataaataaattgattaattgagcatatattcatggatcaggatggacattaccaggatattagctcatcctactgctctcccagtcagctctctacccctttctgggctatgcctccctagaattatctcttatcagataaccttgactgccactagctgtttcaatatgccactacttccccttcacacccaaccttcaaaatccatttctgcaagacagtcttcctcaataaagcttgccaaaaaaattgcaagatagaaaaaagataaaaaattactggcataaatgatgacactcctctaacccacaacagtggtagagacatcactaattaatacaactttacctgaacacagatgggttttatctccaccaacacagtactctaagcagccactaycattgattgtcgttttgccatctragatgtaaaggatgtagagaagcatcaattatccatgggagatgagaaatagatatatttactgtaatatgaaattaagtttgattgttggaataattctccacatgtcaggaattattagacctcagagcaggctatcgaaaaaagatttattcattgaatcatcatgaataaatcatcttctccctggagatccaaaggaatagacaaattgctaacctatctattcaggaaaccctgaaatgggatagaatacagaacattgtctctttttttcccctagagttctgagatcccaaggaagctrtaattggggaaacatttstatgctccaagaacatagggcaggcaggggttgctactgtaaggtattaagacattggtggggttaaggtcagggagcgaagtgaataggatgtggaccaaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatatgacatatggatattcttttgtaatatacttccaagtgaaccagcatgtggacagggcttaagacagaggaagtaaccaccagaaaacarttcagccatagaacttacccccaactatgacctcattaataaaaacatctcagtgctttgaaagtatcaattctaatactaattctcatcaagtgcatataccctaaaatactttcttgcaggaaagaaaccatggcccttctctattctgtcacctgagtggcactatcttggtgaagaggacatggcagttcagccatagtcagtactctcttcgcctgctgtattcagactcatgaaacatcacctcrtaagattgtttgtcctttaccatgagtacgtcttaaacatctcatttggctcctctgtttctccactgtaggattctggacatagatttgaagcaaatgaaaggtgaaagggtttgggctctaacaytgtgcaagctgagctcagagaagtaacttgcctaaggtcacatagcaagtaggcagcagagccaggattcatatcacacctgtgtgaccccacgccccacatctggtgcctaacctcartgcagtaatacgtgacattgggcttccataataaaacaatgcttggtttgaaaaccacagcccattttgtaccacatagggtttctctgtccacacatctgtcattggctccrtttgtccctctgtgtccacacacaacaataccctccttaggaaatactaaatgcagtatgaaatgggagccacgcaatactccagcaggcccctacaatgcttttcacaagggacaggttggctctctagaagatactgtgcttccctcttgtctggctagctcagtcctatctgagaggggatgagtctgtggtcaaaacgagaattcagcctttcctcacatctgtgaatgtccatgactctgacctttccatatctatgcagcctcctgccaggacatgtcctgcagcaaacaaggagagtgcctcgagaccatcrggaactacacctgctcctgttaccctggattctatgggccagaatgtgaatacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgamtcataaatttcaaaaaagaaaagggaaagggaaaggaagcaaaaccracagaactttcaggctaattttacttgtttgaagtaaaaacttgtgaaagaatgactatttcccaagatgcagccaatacaaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacrtgctcatgaactgcagccaycctctgggaaacttctcttttaactcgcagtgcagcttccactkcactgacgggtaccaagtaaatgggcccagcaagctggaatgcttggcttctggaatctggacaaataagcctccacagtgtttaggtatgtagaccttattcttttcatcctcactgacwtagaattttgggggagaagaggacacaatgagctttctccattaaaaaatgtragaaataatgaccatctaggttagatggaaaactctggttatcactgttaactgtcaaccagagtaacattaatttcaattttcatggtatttttttatgggtagagtgacttagtcagtttaattgttgattcgcaggcaaaaacattacaaagggacccctctttccctttgttaattgtaaagtaaacagagtacaatgatgaggacttaggggttaagaattattaatttgataattttacctaacttctctacatgaaaaacaagggtgtttgatctttccaagcagctattgaaaacaccatttaaccattctagtgcatcaacctgcctgccactttgggaaggtgtgactgctgcagaatttgaaggcttccaaggtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacccagtccttacttagtgcatagatgaaattgaccagcttatggagaagctkgcctgaattgccaaaatttaattctcttcctacctgccattcagctagattgggttcatctgagatgagaaagraaaaaaattcctttctttccccaaacacaaaygcaggcagtttcagaatggcctcattcatmatttccccataagattagaaagggtggcctctacatctataagtggacactagaagacctactgagacaggtttatagaagtatagggaatagaggayattaagaatacagcttggaggaatctttgtttttaacagactcagatcaccctgggaactggtaatccaagtctggacaaacatcattagggtctcttgacctttacatcttgctagctccacctgcatttcagaggtggttccaccattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcrttagcaacctccattctgtccaagaaggaatcatggcatggtagasaggccaagggctctcagtgtcggggtgatctcttctaagttcttgcactagagcaagctcttcaacctccaggaaccatggttttctcatctgtgaaatggagctaagaattgcaaggtgcttgtgaggattaagtacataaaaagtatacaattaaatarcatgtataaagtacctagcatagagcttctgctctactgacatatcygaggtataggaccatgtcctatacttgagagggagttgggagcagcggctaaggtggctaaagagagtggttcaccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccagacctggatgacaagcccaaccctgctactatctagctatgagactttagagaagtcacttaacacttctgaacctcacttttcttgcctaaaacataagagagaagagagaaacactagaggattttggtgtttttgtttgtttgtttgtttgtttgtttgtttgtttgttttgagacagagtctcactctgtcgcccaggctgaagtgcagtggcacgatctcagctcactgcaacctctgcctcccaggttcaaacgattctcctgcctcagcctcccgaatagctaggattacaggcaactttttgtatttttaatagagactagggtttcaccactttggccaggctggtctcaaactcccgamctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgcwcaggaattcactttggctgcactcacttggcaacygaagtctgattaggatgacatcctgtgttctagagacaaagcccggtcaggatcattttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagggagggcttcctaaggaaagggaagtctaagctgagacctgaagggcaggtgagagtgagtcaggccaagaggggcatgggaaggtgttccaggcagtctctcttttggaaaatggaggttttagggttctgaacacactgaaaatgtggacaggaaagatayagcatctaggaattttttctgaggaagaacccggcccttccattacctggctttagaagataccttttccacttagctatttygtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaaggtactgtaacagtggtaatgtttttctgtgtgtctcagctcgttagaggcatcagcatctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatggggcttgggggaataaatcatgcatgaggaatagcatgggatggggaagggtaatggacaaggtgtttagytcagtcctgtcacttcctgtccttaagctagtggtttagactctctgaggctcagtatcttctgtaaaatggggctactattatcagccttacctacctgcctcactagtagttgtgaattaatgtgtgtaaacgcaactttaaaactcttataggatttataggraaaatgatgatgatgacatgttaccttataaatcacatgtctgtggtctgatttgacaaaatgatcctctttcaatatgttaggtttctaatcttttgctcttatactaaggcactcatsgggggcgggtgtggtggttcacaaggattattattttttttacgaggagtacctcacactaaagtcatgttccagaagtgtaatattgacattttgtgttttcatttacggagacctctgagcaatctatgtgactccyctgggttcctaagtataccttgattttaaaatgaggcagtggtttgaaagcaggtcttgaagagatatttgtgcacccatgttcatagcactattaatcacaacagttaaaatgtggaagcaacccaaacacccatcaatggatgaaaggataagtaaaaagtattccacatacttacagtggaatattattcaaccttaaagaggaagtaaattctgacctctgctacaaacatgaatgaaccttgaagacattatgctaagtgaaataagccactatgaraggacaaatactgtatgattccactcatatgaggaacttagagtagtcaaagtcatagagacagaaagtagaacggaggttgccaagggctcggcggaagagggaaatagggagttatggtttaatggatacggagtttcagtttgagatgatgaaaagagttttggagatgaataatggtgatggtggyacaataatatgaatgtgcttaataccactgaactgtacacttgataytggtgacatggtaaatggtaaattaaatttcatgctacgtatatctcactataataaaaaattgaacagcaaaaaaaaaaaaaaagaaaaaacaagaaggcaatagaatagatggctatacaccatgatgctgacacytagtctgagttatggaatgtattgtwtatgttatctgggagaaaaagacacaatgagctctttgacacacttaaaacggatcataagggattattcaagccattgttgtctccaggaaggtaaatgtctaatcaagaaaagatagttggatattctcttaagtatccagagatgtggtctcactaacccccttcataggccttctgaatgtttcccactcctgaactcagtgtctgcatgtgacgcaaagccttaatgatattattactatctattactaccactgctactaatatagcagctaatgttcattgagcactttctatgatctcagtctaactctrtgaggtagttacaattattactaccattttaaagatgagaagagacaacacatggaatatgtgtgctctcttcgtatatggttatttattttacatctttgagatcatggtgtatattataatttttactctgattttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaamtagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcaggaatccctgttcttgacactagaaagagttaatggtcaaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaargctggattttagaggtgacaactatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctcctgccacaaaccaggtaaactcttctcacctggccaaacatggcatctggaaagaagaccaggtgggaaaaaaattgcttcagagtggttgtcccaaggctggtctggcacttctaggaaccacagggtataatggtaaaatgggaggggcagaatttacaagtacccagttgcaaacactccaagatctgtataaaattggagaaatagacttagaataaggtgaagagtgatagaaaaaagagaaaaactaatmtgtatactggaggttacgggattctcagaagaaagaaatgtgtggattcagtataaacattctatctgcattgtacttgatatacatacattttttgagacggagtctcactctgtcgcccaggctggagtgtaatggcacaatctcggcccactgcaacctccgcctcccgggttcaagcaattctcctgtctcagcttcccgagtagctgggactacaggtgcccaccactgcacccagctaatttttgtatttttggtagagatgaggtttcaccatcttagctaggctggtctcaaactcctgacctcaggtgatctgcctgactcggcctcccacagtgctrgtattacaggtgtgagccactgctcccggccttgtacttgatatttaacaagccagtgtgctctgtcagtattgcaacatcttktatgaacttgaacgggttctagtcatccatgtttgtgaattgaaggatagaygtatattttttatattccccaagctttttccccctcaatgtatccaattccttagttaacttttatagacaatgctgctttttaaaygcaagattttcatttataaaaathtgcagaaatataataaagaaatgaagaaatatcctcttaaatactcctatcctaaaatagacactgttaggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaaggaaaccactcactattcaggtcacacaaaagcataatcacatacacacacacacacmccccmcmcacacaccccattgttaagctaggtcaacagtaaatgaatgaatgaatgaatgaatgaatgaatgaacaaatggacaagcaaacagcagaattgaatgtccttcatcgccaggcaccagagaggatggcaagcccctggacttagggttgggtgcaccttcagagctgggtctggagagaacagggcggggctgtgaccttgccccttaagtgctcatcctggctacgttgaagtctggacatatcacaaagtccacacaactttggggaagttgtgggaagaactgggaatccctgaggacagtgatcacagtgattgaaactcttacaggcaagcctgggtggtgcagggcacagattacagttcattgctccatactgtcctgcctctgggtgtttcacagcaaggaggttgccactcaccacggcttcctgtgaccttccagttcccttctgctttyagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcagaaggcaaagccacagaagagctggaaatgggttctgtggtaccaacatcctcacccacaccctttcccccataagtccttgcagtttataggcttcttgagttgtgtcctctccagccccacatacacacttactacagaaatacttttcaactagaagaaaagaaccagatctttggacaagttgatcagattgaaaggaatgtagctagagaggggaaggaatgaagggaagagaaaggcgtagaaagtgttcttgaaacctcatgctgtttaagtcagtggctgaaaaatgaccctaggagcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaacatttttgcaatctactcatcygacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccatggtggaagtcagtgtggcaattcctcagggatctggaactagaaatgccatttgacctagccatcccatgactgggtatatacccaaaggattataaatcatgttgctaccaagacacatgcacaggtatgtttattgcggcactattcaaaatagcaaagacttggaaccaacccaaatgtccaacaatgatggactggattaagaaaatgtggcacatatgcaaggattttcctttttcccatttcgaagataaagcaactgaggctcagaaaggttattgtctagtgatagattgctagcaagtaacagagccaaaatttgggcgcmgattccaccacttggttgggaaagggggaagaaagtattttcctccatttctgtgtttccaatcatttgtcattgttttctggtaaggtcattggggtgtttctgaagaaggtatcaagggagaaaccagttccacccctgtctagaagcaacaaaaatgagttgcaccactatcctcccaaacagagcaccagcttcctttaaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacasasacacasasmgagagagagagggagaaagagagagagagttacagagttcaggttgctgaattataaaatgatctcttcttttctcctctgccatgcccatgatagccattccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcctttcttatggctttaaagatgacatcagagaatggagaatcatcagggatttatataaaagtgttyttgagctgaagcaaacaacactctccacaacaatggtaatctagataaaaaagttctccctctctttaaataatattttaatagctttagttaaatattccacagtttcaagaacatcctggccaacatggtgaaaccccgtttctactaaaaatacaaaaaatagctgggcatggtggtgcatgcctgtagtcccagctactcgggaggctgaggcaggagaatcgcttgaacccaggaggtggaggttgcagtgagctgagattgtgccattgcactccagcctggtgacagagtgagactctgtctcaaaaaaaaattgcacagtttcaggaagtgctttcatgtcattatagcattcctgtttaccacaattctaaaataataaggaaaggcagtatcatctcattttatagataaggaagagacacaagcttaaagaggttaaatwactcgtccagggtcacactgttagtaagtgaaaaggctcagctctatgtcactgaaagttttacttccttacagagtcttcttcagctacattcttcatttcttcattcctacattcaccttcaactgagcattactaaatcccagccacagaccttatttagggatgggtgagatttaaccctagcataactatgtgtgcacttccctcctctctccacttctwtattgaatataagcttcttgaaggcaggagctgtgccttcttcatctttataccccctgcagcagctagacagaataaaaatgggtgtgtgtgacaaatatctgttgaattgaaggtgatcatttaccagtaaaatttactcaaacacaagctttggtaatttagtggaattctcaaaggcaggggccagatcttatctgtctttaattcccctgagacatctggctggcaaagtatctagtatattttatgttctaaaatagaagtgcactgaattaattaattcatagctcctgtttagttgcaaaaggtgctattgttctaatgtattgttcagtgtagagttagtaataatgagaccagtgataatggtaataattattgcttaatgtaggactacctatttcataakcatcatcacattcartccacacaaatgayccttaagttggttattactatgcccattttaaaggtgaagaarctgaggctttgagaggttaagtagctagcaaagttcatatagcttgaagtatggagacaggatgcaaacccaggcctagtctgattatagggctagtgttttgaccactgaactacaytatcacccagtggcagagcttctgaatctcaggtaagtcacttgtgaatttaytcttttccactccacagattgcagctataactgctaaatgaactttagaaatggcagtgcctggtgatcagatgagagaatatgttggtagaaatctattcgtgttacacaaaaacagctaaaatattatttattccttcctgtggaatgagcactagattaatatccaaagacttgtattgctctctctccaagtcatgtgccattaggaaagtcttgtcacacccttaggctcccgttttctcaattccaaaaggagaagagtggaccagaccatctttgaggtcgcttccctggtcaagaattctgtagggtgaaagacataaaatgctaccatctgctgtcaaaaagatatactacaagttccctgagaattctagaacatgtatggaggaaagcatttgggcttgtggtttttcactcattcatttattcctcactctcttattcatttattccattgacatttctcataagttctattttcccacattttaaggctaaagaatatttaaaaaaacctttaaaaatctcattcacattttaaatcatgtaggcaaccaacatggctgctaaatctgtaatctctaaagcccttgcttcccttcacyactttccagcccccctttctctgcaggaggaggcatttgcctcccactttgcaggccccatccccactcactgtcaagacccaaccctgaccatgaacagcagctttaacccactatggcccttggaattatcaaccttgactgatcctgatcttgagccctggtttttgcatttgtgtttcttcttcgttctccaaatttatgctctaaatttaggcaaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttcattttgggggatggctctaccgatagttccactttagttagaatgccggttccctgggccctctgggatgtggcctctgcctagytgttcctcagtatctgcagggggaattggttccaggactccctgcagataccagaatccccagatgcccaagtcacttatataaaatggcataatatttgcatataacctacatacattctcctttagacttttaaaccrtctttagattacgtataatacctaatgcaaagcctacacatcacttcatctgcatggattcaacatactcagcacatggcaaattcaagttttgctttttggaactttatakaatttattttttttctgaatgtttttgatccacaaygagttgaatccgtagatgcagaacccttggatacagagagtcggttatttttcagccttgtctctgcctttgcccttcaggacctgaagtccttttcatgagcctaagcagtgcttgaggttcttgtgccaactttgatgatgccacctgcatgatggaktgcttgtacacagtttccgtatccctcctgtccctgcctgttggaccactttcatgatacagactgctgaattcctaatcccttaacactgtctgtcattgatcctctggtgaccatgtttggctgctgaacccaactcctaatgtctattttcactgcgtggggaggggtcctggttccaagtcccaacctcaactctgctcttctgccatgtgcctgcttactcacgtcctaaaatatggtgaactggtgccccctaaaactctggcccagctgacatctccatttttttcttcattcccccaacatttctctgaatctgtgggrcttcctagttttattcctaaagtttgagtttacaatattcaactcagatacatttattattcatactatatcttctttccagaaaattattgagaaaactctatcaaactcaagtaaaatgatataatgaaaggaaacagataatttactaaatctatttgaaataatataaatcaatatgtttaagaattcagatgcaatcatgtatactttcttgatggactatagaagaacaccartgaatacccatatgtgatagmactgccttggtagtcagtgaaaatagaacactaagcgtgcaataaatgcaamccttatctgttttctatttttgtaattattcaggagtttttttttttttgccaaagttttagagtaggctcaagaatatgaccacttctcaaagttatgcacaaaagtcattcctgggtataactcttttcctgcatctgcactaatctccattccagcagcatccttgataactscacaaatgtcattcatcccatgtttgctgagtgcccaccatatgccrgatctgggttaggcttccatgtaactcatctaggctgcccctcaaacaggtaaacccacttctttacatgatccagagccaaattcttagtatgtaagggtcaaggttaatttttacctgagagagttcagagacttttataaatatgaaagtctggatatgtaaccttggctgagcatgactgataagactgaaaccaaagcactatcccccaaatgaatttaatgctgtagtagttctcattttatactagggcccccttcggttaatttttaaaaacagtaattcctcttgtttcttttcaaaccaggtaggcataccttttagaatgcatttaaattaaattgtattcattactgtattcattcaattcataagtatttgtagaacccctcctatgtgtcaggccctgttctctgggatacagtgttcaaagaactgacaaggtccctgctttcctgcagctgacattatacatattcttcagtttaaagttgtaattctgggagattatgaaamagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttgaatggattcatgcaataagaatccataatccttcaatgaatagcttgttactgaaaaatacatgggccagtatgtaaaagccaaatactgtacattggttttccatgagggagcatataggtcttgaagaggtttgtaaaaatcaaactatctaagtaaatgagacttatctgaccaaggtattgttktcagaatagccttagatttaaagaaagawtartcacttcatttgtctataacccaacatttattgataaataatagtcttatattagagaatyaatggggagaaargaataatgctaagaaaatatgtaactgcaataatttgtaaaaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttaygarttaaatcctggaggattagtgggattttaygycatraaagtggaaaaattctcaggggaatgtgagccaagaaccagaagcaataacacacaaagtcacttcagggaattccaagaaactaatctatcttgaccaggaggttttgagttttcctgtgttatctggatgggtggtattaaaatacaacagcaaaataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctacgaggtctctgaagcagagggtgtagagaaaatagggtgacwttgtaagttcttgagtatggctgyctaaatctttgacttctttgtcttcgtgacttgtacctatactcttctctgtaagcttaccatcctcccactgccctttgcagcaaatgacctacatgatatgttgtggaatgctgctgcctagcaaaatacctggaatataggtgcttaataaatattttttgaatatataagtgaatgaactttgtgtaacacagaacttctgaataaacttggagattgtgacactcttaatttgatactctagccatcaagtgcccagaactctttgccccagagcagggcagcctggattgttctgacacycgtggagaattcaatgttggctccacytgycatttctcttgtracaayggctttaagctggaggggcccaataatgtggaatgcacaactkctggaagatggtcagctactccrccaacctgcaaaggtaataatatgtacttgctaagacagttctacttttggaaatttattctacaacaacaaacaattatctagttcttatatgtgaactagataattgtatatattaccattatttgggtttagcaaacagctgaaggattttaaaatgtctaaggagtgacaggatatttttatgtttgtgaataaaagrtatattgattcttaagcaggaattttgtttcatggcttctttttttgaaagagctttgttgagtgaacggaatggtctccattaatttattgctgagagaaacagacaatactggggtagagtcactggtccrgtttttcaaatctaggaattgaggtgcagagaggtcaatcatcatcttcctgccacatggcaagttaatgacaaagctggtgggatcattcaaatggaagaaatagtttgagacagaaagcaatcattgcagwaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagcaacaacaatgactcctctgatttcttctctkggccaggagaatcatctcctcaaggatgmtttttaataattttcctcatctggttttctatctctgacactgayagtttttcttaacttccttaaatagctcttgcaggagcctcccttgttatgaagggagtgaaaagcagttattccagattagccttaactctgttaacgcttcttttaattgggaggtctctgaatkgaaacattttctcacaacagkcatagcatcacttcctactccagggktgcaatgtccagccctcaccactcctgggcagggaaccatgtactgtaggcatcatccgggramctttggttttaataccacttgttactttggctgcarcgctggattcacactcataggagacagcactctcagctgcagaccttcaggacaatggacagcagtaactccagcatgcagaggtaaggtgaaaaggagcaggcagttctgaacctgccttcctgcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcaygtcacaagctaaagctaatacacaagtactcagagacttaaaggaagaaacatttgyagatgtccaagatgtgttagaaaaatagrcatattaaatgtaaaacctgctatagaaattggtaaactagaagttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatttatttgaattaaatytaatttcttgacctttamtttcytatccataaattagaaagaataacsctgaagttccctgaaaatgtagtytaaggaggatgacagtctacttctttcaaacttccagtgtccagatatgctgaacacttattaagtatttyaataaacacatactgacatgccagttgatcacaaatgtagtaataayatttagactaayagtattttaagaaccaaaattttgtaaatagtatatktggaggcaagatttatcawtgcattagcaggtatttgtcggatgctactatgtgtccatctttgcatcttggttctttggatatcacccttcgagagaatattttcatatatgtgctgttagaagagctactgtgaatattggaagtggctcatatcctttctgaccttttacattctgcctcatttattggcaatgttaggttacaaaagaaactataatctstttcacctccaatccacatgttgtttctcttgcattmtttcttttctgcagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctcayagtggtcttgctttccatccccgggtttccccctgcttaataagtgtttcacaatgaatcaggcagaatctccttgccttataaagtagtggaaattaaacccagtgactgtgtaggtaatcacccctcctcttcagtrttcagtttgtgaaatgaaaccttttgcttcrttataatctctgtttaacagaccttgaagtttcaaaatgttttaaactgggagttatttcatgcagatttctaatttattatctcagaagacctttgcttaccacctaactctaaaaacctcctagcagatcttccttaattaaattccatctgtttgcaaggtatatttcagccccctattttttcccctcatagcttgtcctgactgccttttgttacataactgaatctttgccaaaaaattatgcacagtttattttatttgcctaaacttacatgtataggcttcttatgtctacaatttaatttcttttattgggaccttaccctaattcttttggaaattacagtttatatttaagtcttaggaataaattaaggccccacttttattttatttgcccatacttacatgtataggcttcttgtgtctacaatttaatttcttttattgggtcctcaccctgattcctttggaaattacagtctatatttaagccttaggaataaaataaggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagcaggaccattgacyatccaggaagccctgacttactttggtggagcggtggcttctacrataggtctgataatgggtgggacgctcctggctttgctaagaaagcgtttcagacaaaaaggtaaataggaaagagtcttctctttgcatcttggttacataaatcaaaagaaattgatttatgtaatttagggtggggaggcaaaaaccacaacttcagtagttcatgttggaaaacatttgcattaaaagaaaataaagccaagataagtgatcttgagaactgattgtccattagaatcacctagggaacttcctaaaaatatagatccttctatggggagacttggtagtgggtgtggaaatctgaatttttcaaaagctctctcccaaaattcaaatgaggctactttgcagttttgcatttggggcctctggtctaagtaccctaggctatcactaaagctaattagaaaggtgttatgcttcctgacttcactcatttcttcatgtagcagtcatttattcatcaactctgttagagtgtgagactcataatgatggtttctgatattaaggaaggaaaaatccagtaggggagacaggtgaaatcagtgcyggtagtgaagtgtagtaagtgtgttaggacacaaatacaacctaggtattattagaacwtagactagggatgcctaaaccagacyggcaggtcagaaagcctttttcaagcttagctttgaagaatgagaggcatttagccaaggggaaaatggaaatagagttccatcrgagaaaatggcatgtagaaagacatgaaagtgtaaaatcaatgagaagatggtatgtttcgcagttcagtgcatctgaatcaaaaggggattatggaggaggcaggagatgaagttaggggcagaagaagctgcccctgtattggtgacctggtgtgataagctaagagatttgctttttctcctgaaaatttgtaaagttgatgcaggatttaaacagagaagaccaaatagatgaaaactctctgtaagggaaactgtgttcatcagactgttcatcagaaaaagaactttagtctaggaattaaagatgggaacatcccatctcttaaggtttaaaacatcctttctcaatcttctccagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagrggaccctctaacagtggagaaggacaaatggccactcatgccccaatatttttaataataaatacattcatttgttggggatgggagcttttttcctcagcttctcccaatttgatttyaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcaktctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaycttaactttawaattcactgtaatatgtcagaatgattacatgcaatgcctgcctcctttttacaatgtcttttgcaatgtcttcttttctactctgaagtaaaatacacagataacaaatattctaattaaaatatamagtaggaataaaaygaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatrgtgaacaactccrgtaaagagtctgaaaacctgtgataattgtcctttgattcatatrgcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctrtttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggkcatattgcacyctttgaaaactatcgttagattatcaagtgttaatgccaagaattttgtaactacctcttgtcacctagaagaggttgcagcaacttagagggtataacaggtattyagtacataaagcatgaacaataacttagtgtgggtgcraaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagaytataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccwggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgyaattmaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggakacaatagatacctgcatggaataacaaaaggtaattaacatgattatataatttgaatagtgttgtaatagttcataaaatggaaaagccaatttgagcccagaatctgggagayagrcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttyttttttttttttgatggagttttgctctcgttgcccaggctggagtaaaatggcaygatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcaccygycttggcctcccaaagtactgggattacaggcgtgagccactgcgcytagcckctgtgtgttaagtgctggaactatagtttacagtagcattttatcctcccaacataccctatcasgaaaaaytattattgtcatccttatttcacagatgtcaaaactgaacagagaggtacagtaacttgcccaagacaacacagctagtaagtgaaactgaaatctggacaactgatttttttcagccaagctcttcaagcccgctgcyatgctgcagcttagctggcgacaggcccttatcaaggcagaactgtgccttgatagmggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccargcagscctcaggtcagtggtaacggacgactgcttccgtggtgtyggcaggtggaaatggagggatacagctttgtscggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaarccccagaaaaagcggagggagtgagagycagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctrccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggargtttaattcagataaaatactatccttgagttgcmaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaaytccatcttttggcaaagtgtattttagcacaaagcagacatctatctacttatytcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcrtcrtacacattgtttgaattcatatsatctgtaactttttaatcagatagattattttccaatagaaattgttcagatcaaaatagacatacctcagtatgaatacacagcatacatagtaaaaacatgttaggaaacatctctctgttgaaattactccacgtaagagactgataytttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatatkcaacttccacgctttaaccttctacttttcccctttccctcagcaccaatgaccttaccaagtagttgtctaatttctacttgaatgctkccagtgatggagaatccactaccttctctatctagctattctaaaagtacttacgtgcctcctttaattctgcccccacatattaacacagtytctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttyatagttgtagaaactgaggcacaaatggatgaagtaaacttttcaaagtaaaacaataagaggtagatataggcttcaagtccagagatactgaattcacagcctgcaccctagccaccgygctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaraacagttttttcatttgtttgtttccaatatgaatccmagggcttttaccccattagccatctctcacctctcaactagaaataaattccaccaaatcaatactttttcacaatgttccccagtagattaaaactatatttgattgatcagttgaaaaacagctcatatatttattcataaaggatttggtc

SEQ ID NO: 13346 - DNA, 43103 bp, Homo sapiens
agcacagccttcctggggttccttttggaaatgctgacttattaaataaatatgagggaggagtaccctctgcaaggagagaaggtggggaggggcacaggaagactaagcactgtcttcatcattttgccatgtcccgmtagtggccatgagcagccctgtccctgggtctatctcttcaggcttatgatcctatttaatcctcatgacaaccgctaaaggtagmcaaggttgcccttgtttttcagatgaggmgtctctagaaaagtcgtgtggcctgctaagctaactgttcagagcctgggctctggagtcacctggcggtggtttcaaacataaatccggccccctcaagagctgtgtgactttgcaaatgttccttaacctctctggcccyctatttcctcctttgaaaaggagagttaaaatcttgccctctcggcatgagkttattgggaagaatcagaggtatgattgatagggtcatggcacagtggttaagagtatgaaccatgatcccagatatcttgggtttaaatcccacgtctgctatttaccagctgtgtgactttgggcagtatacttaattctcaggttttctatttctcatctataaagggaacatcattatagtacctacctcataaagttgttatgagaatcaaatacatgtcaaatccgtggtacaggggttgacaacagtaatccaagtttgctctaatttgaataaacgcagttcttcttactatactgtaaagactatatctgaccaggtgcagtggctcacgacctgtaatcccagcactttggaagtctgaggcaggtggatcacttgarcccaggagttcgagaccagcctgggcaacatggcgaaacccagtctccactaaaaacacaaaaattagccgggcgtggtggcacacacctgtagtcccagctactcaggaggctgacgcacgagtatcatttgaacccagaaggcggaggttgcagtgtgctgagatcacaccactgcactccatccagcctgggtgatggagtgagactctgtctcaaaaaaaaaaaaacaaaaaaaatactrtatctggctacagtagtattcccaatgcctgccacatagttggtgatcagtaagtatttattttaaaaatgatctgggatttcaacccacatctgcataactcaaaacatttatgccagtgattctcaatgtatgatccagggctgtctgcctgaatgggcctgaccccaagaatcagagcccctggctggccasaactctggatttatcctctccagttcagcaataggctcacagtgtaacctgggccagttctccctctctaggtctcagtttccccatctgtaaaagtaagggctctctggggtgaggagctgtttatccacatgaccagccctgctccatgggggctcctggtatctcaagacacgcaaccttcaagccacaaaggatcgtcactgacgttactacttttattttgtaagcccgcatgtctcagggctcatgtgtgtgtgtctgtgcgtgtgcgtacacaggcacacrttcagatctgcaggtgatgtggcttggggagaggctgccataaatattaaactcccaactccaaagtaccctgcagagattcagaactgmaggaattcataacatcattctctttcaagagtcagtgttctcaggagtgtgggcaccgtcatagaaaactatcgaaaaggagagtgaagcrttagagaactgctgagcttggagggaactcggagctcatttagtcccttgttcccgaagctccaagcacaatccgtggtcagcagcatcaccctcaccagggagcttgttaaaatgcagaggctcagccccaagaggaacatgatggatcaagatttgcmtctaaacaagatccctgggggacttgmctgcacgtctttgtttctgaaaagctgtcctagtccccagccctcatctgcatttgggggaaacatgaggaacagagaggggtggagtttgttccaggtcccccagcccattaggagcagggccttgacaaaaaacctgtaagactttggaaaaggattcaaagctctctgcgagaggcaggcgtttgcacaaaagatgaataagtgcagaagaaatgctcagtgttgctaattgtgtccaacagggttcaggcaagaaaagagaatccaactgcattggttcttgggatttgawtaaagtggctatttctagagttgggggacaagcttgaggaaaccaaccagggactgtttttcctaaggctcaagcagcaaagaaaagcatctgggtatcccagcccaaggagataataggagccaaggacaaggccttatcaggagggacacagccaactgccacacttgtgatctagagaagacagcagggaaaagtgccctgacatctgacctcctgccatgccaccctctggctgaacccaagtagagatgaggaaactgagtcacaaagtgcccaaagtcaccccgtgggggagtcaggattcaaatccaggccatctggccccagagtccataaagataaacataaggtttgtttattcctttggcaattatctactatttgctgctcagtattctagacactatggattccaaattctgggtttttcaaaatcttttcagtaacacttttgtagtsagaatattatcggtggcgagtccgcaacactcccagcccttgtcttctcagaggaaagaattcaattgagagacgcaggcaagttttaaagcagaggcaaaggtttattgaaagaagcaaagtacaaytgagagatcaagtgccccgctcaacctttggctcggggcttttatacactggcttggttctggggtttcttctcctccttgattcctcccttcggtgggctgctgcgccctccctgcatgcgcaatggcctgccagcacttgggaggggccgcatgcgcagtgtgtttactaaggttgtgcgcatgctcacttggggtgattttcccttactggtccgtcgccgcaagaaaaaggtcatatacaagtcagactccaacatttgcccttctgctcgaccttaccagggaattgtggtttgctggctccagatgatgtcaactatctgttagggaactcctctccctcttggcgccattcgtggccacttatcatgtcagagggacagttttatgatcgcctgtccatcatttgatgcactgccatttctgggggccctctcctgcacaagaacacaataaacagccttgttaaaagagtccctatttcactgcaataagactgagtggtggccagagtggtagcagctgttgcttttgtggaattggatggacagcctggtaggagaaaggcccaggggttctgaccagcagtggggtcgtgctgctccctgaggcctctgctgggtcctgggccatcagcagggaccttagccagcagtgggcacctgcaggggtggaggccaggcctgggccatgtggcagctctaaggtccaaagattgctgctgtgggaaattcccacccctgcaaatgactcccagccagggacatccttaaactgctgccagaggaagagtgacatctatgtccccataagatccttatgctccagaatgtcctcccccactctcctcccctcytgggcaggctgaggtccaggaagcaaaggcccctaggcacactggggatgcacctgtgagccctttcctgctccaaagcctcccaaaggctggctccttaccctgaggcctctgctcagcttgttgcctcccaagagaaccctgccctgaccagagttttggaatggcatcckgcagacctggacttaaattcctgctgggtgactgcagcctacatcacttcaccctgccaaacctcagtttcttcatctcaagacaagactaaaatatccacctkgggttgctgatgcaaggatgagaggagacgtgcagcttaaccagcacagcgcctgcacatagtaggtgctcaataaatatcagtttctttccaattyctgctgggtgctgcaaggatctcaggaaatggaagactcagccgtgcctgcaaggagccatcagactggtggtgtggggactgaggggagggacggatgaggatcccaacaaacctcagccccagtgacaggagcaacacggtacagaggagcagagaggcctggactgtggggttccctgtgcttaacgtgggacattctgatcttaacctcagtgcctgccagtgctgtttgtgacctattgggagtcaccctgttaatcccaccacattcagttggttgaggccatcatgaaaacctgcccaatttcaagggaagggggcagaaacattaccttttgatggaaggaatatcaaagaattcgtggrcatatttttaaaggaccacaattatcaaaaagcagagtggttaatgctgtggtggggaaagcgcaaagggttctgggacctcagaggggaccctttctagaatccagagaagcatgggagtggtcagggaaggcttcctgggggtgagggcaaagcagaaytcacaaatgtaagcagggctggggcaaaactctaaaaattaaacacagtctgtactataaattttgttttccagaatgaaattttactatctttacttactgcgaatatatgcccgggaccatacccccaagaaaataaaaattttagaggctgggcatggtggcccaagtctataatcccagtattttggaaggccaagmgggaggcttacwtgagctcaggagttcgacaccagcctgggcaacatagcaagacctcgtccctactaaaatacaaaaaattagctggacatggtggctcacacctgtagtcccagctacttakggggctgtggtgggaggatcacttgagcccaggaagttgaggttgcagcgagcgatgttcatgccactggactcctgcttgagcaacagagtagactttgtctcaaaaaatgaaaaaagaaaaaaaaattgtacktatcaacaagcaaaaacttttttaacacttataattctacccccacaaccagagacaatgcctcatgwcyccttgctaaatattttccagattgttgaacatagaagcctattttgaaccccccaaaatagaaccttactctatggtgccatyggaaacggatgcctcatgacatccctttccttgccaagaaatacctttawttctgcagcctcactttaagggrcatgtcataattcatttaaccaatgcccttctggtggatacatgaggttgggtctcacttctcctgtcctgtttcccacagcatagcagtggtatcttggagcagtgatttactggcacactgactcaattatgtayttaagggcaagtccctgaaattgaattcctgggtcacagggcatgcaactgtttaaacatttgccaattgccttccagaaaatttcaccaccagcaaggtttgagaaacactgttttcccattgggggaaacatttattttttaaataaacgagccaatatattttwaaaaagagagtttggttggtgccagatgtagcttcactctcaaccctgccstctgctggggrtgagatctcaagggagctatgtggcttttttgaamctcagtttcctcatctgctaaaccaggccttcctagcckagctcttaagagactggctgagatgaggcaagatgaacagtgatgaatatggggtctttctgkggggagggtggacagggatgatcataggagtcaggcttcctcatccactgatctrggcagtgaaaactggcttctaagtatgaccttatgacttcagtgatgtcgcaagcaggttccagtccytgtgcctccccttcccgctcccaggaacccatccagcctcaggaactgcccccagccatcgagccttggctacttaagggacctgggcccaatccacagytgggacagtcctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatggtaagaagccacatctgctggctggacttggcaaacccacgctccaggctgctctgggtacagtggggacagggagtggggacacagaccggaccctctccctggggcagtgccaccttctgggtcaggtggctctggctcctattctggccttactgcccaccagctgagtgccctgggcatgttatttgtggtagtgaggtcctccaccagccaacagaacacagctttgcgtgcaagtagttgatttgggaaatgattccaggaaacactgtagggaatcggtactgagatgaggaagggagggcagccaggagagagtgtgcaattaaaccagccaccacctctgatgatgggaaccactcagctgggaaaattctgcgtaaagtttggaaacacatgcctctgaactggaagtcagaattgtggtcacytctrgaggcaggcagagaccctgaagggcatgagggaggtctgccggggtgctggaagttgccatatcttgatccaggtggtgatcacattcctgtataaacattaaaaattatttagcaatacctttaaaatttgtgcccgttaggtactttatgtatattattcctcaattttaaagaatgggcaggccaggcacagtggctcacgcytgtaatcccagcactttgggaggccgaggtgggtggatagcttcaggccaggagttcgaggcaagcctggccaacatggtgaagcctcgcctctcctaaaaatacaaaaattagccagtcttggtggcagccaactgtaatcccagctacttgggaggctgaggcaggagaatcgcttgaacccgggaggcagaggttgcagtgagccgagatcatgctgctgcattgcagcctgggcaacagagggagactgtctcaaaaaaataaataaaaataaaacaaagaatgagcaaaagtaggagtatttttttttaaatactgaaacaaagcctcccgactmtccaggtggcatgggaactgggatatttatacaccacagtgattgattgagggcttctgggccgggggtttgtcarctccccagcacttctgtcctgttgcatgtacctgctttctgcagttccaggacaaaaagcctcgggacatacaggctcagggaggcagacattggcagctgggagtcaactgtcactcactggaaagactcaaggatatggacaggcactgaccacatgtcttctcacatccctagagcctcaattgccttacctattaaatgagataacaacattcccttagrtagggttgttgggagcccagactggctcgagacaggcagagggaaatcagggaaggattccaggatatagtaaaatggaaaagacagtgggaattacccagggacaaggggtagcgttccaggcggaaggaccccaacatgtgcgtttgctagagggagaagagcaaattggaaagaggtgaaaggggaggctgctggtcatctgtgtacccatgtctgccttggggacagaaacctgggcccctcagatctcggaacagtgggacctggtaactgctacttgcattgaaactgtaaatcagggaagtttctcttttgttcctttgcactgtgcacacacaccatgtttatgtaaccagtcctctgaggttggacrttttggtcctttccatattttttttttttttgaaacggagtctcactctgttgccaggctggagtgcaatggcacaatctcagctcactgcaacctccgactccctggttcaagtgattctcctgcctcagcctcccgagtagctgggattacaggcacatgctaccacgcccagctaatttttgtatttttagtagagacaggrtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagttdwgtttwgttttgttttgttttgttttgtttgagacagagtctgactctgtcgcccaggctagagtgcggtagtgcgatctcggctcactgcaatctctgcctcccgggttcaagtgattctcctgcctcagcctcctgagtagctgagactacaggtgcctgccaccatgcccggctaatttttgtattttttagcagagatgaagtttcaccatattggccaggctggtctcgaactcctgacctcaggtgatctgccctcctcggcctcccaaagtgctgggattacaggcgtgagccaccacgcccagcaaatgtattgttgtcattgctatttgayagatgaacaaagtgaaggttgtttggggactttgtcaaagtcacccagctagaaagatgccctctttctctagcccccagatccttccagtttcttctacacaggccagatrtcatggagaacaagaaggaggactatccgtccaagcgcacagcacttttgcccttggggatttgttggcaaaggcattccatttcctcatcagtaaaatgggcatgaacctaacaatgccacagaaatgcagggacacctctgaatgtccctcatgctacctggcacacagaggggctcatatcctgtcattgtacttaatgctaataaggatgttggcccctctcttgaggacaggtgggagccaccgtagggtttagagcaggggaggaggcaggcagatcaagctgactcccagctatttcctttccacagcggcccaggaggggctattrgctctgcagagtgagctgctcaggatcacgctgcctgacttcaccggggacttraggatcccccacgtcggccgtgggcgctatgagttccacaggtggggctctcccttctgctgcggctctgaagtggctggagctggctgtcagggggaattggagagtgaggaagagagagcctcaggattgggctgtggggggacctctccggggcrgacagtgggatagttccctgaagagctcagaaggaaattctrggaaggaattgagctcctccactcagtcacgcagcaaatattaaggaagacctactggctgtgtgatctgagccttgatttccttatctgtaaaatggagttgatctacttcctccttcagagtgctcatccaagatccaatctggccactagatatagtttggaagagaagatagaccttacactttaaatgtagtagcccaacggttagagctgaagtttgtacttgggggagtcagggaaggcttccaggagaaggtggcatttgagccaagtcttcaaaagwttactagacttgagcagctgatgctttaaaagagcgtgaactgctttttgagggatgggcagtgaagaaacgacaatcagactcgtagcacattgtacccctccctgctcactgctgttgggcgtttccttcattcctgccttcttttattcagtccatcagcaaaaatctaytgggcacctactatgtgcccggcaaataaaatagaacttgaccgttcttttcccactgtgacaaccttgctgacttttttggggtcttatcttaaggctgccaccatcttccctgaatctgtttcccccctacctggatgtattgagagagaggagggttagcaggaactgcaaacccaaagggatatgtctacggaccttctcaggatgccaccgggggtcattagattcatgggttctgatgcagactgcaaaaccgtragcaattgcatcccttcctcaaggttctatttccccctttgtggaaagggagcaagaacactgctgrccccttcagtgtggcccatatggcatgaagaaagtaaygtgcttagcatggtcataagatcgatgcctggggcacagcaggtgcttacctggagcagatcctgctggtctagtccccactgkggagaggggaggcgcaaggtccctggtgaggctgggtccaggcccagggctgacacctccttccatgtctctcccttcagcctgaacatccacagctgtgagctgcttcactctgcrctgaggcctgtcccyggccagggcctgagtctcagcatctccgactcctccatcyrggtccagggcaggtggaaggtgcgcaagtcattcttgtaagttggctctgctcccaggccctgragctcttggccttggccttcgccccatccttcttaggtccaaggtgttcctagcttatcagaaaggccacgtgatggacagatggagtccaagcccggaggtggcctggggattgagtcctggctcttggatgagtgtctttcygtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactytatcttggaagcgatctgaggaaacccacaggggagtggggaagtgaggaagggaagggaarggaaggaagtcagcctggtgggcaagtgaagctctgtctagctggggaactcagggacagyggagaacacgcctctgagttactccagccccacgctgtcaccccrtcctcctgcttgccattggccaagggctgcttccaggggctctggctctcaggcactttgaacagttctctgacctcagaggcacttggatggaaggggtrttcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccctttggcaatktcctcacgtggtctttcctctgtgctcaagaaatcccatttctgaggccatgcacgttggctcacccctgtaatcccagcactttgggaggctgaggcgggaagatcacttgaggtcaggagttcaagaccagcctggccaacatggcaaaaatcagtctctactaaaaatgaaaaataaattaaaaatttaaaaattagccaggtgtggtggcaggtacctgtaatctcaactactcaggaggctagacagaagaatcgtttgaaccctggaggcagaggttgcacagagctgagatcatgccactgtactccagcctgggggacagagcgagactccatctctaaaaaaaaaaaaaaagaaaaaagaaaggaaagaaaccccgtttctctctgtatgtcctaatctctttttataaagacactagtcacattggattagggcccaccctaatggcctcatttaaatgtaatcacctcttcaaagggcctatctccaatactgtgacattctcaggtactggggatcagagcttcaacatctgaatttgggaggcaggtggtgacacagagcagcccatagcagaaggaacagcccaaatatgggtgatatgaccatatttatacttcagacctgcactgcctaaaatagaagccaccagccatgcctttactgagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaycccatctctactaaaaatacaaaaattagctgggcgtagtggcgcatgcctgtaatctcagctacttaggaggatgagacaggagaaycgctgtagcctgggaggcggaggttgcggtgagccaagatcacgccactgcactccagtctgggcaagagagtgagaccctatctcaaaataattaattmattagttaattaaataaaataaattagccaccacacctggctaatttttaaaattatttattataaataaataaawctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctasttccatgaaaggaactggccwcactctcttaccctggcttttgtcactgaagtatcttaaatatctctttctatgggcatatgactatctacctcattttttttcacttttttgaatgtgcttttaaaaattgataggaaattcacggaacataaaattgattatttgaaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccaytggggttggagactcctggaatagaccacattttgccccattgttctcaaaggctgcataacattgggtgcccacagcttattcaacctgtcgctgctagcggacatgtaggctgcttcctytttttttttttttttttttttttgctactgcctatgatgcttcartgagctgccccacaccacgcgtatatcttggcaggaagagctacgggataaaggcttagaagttaaattactgggccaaagagtatgtrtgttagaacgaggagagatctcactgatttgtgtttcaraaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagggaaataagcycatatattaaggraattggctctttagatgtctcatactgcaattttttttttactttacatatggcattttttttgtccactgaagttttaattttctatgccgacaagtttatcaaggatttcctttatggcttatgagacttggatattgcctagaaaggccttcatccagccctgcctggaaatactggatctgggctttcttctagatcttttatggctttatttgttattcttaaatctctgctcagctccatgtatttggaggtcagaactgagccttctattttccccacaaatggtggcagacccctggtctaggaactaaccatggcttctcttacctcctccagcaaamtacagggctcctttgatgtcagtgtcaagggcatcagcatttcggtcaacctcctgttgggcagcragtcctccgggaggcccacrgttactgcctscagctgcagcagtgacatcgctgacrtggaggtggacatgtcgggagacttggggtaggtctccatcggggcactgccagcyggactcctggttgcagctccyggccaatccagcgctcagcctggcctccgataattgcaatgatccaggtggcttgcacaggcacttgaagatcattctctggggaaccctgttragatgaacagacttaagccaggaatattggtgcatcattttcattaaaaaaataaactttcattcacytgacaaggggaccyttgtcaggtgaatgaaatctggctatttggaggaacacagaaactttggttgaaggagagtttgcgaaaaacatacaagtcyttggacaagtcatttcatctcttctagtctcagtttccttgattagaaaagtgtgaccgggtgtggtggctcacgcctgtaatcctaacaatttgagacgccaargcagaaaatcgcttgagctcaggagttcaagaccagcctgggcaacgtggtaaaacctgtctccacaaaaaaatacaaaaattagccaggcatgatggcacatgcctgtagtctcagctacttcaggggctgagttgggaggatggcttcaggccaggcgacagaggttgcagtgagctgagattgtgccactgcactccagcctgggtgacaaggtgagatcctgtcccccacccccccgcaaaagaaaagaaaaatgtggattctcaagccgcttccccaaatctgctgaatgtgatcatrcgattgggtgccgcaggcrctgggaagccagacacaccgaatcaggctggatgtgctgggacacagcagggcgccrggaaggggtggagagggctccctttgtggactggcmtgascagkgaccagggcctggctttcccaggcacccggccatccccaagttcagtggcagactgtgcttctctccccaggtggctgttkaacctcttccacaaccagattgagtccaagttccagaaagtactggagagcagggtaagaaggtccaagcctctggcctcccccgagcttggcrarggctgaatggaagacctcactgaccaatggccctggaccaggccatgggggctggtttagacgtacttgggcccaaagcccagggaggacaaatcatttgcccaggtcatggagctgttgtggsgcaygctggggacaaagctccaagtccgttcrgttgggyagaaaatggtcaactgcttgaccaagggttaaacagcaggggctaaacagagactccagcccctccctctgctccaccttgctcagtgycccacactgccytgcattccaccaaggtccgaaaggaaaccattcctcaggcrcctgcaagagaccaggcaggaaagctcagcgagggcgtgggccaggtgggaactgggcgagctcatgagcaccagccctggatggggaggcagcaacactgtcagactggcctgttaaaaaggagtatgtgaaatcttcagagtgtatcatctttgactaaatcaaaaagatgtcgtgttaactttcagttcctctaaacactcattcatcccaaaatcccgtttctgagatattagccaaatggtatctgtagcaatgactgtgggaagggagaaagtgatggaggaggaaagggaaaaaaacacacacacaaacacacacacaccacaccccacacacactccctcccagcacacacacaccacacacacatcctacacacaagcaccccccacacaccacacacacacaccctccacacacacacccacacacatcccacacacacacacaccccacacacaccctccacacacacccccacacacatcccacacacacaccccccacacacaccctccacacacacctaacacaccacacacatacacagcacacacatcaaccccctcacacacaacccacacaccctgcatcccccccacattcacccctcacacaccacacctcccccatacaccctccacacacacccccacgcacataccacaccccacacaaacacaccccacacacataccataccccacacaaacacacacaccccacacacacaccctacacacagacagcacccacacacaccacacgcaccccctacacacacaccacacacaccctacacacacaaaacacaccacccacagaccacccacaccccctacatgcacacaccacacacaccctccacacacacacaaacacaccacccactcacaccccccacaccacacacacgcgcacacacacacacacacacacacacacacmccctcgtctgtaggtccaacctctggtttggctttgagtgccccctcgtggttgaarcaggaacagcaggcaaaccccgcattttgggtgtggccagctgtgctctttctttkctggttctgggtccctgggattaagtgaccctgagaaatatgccaatctactcaggcaccctgttgccatattgctgtgcataacaatagtaatgtagcacaattataattatcacagtaatcacataccataattattgttttgataaatgtatataattaatgctgtacagaatatattattgtataactattctgatttataacaaaaatggctgctatttcttgagcctgtagcttggccagggataatgggctcagcagttcacgtgcacagtccctctggatctctctttttttttaattgagacagagtctcactctgtcgcccaggctggagtgcagtggcgcgaccttggctcactgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggaktagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttygaattatcttccagaaaaactaagagcctgaygcaggcctttctaattccccactcagggtgggatgtggtacctggaccagcaaggctaaggagaagaataagcactcacgaatgcttgctctctgggcgatatatactcactatctctatccccaacttcccaaaatattaccagaaaggggtcctgatccagaacctcaagagagtgttcttggatctcacgcaagaaagaatttggggtgmgttcataaagtgaaagcaagtttattagagaagtaatgacggaaaagaatggctactccacaggctaagcagcaacatgggctgctcaktcgcgtatacttgtggttatttcttgagtctgtgctaaaggggtggattattcatgagttttcctggaaaggggcgaggacttcccagaactgagggttccttccccttttagaccatatagggtaacttggaaattgccatggcatttgtaaactgtcttggcactggtggtcatgtcttttagcatgccaatgtattataattaacatataatgagcagtgaggatgaccagagggcactctcatcgccatcttggttttgattggtttggccagcttctttaccgcatcctgttttatcagcagggtctttatgacctgtatcttgtgataccagtcctgctgacctcctagctcatctggtgactaagaatgcctaacctcctgggaacgcagcccagcaggtctcagcctcattttgcccctgttctagatgaagtcactctagttataacaccactgacaaaaacaccctgggaagcacttggccttgccattgtatcttgtgagtgagaaccaaaaagcagagagaggttctgcaaaggtcaaacagccattggggactgggcaggatttgaatccaaatttacctggctttcctgctgcacccctaaccactaccccagtcgcatcctcaggaggccctgctgtgtgtctgcaactcaggcatcccatgcctcccctgcccagtccttcgggtccctaaagactggggcatccaggctccaggcttttgggatggtctgatgggctactgtctgaaggaaaggcaagaaaggagcggtcttcagggagatggatggagtttcttggttcccttgcaatcaaccacgaatgttcctcaccacacttgaccttgctttctggcagctcatcgctgctaaactcctctcccagaaaatggagcagctgcaaagagaggttaagatacagccctttgccctcccagcccccagygtcacccttccatcagcaacccagygtctgatggatggtgcctgcttacccttcagcacagaagccatctgtgacccctgcactaggccagggctctgcatgtccctctccttcactgtacatgtggattcattgcacaagaggtggtagctggctaacaaaaagagctgtttaaagtgaggactttctcatcrcacatcaacaaagaaaatattgacgtatgaacccaawtgttttaatggtggagtttcaggcagcgtctccagtgccccctcttcgagctgtgtcagtgaargcccacagctattctttgaaaatggtctcttgattgasattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgtygtctgttccaaatttaatcttgcttttagaggggtttttttgtttttcgtttttttggttttttggktttttttgcacctcacctttccagagtatttatcttargttttcrtagaaagaacccttatagctggggccgggcatggtggctcatkcctgtaatcccagcactttgggaggccgatgggggtggaycatttgaggtcagaagttctagaccagcttagccaacatggtgagaccccagtctctactaaaawtacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgtgtctcaaaaaacaaacaacaacaamaaaaaaaactcttttctcaatgatattgcattagtgtacataataaataattcgagtrattacaaaagcaagtrcagcaaacaggtggtaggctttcakgtggactccaktagggcccagttggacttttcaaagtctatcscaaggctgcatcataaataattcgggtgattacagyggcaagtacagccaacaagtttggaaatgcacatttccttctcttgagaagcaggccrcacaactggtggcaattgtgtgtgagtagcctacagaccccagcattcagtcttccaggagtaccagcaggaatggggaatactgatcagtccagccaatctgttcaggatgaccattaagaactatctacaggccgaatgtggtggctcaygtmtgtaatcccagmactttgggaggccaaggcaggtggatcgcctgaggtcaggagttcaagaccagcctggccaacatggtgaaaccccgtctccactaaatatataacaattagctgggcgtggtggcacatgcctgtgatcccagctacttgggaggctgaggcaggagaatcgcttgaacccaggaggcagaggttcacccaggagggtgagccgagatcrcaacactgcactccagcctggccaacagggcgagactccatctcaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctrtgtcagtgactccctagctcaggtgtccagccctgggacagactgaaaagtccaactggaccctagtggagtccacatgggkgcccacatagttttattgtttgtatttccttggtacctggctcatgacaagcacttataaatatttgtaaatcagtgatcactgagcacaygtgtggaataatgtgactgcagtgatcagcacsgggccagaccagagctggggaactcactcagkyattctcttcccatgtttttcagatttgcgaaatgatccagaaatcrgtgtcctccratctacagccttatctccaaactctgccaggtaggacaccccatccatcccgggacacttttatttctgttaatttctataagagcatatatatatcttataaaatagtaaatggggcaaaaatatagaaartaaaaattaagggccaggcgcagcggctcacacctgtaatctcagcagtctgggaggccgaggcgggtggatcacctgaggtcaggagttcgagaccagcctggccaacatggtgaaaccctgtctctactaaaaatacagaattagccgggcgtggtggcgcatgcctgtaatcccagctactcgggaggctgaggcaggagaattgattgaacccagaaggtggaggttgcagtgagccaagatcacgccattgcaccctaccctgggcaacaaagaccgaaactctgtctcaacagaaaaaaaaaaaaaaagaaagtaaaaattaaaagttcatttttctcccccacttttcttccaagaagtaacttctgttttgggtgtatcttttcagatattttctttgtatgtacaaatataaatacatgtaagcatataaatagacattcatgtatgtattattttgttcatgaatctatgtgtatatgtattattttaaatatatatrttcatatacatatagtataggcattgttccagatttcttttttttgagatggggtctcactctgtgtcccaggctggagtgcagtggtgtgatctcggctcactgcagcctcaaactcttgagctcaagtgatcctcctgcctcagccacctgagtagctgggactacaggtgcatgccaccacacccggctactttttgtattttttgtagagacagggtttctttatgttgcccaggctggtctcgaactcctgggctcaagtgatctgcccacctcagcctcccaaagtactgggatgacaggcacgagccactgtgccagcttgatttcatttttaaaaactttttattgaagtatatttataaagaaaagtgctcaaatcataagtgtgctgttaaagagtttttacatgcatgtaaccagctcccaaccragaaacagaacacggctggtttttcagagcccctggtgtccccctcggtcactgcccagccctccagggtcaccaccatcccaacttctaccagcaaagattagttttgcactttgcacatgaatggaatcagacaatattttgagtctcttttcaaaagccagaaggctttctttgttcaactttaaaatatgaggtcagggctgggcgcggtggctcacgcctttattttttgttttctttttttttttttttttttttgkgagacggagtctcgctctgttgcccaggctggagtgcagtggcgcaatctcggctcactgcaagcttcgcctcgcgatttcacgccattctcctgtctcagcctcgcgagtagctgggactacaggcgcccgccaccacgtctggctaattttttttgtatttttagtagagacggggtttcaccatgttagccaggatggtcttgatctcctgacctcgtgatccgcccgctcggcctcccaaagtgctgggattgcaggcgtgagagctcacgcctgtaatcccarcatttwgggaggccgaggcgggtggattacctgaggtcaggagttcgagaccagcccrgtcaacatggtgaaaccccgtctctactaaaaatacaaaaattagccaggtgccgtggtggatgcctgtaatcccagctactcgggaggctgaggcaggagaatcacttgaacctgggaggcggagtttgcrgtgagttgagattgtkctactgcactccagcctgggcaacagaacaagactytgtctcaacaaagaaaaaaaataataaataataaataaacaaaataaaatatgaggtcaggtcaggcttggtggtgcacacctataatcccagcactttgggaggccaaggagggagtatcacttcagttcaggagttcaaggccagcccgggcaacatrgcgaaaccccatctctacaataaatacaaaaattagccaggcatagtggtgtgtgcctgtagtcccagctacttgggaggccaaggtgggaggatcgcttgagcccaggaggtcaaggcagcggtgggctraaattgtgccactgcactccagcctrggccacagagtgagatcctatctcaaaaagaaatgaaataaaataaaacatgaggtccatgcatattgttgcaygcrcctgtagtgtagctggtttattctccttgctgcatagtatatcaccatgtagatgtttccccatttatttgttcattctactgttgaargccatctggggggtgttcagttttaggccattatccgtagtgctgctataaatgtcctagtacctatggtcgcatgtctttgggtatatatctgggagtgaaattgcaagctcgtcatatcatgtgatatgcccagattcagcattayaagatcctgccaaacagttttccaaagtggttgtaacagaccttatttgttracagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggyaaattatctgagatgttctctgatgccttakctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgygcttgtctggaaactgcttargccctaggctgagcatacacccccaccattgttaactcatccaagggaatccatgtagtstctttcttgaagaagcaattctttgcctcagggccgggctagtagggggattctgaagaaagtcacagggaatgtgartcagccagmgcccttgcccctcctccagcagctgaaagtgtcatctggcccctaattctgccctgtcctcattcacagttacaacagagattgacagtttcgccgacattgattatagcttagtggaagcccctcgggcaacagcccagatrctggaggtgatgtttaaggtgaggrtcctggggccgggctgcgtgggtgaggctttccctcagggtcagccattctttgggccacctgtccccscaacttcagatctrtcctcatcctcccagtggttcccgctttgtcaagggccrggtgatatggagtggtggggagtgtttccagagctaggattctcccacggctgtcttacacctctcaggtcttaacgcttccctcctccttcttcccctactttgccttgcccatcatgcagaaaaggccaatcagagcgggtcttagggagtgtagatgggcctagggcatatagaggggctggccaggacttcctrtgggttaatgtagcaaagcttctggtgagcttttcattaaaagacataacactgcctttaatggtggagtttcaggcagtgttccagccagcgtcccttcatcggactgygkaggggaatacctagcccctsccccacgataggctttgaaaagtccarttggaccctatttccctctccagggtgaaatctttcatcgtaaccaccgttctccagttaccctccttgctgcagtcatgagccttcctgaggaacacaacaaaatggtctactttgccatctcggrttatgtcttcaacacggccagcctggtttatcrtgaggaaggatatctgaacttctccatcacagatgacatggtgaggatggtggcaaacaggtctctcaaatgaacacataacctaccgctccttccttctttccttttcacccctgttgacatcagtcaaatagtgagttatagctaagagaaaaatcaacaccaagaaaaatatgttagcacaatctccctttttactttggcaaccargaaactcaaagccaaagttctttctcccatggctgggtgtggtggctcacgcctgtaatctcagcactttgggagcctgaggygggcggatcacttgaggtcaggagcttgagaccagcctggccaacrtggcaaaaacctgtctccactaaaaatacaaaaattagccaggtgtggtggtgtgcgcctgtaatcccagctacttgggaggctgaggtgggagaatcgcttgaacccaggaggtggaggttgcagtgagccaagatcatgccactgcactccagtctgagcaacagagtgagaccctgtctcaaaaaaaaaaaaaaaaaaagctcttcctcccttataacaactgtggaagactttgcagcttacttatctgtgttttgcttttctagacctgtttactagtctagacttgttagtctaattcatattttctctcatcctgatgatttctggaggtttattaaaaaatattttagtgaatgaggccgggcaaggtggctcatgcctgtaatcctcgcactttgggaagccaaggtgggyggatcacctgaggtcacgagttcaagaccagcctggycaacatggcaaaacctcatctctactaaaaatacaaaaattagctgggcatggtggcacatgcctgtagttccagctacatgggaggctgaggcaggagaattgcttgagcccaggaggcagaggttgcagtgagctgtgatctcrctacttcactgcagcctgggcaacagagtgagactgcatctcaaaaaaaaaawaaaaaatatatatatatatatatatatatwtttatatgtgaatgaggcaagataatacatgcactgataaatgcatatattttcagagaaaaggaaataaagaccaagtgaaaataaagcacaattataaagacactgagcccttaaattaatttctttaacatctcaaacctgtyggggagcttccttgtagctaaagtgaaaaagatacatgatttcatgattcatggtgaaaaggagagacagtcttcctcacacccccaaaacaactgtttccaatgtggctttgtataagggagactgaattttayagtggatctcacctttaatggttctccagtttatctaatatttctgggtttcaaaaagttgtttcttgaagcacttcataaaagttgaggcctcatgaataatgtcaggatggtgggagaaacagtgtggttcggctcagacggtccagcttaccctggtataagtcaggggcygtctggtagatcgagggtcattttgtccttctgatggcctcctacacctgcacaggccttcrcttctggcrtcgtgtttggtttacccatcctactgcggcacgggcctctctttcaatgggatgataatagctacgttttatggagcactcaccatgtgctgggscttgtgctaggatgttcgtttaggmctcacagtgactcgraggtggggactattgttatccccattttatggataaggaagttgaggttcagggagatggaagggcyggcytgagatcacaaagtcaggacacaaaccgaagtctgtgtgaccgcaaacctcaccctcgcagaccctctgagtgggagccacacatcagctgccccccggggagagcrggcaggatgctgaagtcccmtgtgctctccttgggtgaatgcaggacaggcatctcctccctgccagggtaacccaggctgtggagaagcgacagtcttgcacatccccctgyctccccaatcttctttagacyttcagctccagcrggagcaccctaaaacttcttcrtgtctctttgctgcagataccgcctgactctaatatccgactgaccaccaagtccttccgacccttygtcccacrggtaaggagtcccttagttccccatgwgtgcagaccgagcctactagactccagaggtttctctttaaaacctctgcatctctcagcttgaccaagagtgagaaggccgggatgagactcccactgaaggctggggtgctgctccyttcaaagcctaaataacagaggccacgccccatatcttgtgggaccrcagcttgtccaatcttttattggygytatctaagaatcccaaggaatgctggcatagtccataaaatgtaccctaatgaacagcagctaacaattacagggggcttcytaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgaygaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccacccagttcccatctcaagtttgccaatattaccagattttacatatctttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtgktggctcacacctataatcctagcactctgggaggccaaagtgggggggtagcttgaggccaggagttcaagaccaacctggacaacatagcaaaaccctgtctctattttagraagaaaagttaaaaaagaaagaaagaaagaaagaaatgttctgtggaatatcatattaaaagagtaatamgagaaaattaaatattttttttaaaaaagaaatggtgggatccagctgtgtcatatttygaaaacactggcatctgacctcagcatgcccaattagcagaatgtgatgaggggatggagaaaccttgggagaggtagggagggagaaaaaatgggcccaacttttctggaggacaatttggcaatacctgccgaaagttttaaaagcattgctggccaggtgcggtggctcacacccgtaatcccagcactttgggaggctgaggcgggcagatcacctgaggtcaggagttcaagaccagcctggccaacatggtgaaaccccatctctactaaaaatacaaaattagccgggtgtggtggtgcacacctgtaatcccagctacttgggaggctgcagaaggagaatcgcttgaaccccagaggcagaggttgcagtgagctgagatggcaccattgcactccagcctgggtgacaagagcaaaactccatctcaaaaaayaaaacaaaaaaagaaagcattgctgtccttcaacccagcaactccacctctargaatgttttcctgaaaagaatagccaagggtgctcacaggaggtgktcattataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgytcccagttagccaggctctaccycaacatgaamctggaaytccagggatcagtgccctctgctccgctcctgaacttcagccctgggaatctgtctgtggacccstatatggagayagatgcctttgtgctcctgcccagctccagcaaggagcctgtcttcyggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctggcccttacccccaatctaccttacgmcccttgccactttttcttgtaacaccccattatctttcttctcagcgtttactacaaagatactttgtagctgtctgcaggtgtatttgtttaatgcatgwatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttrccacggcagaggctctggctgtgacwatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacaytgagagtcagttttccttttttgatggactctgtctaatagggaagggatgttggrtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgrgcccaggagattgaggctgcagtgagccatgattgcaccactgcactccagctgggcgacagacagagactccatctctaaaacaataataataatttattawtgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttsagcacctacagtgagccttctgggagtctatgatctagtgggcaaatttcctgctttagctcattgagctgtttgttgaraggagacagttggtccctcgtcatcatccttcctatacatacaaccttcatcacttacacctgcttccttcttctggcatttccaggccactaatgtgtccgccaccttgaccttcaataccagcaagatcactgggttcctgaagccaggaaagtaagttggcctcctacctacatgggggtgcccagctggactccatctgtatgctgtagctgcttctctgtagctggtgggagggggggccaccatttggaaaggacacttacatttcaccccaattggcccaattcttctgccccactggtcctgcccccacaaatctcaaattgttaaagaattcactaagactgttacttcttaatgtatgaattttagamgccagctatatgaacttcctgaaatgataaagagtgagctttttgacactatctcatctgccctgtgacagtcttcccgatgtcattgtatcactgcttttagttcctcagtcatcttttccactcctgctcccgccctacctttggccctgtgccttctcaagcccatcctttctcgcttctggggacccccgcattgcttaaacttgcataaagcccacacyttttaatcttctctgattcattacagggtaaaagtggaactgaaagaatccaaagttggactattcaatgtaagttgtttttattgatgacatgattagaatgttaattaatttggggtgtttcctaagcaattgctatggcacctataataggaaatacaaaaggagaagagttgattttttgccctgcagaagtgtaaaaggtctcgaaaacacaagacatagggccaaggaacagttatatcctagtataaaacaatatataattaagtcatctactgaacagaattctcttaactgcaagagacagaaagccaattgaaatcatcttaagcaaagaggagaaatatrtaggattatataattgaaaagcaaaaataaaygaaaaaactaagaccagaggtttcaggcatagctggatccaggtgttctaattagtgcatcaagaatctctctccatctctctgttctgttttcatttgtgttagcttcactctcaggcaggctcttccaattggtagcaagccccagagtttcctacagtttcagttttttaaaaaatttgcacacacacacacaaaatctctgtgctagctctcattggactaatcttaggcacccagtcttaagccaagcactgtggccagaagtcagcccagcatggatctcatctacactccaggaggcaggatttgcagtcagctacatccaaagcacatggaccaagactggcaaggagggttgttccctgggggaaaatagactccgttatcaaaacaagagggattgagtgctgagcaggtaaatccaagaagtgatttccacaaggtagaaaaagtggtgaagtagacrgccccaaataaaaggaggaaagagaacgtgaaaatcagtgtgggccaaagttatggagaagagctttctggaaagagggaaggaggagctgggtagactttaatgtgtagtcgttggcttctcttttaccattccatgatgctggcctccaytgaccacctccacctgtgccctgcctcccagacttwcccgaagcacttatgaagtggaaacaaacacagaggcggtgggragagatgcagggaccctgaagctaactcctttcagagaataaagggtggagtgaataatggtgcactcatattgtatctgtgcgtgtttactgcaaagtaaaacattcaagtgagaagtttcacaaaaatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaacyttgaggggttgttgtgaagattgaatcagacatgcacgtaaagctctgagctctctgcttrgcatayagtgggggttagaagttgtgtttcatgattttggtagagaagcttattttgtttttattaaatttttwaaattatgtaggtagttcargaaaaacattctcactgtaaataaaaccgatactaaagataaggctaaggacatgtcaaatgttgatgttcttcctttagaggaaagactgtcrggtgtgtaactttccaaaatttttctattcacttgcataccaaatgttcatctcaaaagagttttatcttataaaatagtagcatgatgtaatactagtttgcttttyccaagcgttttgctatgttggcacacacagaaccaccatgtggccctgtggcgatgtaaatatatctctcytgttctcttccaggcagagctgttggaagcgctcctcaactrttacatccttaacaccytctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggatygttgaagttggcctcatctcccyccagggctctaatgarggttgggggctgggacagctctttggagcacgggaaacctccttataagygggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgggcaaagggcagggagtggaacgccctgttctttatcttatcatgaatgtgtgcttcctccagacagcaccatgcctgatagcttaggctcccaagtcagcctccctgggtttaaatcccctttctgacacttcctgtgtgacctagaayaagttacttggccactctgtgcctcagtttccttatctgtaaaatggaaakaataatcacacctacctcatagtcttggaaatcactaaatgggaatatactgaatatagagtttgcagagaacattttcggtaaaaatctgtctctaattattatttattcaccaatctctttcaatgttgtgcttcaacctcyagataagttgrcygaargcttcccccttcctctgctgaagcgtgttcagctctacgaccttgggctgcagatccataaggtcggtgggttcaggggggctctgaggatgtgtgagggaggaggtggtttgcatgctagctttggggccatgattcatgggtgacacccagcccagccctgcagctgggaaagtctggccaggggcaggacgggtgctcctgggccttgccatatgccacaaagccatccacatgtccttcagaagtggcacctctgctggtgcaggtrgcatttgacacagccctatgccaccaccacatcccatccctaccatgaggggcytgagggaagctcaagaccagctcgttttgaaaatactgcgggccgggtgcagtggctcaygcctgtaatcccagcactttgggaggctggggcgggcagatcacgaggtcaggagtttgagaccagcctggccaacatggtgaaaccccrtctctattaaaaatacaaaaattagctggacatggtggcaggtgcctgtaatcccagctactcasgaggctgaggcaggagaattgcttgaatccaggaggtgaaggttgcagtgagccgagatcacgccactgcactccagcctgggcaacagagcaacactccgtcaaaaaaaaaaaaaagaaagaaaaaaaaaagaaagaaaatactgtaagtcctagacgtagcattargtcaggttctgaaagtcatttgtaagttttaagcttttcttctaaattttaaggttgaagagctttattataaatacctgtttggcatgcctccccatttaaacaagtactacaaccatatatacttttttttttttttttttgagacagagcctggctctgtcacccaggctggagtgcagtggtgcratcttggcttactgcaacctctgcctcccaggttcaagagattcttgagcctgagcctctggagtggctggaactacaggctcccgccaccactcccagctaattttttttttttttttgtatttttggtagagacaaggtttcacaatgctggccaggctggtctcaaactcctggcctcaagtgatatgctcacctcagcctcccaaagtgctgggattacaggcatgagmcaccatatacagccaacactatatatgtttacaaaaattattcataaacctattgctccactacaagcacagtttgaattttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccracatggtgaaaccccatctctactaaaaatacaaaaattagctgggcatggtggtgcgcacctgtaaycccagctactyaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcargttatcttttgaggtgagatgaactgggttggcggactcattakcaggagggggatgctgcgctgtgcctggtacattgttaacaacagaaaataatagccattaaagggaatgaarggcargggggatgattagggacctagaaacactggccaactgttctatctaaaaaacaaatgtcgaaagcccttttgggctctgagatactcagcacttaactgctcttgagcatttataagtagtcagacagatcgttgttcaaagcaaagattgagtgacagttcataccatcggcctcagttttctcctctgtaaaacgggacataaccgaaatgtcagtgggcttttgtgatgatttagagggcaagtatgatagcttctagctcaatgtttgacatgtggaaagtaattagatttattatatattataatattcattagaattttgaggtcaactctgcccatgtgtctaaccgtctaaaacaaaggatggatcactgtgggaaagaactgaacttggccttcggttcagaattcctgcccctctgggtgatggaaacgtaagaagagcaggagagtacaccctagcagttcacaatttttcattatttgccaaagagagaaaatttaggtgacgcaaaggacacttagaggcctgccgggcagcagcagctcggggaatgacagatcgatctctaccttggagaaggtagctgggaagagctgtgctttacggagagcttggggastgaggcacactcgcaatttatgcactgacctggattctggcagagcttgtgtttcgtgagacgtgggctccctttcaatcgcagatgcatctttttggagtagaggatgctctttaccatcctgtcctgtcctgtttttcctaggacttcctgttcttgggtgccaatgtccaatacatgagagtttgaggacaagaaagatgaagcttggaggtcacagctggatctgcttgttscatttccagctgtgcagcaygtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctcccygactggcctgggatatctttacaagcaggcactgtatttttttattcgccatctgatccccatgcctagcagagtgctggcacttagtaggtyctcaataaatatttattaaatgatgagatgatggaatcacctggtattctagctgagcctcatcactgcctgccctcttctgacctcaggggtctttggatagtcagccacatctatggtctccaaggcccctttctcatcgccgctgctatgggagcctcaatgagagaaccagggattctgtacatcatgtagccctggatctggcgctggtgctccgtctctaaggcccttgtcctgtctcaggcaggggctcacttcgacatcgctccctccctcatttcttgcctgctacagccaagggagccaatgatctcccggagcaaaaactcagcctcccgctgcttttccctcattgaagcaggtgtaaattaggaggaaatggatctgtctaagtttttggtccaaccccaataaaaagctcatccaactgttgtttatgagccccaagcctggagggagaggccgtgatttctaattactgaacaatgagcctttgatcagactaataaagagtcatttccaagttatgtagttgggctcccagggactgggagtcagaagactcgtttgataattttttttattgtgttaatgagcagatggatggagcttcaggctagcagataattcacagggaataatcccatttaccctgtgtgtgacagagatgtgttccaagatgggacgatgtgttgtcgcccagctggtggcagggtaagctgtggcttcaagccctctctcctctccatttttgttcatttgtttgccaccatccatccctatgaccgactggcaaaggacacaggcttcatccagtactagccatgtggccttgggaaggtcactttccccctggggtcctcatctatgaaatgatgatgatgattatagtagtcaattcctgggactgctataatgactgcattgggtaatctatgtggaargatttatttagccaaatggggattccatatttattggctgggtgtgcttactaagcacctcctatttgccaggctttggggtcctcatggggagaaatacatggagcatgggctccattcctgatcctgcttttaagagtgatacttcctctccctctccctctccctctccctctccctctccctctccctctccccacggtctccctctccctctccctctccctctccccacggtctccctctccctctcccctctttccacggtctccctctgatgccgagccgaagctggactgtactgctgccatctcggctcactgcaacctccctgcctgattctcctgcctcagcctgccgagtgcctgcaattgcaggcgcgcgccgccacgcctgcgtggttttcgtattttttttggtggagacggggtttcgctgtgttggccgggctggtctccagctcctaaccgcgagtgatccgccagcctcggcctcccgaggtgccgggattgcagacggagtctggttcactcagcgctcaatggtgcccaggctggagtgcagtggcgtgatctcggctcgctacaacctacacctcccagccgcctgccttggccccccaaagtgccgagattgcagcctctgcccggccgccaccccgtctgggaagtgaggagcgtctctgcctagccgcccatcgtctgggatgtgaggagcccctctgcctggctgcccagtctggaaaatgaggagcgtctctgcccggccaccatcccatctaggaagtgaggagcgtctctgcccggccgcccatcgtctgagatgtggggagcgcctctgccccgccgccccgtctgggatgtgaggagtgcctctacccggccgccccgtctgagaagtgaggagaccctccgcctggcaaccgccccgtctgagaagtgaggagcccctccacccggcagccaccccgtctgggaagtgaggagcgtctccgccaggcagccaccccgtccgggagggaggtggggggggtcagccccccgcccggccagccgccccgtccaggagggaggtgggggggtcagccccccgcccggccagccgccccgtccgggagggaggtgggggtcagccccctgcccggccagccgccccgtcggggaggtgaggggcgcctttgcctggccgcccctactgggaagtgaggagcccctctgcccggccagccaccccgtccgggagggaggtgggggtgtcagccccccgcccggccagccgccctgtccgggaggtgaggggcgcctctgcccggccgcccctactgggaagtgaggagcccctctgcccggccagccgccccgtccgggagggaggtgggggggtcagcccccagcccggccagtcgccccgtcggggaggtgaggggcgcctctgcccggctgcccctactgggaagtgaggagcccctctgcccagccgccaccccgtctgggaggtgtgcccagcagctcattgagaacgggccatgatgacaatggcggttttgtggaatagaaaggggggaaagttgggggaaaagattgagaggttggatggttgccgtgtctgtgtagaaagacgtagacatgggagacttctcattttgttctgtactaagaaaaattattctgccttgggatcctgttgatctgtgaccttacccccaaccctgtgctctctgaaacatgtgctgtgtccacccagggttaaatggattaakggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaataaataaataaaaagagtgataggtgtgctgaaaagagccagtattgattccagcctacctgttttgggtccctgggcaaggtatctccaagcctcagtgtcctctcctgtcaaatgaggctgggaagagctcttggcgggattattttggaaattgatgggttcaggttaagcttccgtgggtgcccwgagaataaccaggtggtggtcaatggatgacacaattagatcacctgtcatacttggtgtccccagaagcagaccctgaagaaaagaggtgagtacaagtatgacggtgttgcaaaagtaattgtggtttttgctgttactttctttttttttttttttgaggtagagtctagctctgtcgctcaggctrgagtgcagtggtgcaatctcagctcactgcaagctccgcctcccgggttcacgccattctcctgactcagcctcctgagtagctgggactacaggtgcctgccaccacgcccagctaattttttgcatttttagtaaaggcagggtttcaccatgttagccaggttggtcttgatctcytgacytcatgatctgcytgcytcagcctcccaaagtgctgggattacaggcgtgagccaccgcgcctggcctgactcccagtcttttctccagttaatctttcctgggtttttgatgagattcctaggaagggggtcttaagataattgcatttcttttggaaagaagttttcttattcagagaaggaaattccagacagagtcccttctggtgcttcaggaaagaggatcagagagctaaggaggtgagggaagatcagagggagaccttgagtctgcttttttagttcagcatatcaatgtgccatatattggcgtattgttttcygagccccaacagtgttatatctcgatggggtagtacaggacaacacagctggccctagagtcccatagcaggttctgacgccctgaaatctgactgtaaacatatgagtatcctggacagctccaacctgtagagaargactggccttgggacaggakgttctgatctcaataaccggaagaactggactgtcaaagaaccttcaagagaccacagactcattgctgtgtagatctcattctcacacaaaaccaagatgccwccttggagcgcctcctcttgactacaacctgttcctcccttctgcccttctctgatttcccctctcctctcctcaacctgatcaagacctctagcctcaccggtgtcttccaggccgctattctgatttaatttgtctccataactaagcacagttcatcatctctaacagaatcctttcatctcctgacaatcytactttccacatccccagcctggggcctaggcgtaggyaagagaattaaattactggaggaaaaggcaggcaggctatagccagttgaggtctccttccatcaccaaaaccatagttctgtctgaatggcctgagcagcagcaacagcctagaaattggaatacatgatatttctaatgaggctctcaggtaaggtctcagaacccattcagtctcaagacatgctttttgtttttgtttttgtttctttgagacaaggtctggctctatctcccaggctggagtgcagtggcacaatctcggcaaacgacaaccttcacctcccggactcaagccatcctcccacctcagcctccagcatagtgggactacaggcatgcaccaccatgcccagctatttttgtgtgtgtgggtatttgttgtagagatggggttctgccatgttgcccaggcaggccctgaacttgtgagctcaggtgatccgccggcctcagcctcccaaagtgctgagattacaggcaggagccaccatgcccagctgcatttcttctttctttttatttattttttttgagatggagtttctcycttgttgcccaagctggagtgcaatggcatgatctcggctcactgcaacctcggcctcccaggttgaagtgattctccagcytcagccgcytgagtagctggaattacaggcgcccgccaccatgcccagataatttttgtatttttagtagagacttggttttatcatgttggscaggctggtctcaaactcctgacytcaggtgatctacctgccttggtctcccaaagtgttgggattacaggtgtgagccaccatgcctagcctgcatttctttctaagagcccaagatgwagcttagaagaaaagacactagcatgccaggatagtccatattgtgctgtaagtgaaggcagcatggagaagtcttggcaatataggtaacaaggtcaggggcagccacaggtctgaataggtggaaagatgagagctgctgggtatagtatcaaagggttaggcaaacaatagaaccaataagtgtgcgtgtttggaaaggacagaagaagaaaacaaaataaacaaaaccaaaaccaagtacagcattgggccccagggattagaaagtcaagcaggagctagcacggccaatgcactttgcttctttcactggaaaagtccaaaatatattttcctattagtacacagagatcttctgcatttgatttttaaaatttaacacagctacataatattccacatttgtgtatgtacaaaacracttcttcattcttatttaaagatgcataggatctcctrgtgaaagatacaatttatttaaccagttcctacttatgggtcatcaggttgttttaaaacttttgcttttataaataatgtttcagtgaatacctgtattcatatgccaattcatacgtgtggaggtacattgtagaataaatgcccagaaatcaaatcctataactctgactctttggttaatttagcagattgtcatttgctcactttctcttctttccagactttccccttctcttgaggtggtgcctgggtatacagggatgttgaaggggtccacatggcatcatgagagtggagtgaagcaggacatagtaaagaatttaaccttgctcaaagagagacatggcttttgtccttggcccctggaaggtaatctctaagcccttggaatgcttgcctggtaagagtgcctttgtttacctgggggcattggtccataacagatagtctaacaaggggagccacggcagggcttttgttcacatcatatcagcttaatctctgaagatgctgaagactgagcccagccacatgggcagccaaccagattggcatgatcaaggccccaaaagactctggagcttttcagatgattttcaggagaaatgactgagcccaaagaacaatagcctggaaggaagttcctatgagtgctgtgggaagtggtgggaaggtgaggggcggaacttcacaatgcacaaaggttgtcttatt

SEQ ID NO: 13347 - DNA, 46271 bp, Homo sapiens
gctaagcacagtcaagcacttaagatatgcaaaatacagtctttacccaaaaagagttacaatctgataccaattgcaataagataaattgcattttttaaaaaatttaaatactacatgggctcatgaaaaataaactttttaataaatattacatctttttctaaagatcaagaatgatcccacagtgaagacggtagaagatatgaaaaatatatgaaaaaagataaaggcattaacaggtgataatgagaaaatgacaaaaatattaaggcaaaataacttgtaaagtaatccagcctggaaattaaactacatccaggaaatagtgagggacacagaacaagagctttgtcagaacctgggtcttatcagatttaaatgttaagagggaggagcgaaaatttctagcttaagctcacacatttatagtcctctcttctaaaagacacagtaaaggacctttaaagcataagccagaaaaatgaaaagaataggaggggtgccatcagcagacaaaaaatttcaaagtatttccaaaggatccccagcaaatcagagaagcatcaaaggaagccatgaaagataaggggctggtagcagaaaagaaagccaagctgccaaaaatgatccaggaaaggttccaggcttagaatctcaggtatgaaaaatgacagcaaggagaaacagctgaaacaagggagaatagtaaaatatttatatacagaacaggtgaccttcttacccccaaaataatatttttataaagaaatataactaactgacagggagaaatactgtcactatcgccggaggcaacacttctctctacataacattttaggggctactatgcccagcagagtcatagacagcaaaggaacagagttaatatacatgttaatgtcttttaaaatacagtttttcatttattcctgcttgtgttgaaaattaaaatcagaaacatctcaaacacaggttgagtatcccttatccaaaatgtttgggaccaggagcgttttgaattttccattttggaatatttgccttatgtttactggctaagcatcccaaatctgaaatccaaaatgttccaatgagcatttcctttgactaccatggcactcaaaagcatttcagagtttagattcttggatttgcaatgttcagtttgtatttctaaactaaggaaatgaaaaagactcttacctcttgctttccgttcaaactagtaagcaacactggtcgacctatacatatatttgcagacttcatagtgttgagtccaagatgaataagggaattctggaatgttttaggaattttgtcatctactatgaaggaaaagaaaattatttttgtactactttgtaacagaagttaaggcatgctttcttttgcagtaaataaaaatactctaaccatataaccacatgaatgtacttaccataccctggagaaactagtgttccaacttttgttataacaaaacagatttaaaatcaaatgcttttgagggtctactggcaacatattaagtattaactaaaaagaagatgttttatggggtgagtattggtttctttttttctgagtctctaatttcattaagaagtaaacataattgcaaaagagagtctctgagctttaagttcaaagttgagtcagctactagtattcaaaggattgaactgggaactggcacatctatctggctctagaggattaagttatgtttctacttctgccccacattatggtcaccagatctttttcttttgtattaccaagaatacgtaaagakagtaacagaagtcgtcttccttatacgaacacacaccactagtgatttcaacttttggctgaaaaagggggtccagaattcaggccagttaacaacacctctgaaaatgatgtgctgtcatctccactcctttctatccaccccacccccaccaagctccatatttagttaggtgtccctcctctaattcctccagcactctgtgctgccagttaatagcatttaccataatattcatttgttttagtctttctccttaattgtatactgctttgaagcaggaattgggtcctatttctctctgtatctccaatgcttacagtgcattaaatatagcagttgcacaataaatagccataaaatgaataaatgtagtaaataagtatacaatggttttcttttcagcacaaaatctatgaaacacttagagaatttaaaaatgtcacaacttcattataaaatttattgtaaacatatataccataatcacagagctctacctaagttttccttaataatcagaaaacagatattctgtaataaaaaagaaattaaatcaaggaaaggaaaaccataaggtacccatatgatttacattattctgtcactacaaaacaactccccaacacatttcttttccttcttatatgaggtgcaaatctagaaaaacaaagcatctcacagagctaagatgaacagcactgagtataaaacgaaatgaacacatactgcataatacaagaagctggacagaaattcaaccttccaatgagcattagttctcttacattgtttgctggtcattaacagtaaagcatactgctgttagatgatctcataatattcagttcctgcctctttcttcctaaacctcaatgaactatctttccctcttgacaattaccacacaagtgttctcagtccttcccaagactttagttttcttcttctccttccaccctatccagcacattctccatgtcccaggatttattctccaccttgtctttcaatggtaatcatgttcaaattcccagccactggtctcattttccaaaacatcaccaacgtgttctctgcttacactatataggtctactcaagttgtccacacagttcccttctcacctcactcctccaatactttaaaaatatgtcaacatctaatttccccattaactactttcacatttattgagcaccttaagtatcacattaactaacaagatagtaaagataatttcaaacaaccatccacccttcatttattcattcagcaaatatgtactatgtgcctactatatgaaagatactatgctaggcacttttgttcacaagtccttggtctcacagagtttatagccttgtaggatgagtgagttattaaacaatcagtggatagctgtaaaataataaactaagattaatacaatgaaaaaatgacttagagtgccaggagagccatgtgggatctgacctaatttcaaataagagaatgtttctcaaaggaagtgatgttaagatcaggtctgaaagaagagtaggaactaactaaatgaggagaagaaaaagataattctcagcaaagaggacagcatgtacaaagttcctgggcagaagggggtatggcgcatcctcaggagagtataggcagagtggtggagacatagggaagccatgtaaagaaggtcaagaccacccaggacaatagtgcaataggctgcatcaagatgctggtcattactctgacagcagtgggagcccagaaagggatgaaaagcaatgtcatgacaagatcttcatcttacaagatcattctggctgcagaatggaaaaggaataaggggcaaaattggaagctggaaaatcagtcaaaaggctgttgtagcagtccaggtgagagatgatggtgtctgaaattaaggtagaaacagtgggaatggcatgcagaagaggaatatgtaaaatatttaggtaataaacatgatttagtggtggactaggtatgtgagatatgggggggagagtcatggatgactcttaggtttctgaattttgcagcgggaaaaactgaacagagttgaagtttattttgttggaggaaataacgggctcatgaagttagtcctgaagtatctttgggacactcatgagaagagttattgtacagtgctattcaaaatatgacccacaacgatttgttactgcttcatgacaagtacaaaacaggagaawaagtatatagaagcttttattgaaatttacagagtaatttcacatctgtttaataaaaatttttccttatttttctagaaaatcatttttactgtattttagaaaagtgcygatctgtgacctattataaattttaaagtcttcaccacagagagcttgagaagcatttggctaaaaggcaaccacatcaaggcgcaaaaacaaaagatttacaaatataaatctgacactgaagagactatagatgggaaactctgggcactggatgaacttgccaaggagacaggatttattgagaggaaaaaaaaggttttggactaagaattgacgaacttcaacatttaatggtcaagggaagaggacgagcctgcaaagaaaaatgatgaaacatcaacaaagatgaagaaaaccaggcaagtttgacaacacataagaagttaagtgtttcgagaaggagggaatggtcaacaataccaaaagttgctgtggtcacgtaaggtttatcaacacggagatgctcggagaccacaycaggaacagtttccatggaatgatggggtggaagtcaaagaggaataggctagggagagtatgtaagtggtgaggcggcagagaccactccattyaagaagcttggcaatggayagagagacggttgcaggaagaaaatgtggagcttttgttctgatttaagatggaagagaaatgagcatgtttacatgtcaatgggaaggatctagttcaaaaacaagttgaaccttcaggacagaacaagttgtcctctgatacctaaggcagagtgaaaataccatgtkaactctaaattgtctttaaggtctgattagacataaaagtttttgccactagtctggtccatttttcaaagctattacacatcaaatataaattttcaatttttaattcaatttataagacttttcagtataaatacgttctcccaaatcaaaggagctgtcatctaggaatggcttttaagtcaaacacatctggactcaaatatcggctctgccacttagcacctgtgtagcctgaatggaatcacgttaastttcctccctctataaaactgtcattactatacccatcggtcacggcttctgtagaaattagatgagctatatatactgctaacactagtgtgcagttactagcagttattaaatatcataacctgcgtagtactggaagaaaatgctatcatcactcctaaaggcagagtgatccacatttttactgaattggttatttagttttttaggataagtatcccatgttcgctagttatgaacaattttgcaattaaatgtgtcgttaatgttaaatgagacaaagcgtttcaagtgcaacttaaaaattcaaaataatttacaaaagagaaaccttggacacggataaaccatttcagcctaacttctccagtgcaggcgcggctacgtttgcatgcttcttacatacagaagtcttacacgcttctgtgccgctctcagacccatgccacgcccaactttcaaaagtctctgcaccccaagtcagtatcactgagtctcccgcccctcaggttgcgccccctcggcctctagtctcccacccggaattctttacccttttctaataagttggtcaccgtcagagtcccggaggttgccgcgaagtctgatccagcagaaggagcccgtgcctccgcasaagaggaagcagcagagggcaaggacgaaccattttccgcgctttggttcaaccgctttctattcttcttggaagacatggtcacaaggtaccctagccgaagcagtagaaaagccgactcaatgtgcgcgcttcaactgagagaaaaacttccggggcagaagtcagcgagggtccgcccctgcgccgtaatcccctgagtggagcgcagcagtgcacagcgtggtgggagggactgagcgttttcaaaamcagcagtctttgaaacagctgtaacggcatctgtgaaagaagataggttccaggaacggaactgccacttagattgtaaattcctgaaaaacaggacgtttttgcatctcctcccggcttccccatccctaaaccaacgtctgttgaattaaactaccaaacaaaataagtgagtggcggtgggggaggaggttttycccgcttaactggagcggggcaaattgctgagaagggctggtggaccacttcgcggtctccttggcatagctctgcagagtggtaaccccagctcaactctgagggtattgatggcactcttctaaaatgtacggccgcgatctccgctctggagcgcggaggggtcatttgggcaacggacgaatyaagcggcgtggagatgcggcagccrctgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcagggcaagtgcgcctgggacgaagggctcccggggctccagagcttttctaatgaaataaccgcggcccccactccctagtcgctctgtgcaccactgtcgagcccagagggaaagggagaaggcacgcgtgacctggacctgttttctggagcattcgtgcttagaccttttgctgggaggtctctaaggcggttgggtgaaatggtgaagatcccggactttgggatctgcaaccctggttgctggtccactttctactgtgcgacattcggaaattgccgtaaaccaccatttcctcttccacagaccccggtgataagaactcctggaattactgagagttaatttggataatgcacataaagtgcacagcacagtgcctgccacgtatttaaagctcagtagatgtttgttaatattatattattacattattagtatcctttaccgagccttggttctgtcggacacttttcccaaggaaaaaaactcttacattctaatacgggtggtggactgagtggaccaaagaggcttttcttttttatttttaatttttgtgggtccatagtaggtgtgtatgtttatggggtatatgagctattttgatagaggtataaatgtgtaataattacatcagggtaaatgagatactcatcaccacaagcattcaaccataatccagttactcttagttatttttaaatgtacagtttgttttttttttttttttttttttgagagagggtatcattctgtctcccaggctagagtgcagtggtaggatcagggttcactgcagcctccaacccctgagctcaagcaatcctcccacctcagcctcctgggtagctaggactacaggcgcgcatctggcttttttctattttttctagaaacggtgtctcactgtgttgcccaggctggtctcagtctcccgggctcaactgattctcccgccttggcccctcaaagtgctgggattacaggcaggagccactgcacccagcctgaatctttattgaatatagtcaccctgttgggctatcaaatactaaaccagagaggttcagagtgtcacatttgtatacaaattgggtcaacagctgtctcagcgagaactggagttttttagaataacgcttcttttatgattaaccagggacggtggtgggtggtttcagtcttcaataagaaaactttttactggctttcaaccttgagcccaatgataagaaagcttggatggaggagccttcactttgraagaagtcgatttagtggtgcagcagtttttcaaacggcctctgagggttttataatctaattgaaggcatagcatgcaaattcaactatggaaaaatctctcacactggaaactcaaaataatctttatcctattgagcaatatggcaagaagcatatctgtaaatataattgagctagttatttcaatgtttactcatcctcattcccagacttcttacctcttcacattattttctctcctacttgctagtaattgctgacaagcccgcttatactgcaacagtgtcactaataggagaatcaatcgttttatcttccagtgtgtgggtagacacaggtgttgtacccactgatacttatcaatgaccaaacaggtgatcaaagcactaccccagtcagcatgacaaagcagaaagctgtgcgatttggagrtgcacattctgggtttaagtaccaggttctgccatgtgcttagccaggcattaggcaaattgccaccaaaaatatttgcttcttagcttgctttttgtgaataacgccagctctaattactggatagatgcgttgatcaaagatgaaactaatttgtaaacttaagtaccaaatacttgttayattttttcaataaaacaaattttgttgcacttaatggtagatgttttaggatctttataaatagtaattaatcctcctaacaaccctttgaggtagatagcattattattcctattttaaagatracagtagtgaggcacagagagaaaaatttacttgccctggctctacacctttcttactgcactatgctaccttgaagaactcctgctggttctgttgttataattgaacaaaactaactgaatggtagtgcctataaagagagactatttacacatgaagtccgctattcttagtctttatggactaagaagtccatattcttggtggaataagaagtcaactattcatattcttttagaacatgaactattgatgttttgttaccaacaactgaagttagagggataaacaggcaatatgttgttagcttcacacataacatatctgcatcagtaatgaaatagcactggttctggtccctgctatgccactcaccagctatgtgactttaggcaagccagtcatttcattagtacaaattgagccccagtgcataatgtagggttaccctggaggattgcaaatgcatggaatattaaatagrattggaaaaaatagctaatggaagagatatcattaggtcatatgtaataagttctaataaattgtacagacatagtagtctttaaattcataatggtgagctcatgagcagtggttaggaaagactggtcaaagatgtggaatatgagctggactttaaaggatagatattagcaatgggaatgggaggtgagggaagaaaaagcaataaagcttattagggaaaagaagaaagcaatttaaaaatgattctaaggtttcaagcattggtgccagaaataaataagcttataaatgaagctagtttggggtgtaagattcagttttggccaggcgcggtgggtcacgcctataatcccagcactttgggaggccgaggcgggcagatcacgaggtcaagagatcaagaccatcctggccaatatgatgaaaccccgtctttactaaaaatacaaaacttagctgggcatggtggcacgcacctgtaattccagctacttgggaggctgagacaggagaatcgcttgaacctaggaagcagaggttgcagtgagccgagattgcaccattgcactccatcctggtgacagagcaagactccgtctcaacaacaacaacaaaagattcagttttgaacacactttgtgaagtctgaagtggtaaccttcaggacaggaaatgtctgggagcaactggagaacagaaagtttagtgttcagtgaggtcagggctgggcagccatcctcatgtatgtatcagctgaagcagtgagagtggattctccaagacacagagtgtagatataaaacagcaagcaaatagcattgcttttagaaagtagccttttaatttgattggaaggattgcctgggaaggagcacatgtgaaatgtatggagtgatagaaatgttctataatgttaaagtgtgttaygggcatatgcatatgtcaaatcgcatgaaatgtacasttaagatttgtacatttcactttatgtactttacctcaatttttaaaagatgtcatcagacaaagagagcaaggtgagaaggacctgatcccataattccactgcatgctaactcaaatcaggaagtctttattaaaggccccatgtgcctgtcactgtgctaggcacagcaactttcaaagaggtagagaacattgtccttaaagagaggagcttcctgcagagctagggaaaagagaagggaaagttaattaactatttgatatataatcaacccccaaagacagacacacacacacgctttatagcgttattataaagattaagtgagatgatggatgaagaaagtgatctgaaaagcttttctaaaaactctaaatctgaagtatttatttcttcacccataaacttaaggtagtaatacctttcatggttgtgcacttaatgagataatatatataaagtgcttggaacttagtaagtttcaaatagatattagcatctttttcccctggctcaatcttaagtagtaaagagaatttaaagaaggcaaagatagaaaacctataattatgttcaccatgatattatctataataaggaaaaattagaattttattcctatatgctagtaaaatgtgaagtttgatttcttcatattttttattttcaaaatttctacaaccagcatacattatttaaaaacaaagtttaactaccttgaaatttatacattaaaaacattataacagaactcctaaaggaagaaaaaaatagaagtccataattgtctttaagattaaacctaaggatgttaaaaggaacagcattcaaatggtatttgattcggtttaaatccttttatttgtccactctaaaactacagaacatctgttacgtgccaagcattgtctttggtggtatggatataaaggtcagcagtgtaatgactttattcygaaggaattcagtctgatggaaaaatcatataaacaaggtggttactataaaacatggtacttccagtgccagcgatgtgaacaagacatttggggacctcttttgcttaaagatggtttcctggaggaggcgaaaccctgaggtgagttttaatttattccactcgtctctttggaaattatttagacttttttcttctgcatttagctgcagtacagcaatggcgatcagaaggtagaacagctgtatggctgcacattcccatcctccaaagccgatttattgcccctgctgcttccctgggcttcygctttcaccacgcagaatcggattcatcaacgttgactctgtggctgagagaagggcccagcagattaccaggatatgcttcacatcaagtaggagttgcaggtcagtttcaaactcatgatgagcagaattaactttttagacgttcacccaatttcttgcttgttacagctaagcaaatagtttattcatgtggaatgagttatttgattaaatgattacrgtggttccaccctatctgcacaggatgtgttccaagacccccagtgggcacctgtaaccgcagatagtaccaaaccctatgtatatwtaccatgttttttcctatcacacatatttatgataaagtttaacttataagttaggcacagtaagagattaacagtaactaacaataaattagaacagttataaaagtatagtgtaataaaagttatgtgaatgtggtctctctcaaaatattgttttgtattcacccttttgtattcacctgcacgatgaggtgaagtgaggtgaatgacaggcattatgacctaaatggaaaattccagaaaaaaactcttaagttttaaattgcatgctgttctgagtaatgtgatgaaatctctcaccatcctgctctgtcccaccaggccgtgaatcttccccatrtccagtgtatccatgatccataggctacctatccattagttacttagtagccttccctgttatcagatcagctgtcccagtatcacagtacttggattcaaataacccttattttccttattaatgccccgaagcacaagagtagtgatgtaacacttygagactatggttgaccttgtataactgaaatcacagaaagcaaaactggacaagggggactacagtatctattacatagtgcttttaaataggactattacatagtgcttttaaatagatgaagtttgcctcaatcagtagacagacgcacagagaacaactttagtgtttagttttccaaaggatatgcttgaatatattttacacatataattaaacttcactactcaaatagtagcactgaattgggatcagggaataaatttattgcagagtaaaacatgttggcactaattatgtaaatttgtaaagtaaatgatcatttttatgttgaatttcaggtaaagcaaaccaatttttcaatgatttgaacaattacttcttaataatatttacattattstgccaaacagttgtttaaaatcgtgtaatttaagtgtagagtagaattttgaagtggctgattagcttcagagacataggaaagttgagagaagacttccctcagagtaagacacagattctcacattgtagattgcatcaaaatcacctggaatcttaaaacagattgctgggccctatccccagagtttctgattcagtaggtctatggtgggacctgaaaattcaggtgatcttcctggctgtttctgtttttgctgctgctgctgctgctggtggtggtctcagtactaccctttaaggaccaaaattyttagatttctagaaaaactataatagtaagggatccttatgaccttaataaatgaaagcaatgaagcatattagttatttaattaataattttatttgcctttatataatttacaagagtttttaaggtagtttgcttttcaaggcttttcaaggagttgttcaagaatgcctaatgatgtcttctctgtccctgtcttacttccctgtagcaagtagacattcagaaactctccgttcagctctatttcaaaagattctactcaataatttagtgacagcctcacacttcaatggaaagttatrcaaataattatcattcacgggcacagactcttaagagttcccagttattactacagaattggtaatatatgcaaaaagagtatcctatgaagggcctgttgataactaagtactatattgtatattgtacattatagtttagagtgtcagagcagttcaaagaataagagatgcagaacttgaccaatcttgaacactaactaggatttgaagccactgttgggggtgtggacgaggtaatgtaagaaattgttctggaaaggtgcagagttgtttttktkgttttttgtttttttttttttttgaggmagggtctcactttgtcacccaggctggaatgcagtgtcatgatctgggctcattccgacctccacctctttagctcaagtgatcctcctgccttagcctcccaagtagctgggactacaggcatgcgccaccatgctaggctaattgttgtattttttgcaaagatagggtttcgccatgttgcccaggctggggtgcagagtttttaggtggaaagaaaaataattggcatttgttataaactaccgaaggcagatgtggctggaatagctggagccattgctttcttttgcttttcaaacttagcaagcttgtgtctgactcagagccttgacatctactggctcctcttcctgcagcatgcttctccagaactttctttatctagttcttcatagccgaagtttctgctcaagtgtctccttctcagaaaagcccctgacccttctgttagaagtgacttctccctgcacactagtgccatcattccttgtccctttatccagctctatgtttctttatggcatttatcacagtctgaaactctattatatcatgtatgtaaattaattatattgtatcacttaatctcccccacaataatataaactccataaaggcagatattttatctgtcttggtcaccacgatatcctcaagctaaagacagcgagtgacataaagtagatattcaatatttttttaatgaatgggatggaaatgtgagtcttctgagagagmagtttcagtattgttgaggggcagcattgcacagtgagaagagtgtgcctgcctagaatccagacagactggctatcagtcccagttctaccagttagagctatatgaagccagacactcatatcactcacaggattattgtgacttatacctgagctaatgtacgttgaagcacagtgcctaatcataataataatttttatgttgtgaccagcagaggtckctcaaattgtgctttagtggtgctggttttgtctctgatactgtgctcatgtttacagtgaattcattagggacaagttcaatttgagtaaccacaaattattaaaatttaagagtaagtttccttggcatttctttggcagtctacctcttgtaaagtccagttaaattatagcttacattttctaatagaagccaacattaatgttaattatatctcacttggtgattttccttcctgctttaaaatagtcaagtgtggtgttttcatttcaattgcatttcaattacttttccccatgttacacatatttattccttctctatattctacatagcatttatcaccttctaatattctatataatttattttttgtttgttttggcgcctccccacacacataccagaatgtgaaccccataaggatagggagtttcatttgtgttgttcaccactgtatctgtagcacctagaaaagtgcctggcacatagtaggagctcaattaatatgcacaggatctatgtacattatatagaggaactcagttaatactgaaagcatggacaaatatgtagaaagtatcttttaaaaaatgtcatcccacattatttaaatacaagtaatgtttaaatcataacatctaaaagatcataataaaaatcactaatacgtcatttgtatttttgacccaagattgcccaaagggaaatatttttaaaaagaaagagagaatatgcaatgtgtatgatgaatgaataaacaaaaaaaaatgaactagaacttaaaacatatataaaacaaagaactcttccaaagcagtatattagtagattataaagttgtgtatatacataataagaaaatttaattggcttcagaaaggtcttgaaatgaatattgagatatttgagatttggatcatcagggggcacagcctgtgttgtatgcatagtgattcaaggaataaaaatgagaagtsaattcatttattcaataaatattgtaagcacatctgttgtctgaatgtttgttccccctaaaattcatatgttgaaacctgatccccaatgtgatggtattaagaggtggggcctttgggaggtgactagatcatgagggcagagctcccatgaatgggattagtgtccttatgaaagaggcctacaggagcttgtttgcccctttcactatgtgaggacagggctagaaggcatcgtctgtaaagaatgagcccttattagacactgaatctgccagcaccttgatcttggacttcctagcttctagaactgtgagaaataagtttgttgtttataaactatccagtctgtggttattttgttatagcagcccaaatggactaagacaggcacttagtgtcttcatggatgaggtggtggtacagcttgaccatccccaatctacaaatctaagatccaaaatgctgcaaaatccaaaagtatttgagcactggcatgatgccactagtggaaaattccatacctgacctcatgtgacaagtcacagtcaaaatgcagtcaaaactgttttcatgcacaatattatttaaaatattgtataaaattgccttcaggctatgagtataaggtgtatatgaaacataaatgaatttcatgtttaaacttgggtcctatccccaggatacctcattatgtatatgaaaatattccaaaatccagaaaaatctaacacttctgctctgaaacattttagataaggaatactcaacctgtatttgaaccaaggcttcaagtatgggtagaatttttatcaccacagatagagagtgtgggaggagattaaggtgaatgaaattaatatttctcaattatcttttctttttcccctaataggagctgtatttgatgaaagtactagaaaaatactggttgtacaagatcgaaataaagtaagctgcttctgttttataaattgcttcctaaatgtttatttctttctagagaagaataaaatatagaaattttaatatgcctaaggggttatagaaaggtattttaaaaatcatttctaagcagttatggatcaccttagatattwatttaaaccaaactacttatacagaccttgaaaatttccaggtaacactcagtgttamtatctattactttatggctaaaggaaaattataaatgactgtatttaattgggaagacaagtctgctttaatatattaccaagatattcttccattcattcagcattcaatgagtttctactctgtgccaggtgctgagaatataaaaagcagtaagacgatataccttatgccctgcagcttactatttatttggaaagacagtcatacaatagatgacagcaattaactttgcctgaagaagtccccaaagacttctcaaaggaggtgaaatttaaactaggtcttgaagaatgagtaggagctttccaggtgcagaagaaaaaaaataaaaaacaaactgataaaattcgaattgcttrtacaaaggcacagagctcagaaagggactgacatagtttagaaataatggtaaaaagttcagtgtggcccagaatatggacagtggtaagatatttgacttgagagctagattggaaacaatgtgaagaggattggataccaagataaggagtctaggtgactagaagcaacaaatatttcccagagaagtaccgtgattagggatcagatgttttcatgctcaggagtcagaagtaaaagtgaaagagaataatgattttgatactttctgagacttcagcaaatattagtggacatagtcaaacatttttccccaccacatatgttcttaaagtttaaattaatgtttgtaatgatagctgaaagcagtgtcacayatttcttggaaatgctatctaaaactattcttatggctccaagtaactttgaagttttcattaaggcaggatctctgattcaaattaagctttttgtcctcaacagaaatttatagaacacctaaagtagtattgtacctagccctcaataagttttatatttgaattgggacatatatatgtaacggttatgaccagagagtaggaggcattattgagtggtaaaagtagggcctagtcatgagaaccaggcagatgagtttagacttgacatggaaacagtaactattaaaagattttgattgtgatgacaaaatgatgaagatgatatatggacaaaattaatctaataacaatatgcaaattagcctgacaacagtatgcccaatgagagggagctgatatgaacaaaatggacttgggagccagactgaccagagttccaatccctttgmcacttctactttgtaaagttggcttcaacccagagtggatattataactctctccaatatagcagatagatgatatgcccgaaatactgtatgtacaagtaacataaattgattaatttcttttgttatgtttaaaacaaaactatactttggtatgtagcagttacttctaaagagataccataaaagggttttactgtcttctaagtatatccctttaattatctctcttttcatttaaagaagaagtagatcaccagaatttatttaatctttcctgggctcatgtgaatgatgttaatgagacaaaacggaatcagcagacccgggtccctaggatttggccatgccattaactgtctttctgactctggggacctaagtttccccatttataaaatttaggagttagactcaatggtcaaacaaaatattgtaatacttaattctatgtatcttccatgtacatagcataaatacttatacaatatatggataaaatgtgatctaagccactttggtagtatggaaagaaaagggtaaaccatgaaggttttttaaatagcacactgggtttcagaagtgattttgtcaaataaaatttcattatrgactttaacagaggctgaaagacagccagataacatgattgtgccactccaagcagtccttcagggttggttaatctaccaaataagaatctagccatgttattattcatgtcataaaacacagaaattcatagaaaacaaacttgggtatgttaatgttaaaaactgcattggaatctggaaaaaaaggagctttcctggcagatatagctgaattgtcttactccaaacctagacagctttatgttttttgagtagattttttgtttctttataaaacctgcaaagacaagtgacttaacaggttcagcttacagaaatcaaactcccagagcaatctgtacttgaaatatgtaattgaaaaggaaagaattgagttgggctatatttttaaaacagggtaatagtgaaaactrtgtttaataaatttgcctgaattccaggtaaaccactaaaacttttatggttctctgttaatcatggttgcacttaatgcgtctctagttttattcatcttagtttcaaataagtgaaagtgttttctgaaatgtttcttagtgtttttcaacatagtcagaaaacaaagggagatccagacctaatgacaaaacaaataaataggcrtcatcccattgtaggggaaaactcaatccacagtggcactgtttgcatcattctttggaataactgagttcatcctgtaatgtttacttacaaagattcaagtggagagttttccctttttccactctgagtttcttttgtatggcctttacagtcatttgaaggtcatacctttaggcttggtgactgttgagtaattaaccctagataggttcatgaatggtttatttggtggctcttagaacctgtagtcatctctaaagagaattaaaaaccttaataaagtggtagtaccagcctgtagtgcacagaaggctctgttctggcctttagcctcctaagaagtcatagccaaacatttgctaatacttattcctctgttatagcacacattcctgatcctagtttatgaggttttcggggtaaaaaaaaaattttaattctatcatgttttgctctgtcagtagaaataaaaccagataatcaaataatttgtgatgacataaaatacttgcatgaaataatttccatgaaatgtttctcatttaataatcatacttattattatctccattattttaggactgagatttagagaggttacaataacttattcaacattatgcaactagttaataggcagaatcagaagcctatagggtaatcttttcactaaacctagactaaaaaaacaacataggcaggaatggtggtgcgcacctatggtcccagctacttgggaggctgtggtggaaggattatttgagcctggaaggtcaaggctacagtgagccatgatcaagccactgcactccagcctggatgacagagtaagaccctgtctcaagaaaaaaaaaaaagctgggatggcggggagatgattaatttaaggagatatagagtaattatcagttcttctcaaaacctaggatgatgatctatttttacagtttttagaagacccaaataaagactgtagactgtaagtaagaaagaaagaagtttttattaaaaatccttttgttttttgctcactgagatggctgaacttttcagagaacacatgattcagcagttggtcctttaaaagttaacaaactttaattgttttcctttactcagagttgtttggattttgagtaagattaagtcagggtaataagagattaatttataaatcagaatgccattttattaattctgttaatggaaaagtcagactctgtaaaacatttttaaaaggtttattttgaaccaatgaatgaccttggtctgggaaatgcatctcaagaggtcctgcaaacgtgtgccagtgggcaattgaattacagttttgtttaataagtttgagggaggcaggagttacaagcagagacataaatcaatatgtggatgrtatacatttatttcgcctgaaaaggcaggatgttttgaagaggcaggatgtttaaagagggggcttactggctataggtagattcacagattctctaatttacaattgattaaggaagtgaagctttgtctaaaaatttagagtcagcagaaagaatgttttaagttaaaataaagaagtctgtcaaccaatattacactgggtcagagtgacctgcagggttgtgtgacttaacccttgtctggcatggctttagatcctgtttataatttggtatcttattgtcacaaagagtccattttgttaccttatgttaacataataatggtcagttgtgactaaactccaaaaaggaaggggtataatgcggtgtgtccaacctccctacacatcatggctggggatttagtttataagatttttttggggtccccttggtcaagagggggtccattcagttgggaggggtttaggattttatttttagttacaattcacagtaggaggaaaggatccaggctttttgttagtagaaatgaattggagagatattcccaaatatgatatatgctgcttccaaaatgtaaaaaagtattgctccaagtgctgtgagtggggatagttgcaaggtgcaccaaatcgcccataccttagagatctacagattactgttaccagaagggggtcctgatccagaccccamgataggattcttggatctcacacaagaaagaatttgggtgaatccgtaaartgaaagcaagttttattaagaaagtaaaggggccgggcgcagtggctcatgcctgtaatccctgcactttgggaggccgaggcgggcagatcacgaggtcaggagatcgagaccaacctggctaacacatgaaaccctgtctctactaaaaatacaaaaaattagccgggcgtggtggtgggcgcctgtagttcccgccactcaggaagctgaggcaggagaatggcatgaacccgggaggtggaggttgcagtgagccaagatcgcgccactgcactccagcctgggtgactgagcgaaactctgtctcagaaaaaaaaaaaaaaaaagaaagtaaagaaataggccaggtgcggtggctggtgcctgtaatctcagcaytttgggaggctgaggcaggtggatcacttgaggccaggagtttgagaccagcctggctaacatggtgaaaccccatctctactttaaaaaaacacaaaaattagcagggcatggtggcgcatgcctgtaatcccagctactcaggaggctgaggcaggagaatcactagaacccaggaggcagacgttgccgaaacctgagatcatgccactgccctccagccagggcgacagagtgagactcgtctcaaaaaaaagaaagaaaagaataaacaatggctactccatatgcagagcagtggcttgggcttctccactaaggatacttagagttatttcttgagtatatgctaaacaagtgttggcttattcatgagttttccaggaaaggggcaggcaattcccggaactgagggttcctccccgttttagaccaaatagggtaacttcctgatattaccatggcatttgtcagctgtcatggtgggagtgtcttttagcatgctaatgcactataattagcatataatgagcagtaaggatgaccagaggtcactttcatccccatcttggttttggtgggttttggctggcttctttactgcaacctgttttatcagcaaggtctttatgacctgtgtcttgtgtggcctcctatctcatcctgtgacttagaatgcctaacctcctggtaatgcagcccagcaggtctcagccttattttacctagcctctttacaagatggggtcactctgatttaaacacctctgacaactatacttctaaacacttaataggggcatctcctatcctctagcacctagatgtcttactaggacatctagaatacgtgacacttcctactttccaggtccagtcagcatgctggcatcaatagagttgggtagtgataagccctggcatatagtaacatagcagctactaagattcttacatatggaaaggaatgaggtacagatggaaacagaagtattgagtcgtttggtagccatggcactttaaaagtacgtaataataattatatagctttggagatggctagcttttgttaacttgtttagatgccttggcaaaataaaaatgacaagctcaagtcagcctgtcaattcaaggcacaatatgaataccccaagacctccatggcaccatttawagagacccctatattctccagccacaaaggcaatattgaaaatcaggcctagatccaactgtaagaatatcagagctgcaaaggagactgaatagagtttgacaagtgtcctatgtcaaagccaatcccctaacaggaaaagagtggggatcctgcgaccctgagtgaatggacataagaattttgaatttcaaattctcttgaaccctctgagccagtagaagcagcacccttcttctggctacagaaaacagcctccccttgcctgagggctctgcaaaagatagagtatttaataatattaggacagtgtacttaaaatcagaaatagtctggaatattcaggatggcaaccagaactgatgacctcttaggagtcatcagtgcacaaggaatcagatgcacaagaaatccttgtgcatctttactgactagcctgcagtcttagcctccaaatatttgttaaaggatttgaagaaactgtggaagccaggaaaccatttgtcatagatgtgttaggcactkagtgacttatcagagaatamctgaatgagagatgacctctcgaagtcctagttctgtctgtgactcatgggtgrgaatatgggcatagcactcctaaaatttcctatgtggaaaagaccacttttatgttggcagaggtaaagtataacagcacatagaggggtaagcaaataatgggactgtctctgtgtaacatgtatacacacagacatacatatgaatgatcatcctcattcgcattcaaataacaaaagatccaaatgtaaaaagaacctactgagtaaaatatgctatgatctaaaaccctggaagatgcaactttaatgttatagtgtgacaaaactactgagaaaatcaacttaatgtaagacattaagaaacttgattttattaataataccatttagcatatagtgaatgtttaacctgtgcttcacactatcatattgaggggtgaagccagctggacttcccagatcgagtggggacttggagaacttttctgcctaactagaagattctaaacgcgccaatcagcactctgtaaaatggaccaatcactgctctgtaaaatggaccaatcagcaggacatgggcagggacaaataaggraataaaagctggccacttcagccagcagtggcaacccgctggggtccccttccatgctgtggaaactttgttctttggctcttcatagtaaatcttgctgctgctcgctctttgggtctgtgccacctttaagagctgttaacactcaccacgaaggtccgcggcttcattcttgaagtcagtgagaccaagaacccactggaaggaaccaactccagacacactatgtgctgtatattaattacctactttaatcatcatagcaacctgtcctcatttcacagactgggaaagtcaaccaaaaaggttaagtcataaagtargtgaggaagaggcgaggcacggtggctcacgcctgtaatcccagcactttgggaggccgaggcaggcagatcacgaggtcaagagttcaagaccagcctggccaacatgataaaaccccttctctacaaaaatacaaaaattagctgggcatggtggtatgcrcctgtaatccaagctacttggaaggctgaggcaggagaatcgcttgaacctgggagacaggttgcagtgagccaagatcatgccattgcactccagcctagctgacagagcaagactctgtctaaaaaaaaaaaaattatagaaagtaggtggggaagaaaacttttcatctaccaacttagaactgggtggaggggatgttgctacaaattaattgacaacagatagattaacaggagaaaagtttaagagtactctataaggaatgccttggccaggggtaagggtttatatactgtatagtatatcatcttaataaaaggggatacaggggtataggacttctagtgaaaacatgcaggcatagtagcttctgacaaagtttygttatgcaatttctcatctaggtgctaatggtcagtctccttcctggctgaaagcttccccaaccccctcaatcccccactcctactcaggggattaatggcagcttcattctcagaaagctttgcctttagtcagataagggaagctcacaaatgcttctttctgcatctgctgtatcttaaatatcttcagtttagagtcatcattatgccattctggtgggttgtgggtcccttcatgtgggaccatgcacagttaaaactcaaacctcttgctsttcagctggtgctggtttatctggacccagatctctgagaatgaggcatcagcttgctggtgtctcttgggaaggggatgcaaaatgaagcttcttttacaaatgttaggaaaacttcaaactggattctgctgatactatgggaaggaaatgctgctgctagagtgaagcagccttgaagcagtgatactcacaggaaccacgagcacacagaaggcccacattaaggagctagtcccttcctcctccagccttgcagtctaatggtggagcataaaagggartcagctggcaaagcagaaactggttagcagaatcccagctccagcatcactaagcaagtacagaagggcagattcggagctgagagacaataacagcatcaacttattaaaaatgcaaattctcaggccccaccccagatctgtagaatctgaagctctagaggataaagcccagcaattctgtgtttacaagccctccaggtgattctgatgtaaagtttgagaaccactaaactagcacattgagcttcctggctctgctgattttcaaacctgccaataattggtcctttaagaccaagaaagtgatgcttttcagaatctagtcatgttcmccctacacttttaggcagttggtactggtagaagctaaagaagttcaaattatataagaaagtttatttgtggattaagtaggaatgacactcctaagtagggttttgatttttttaagttataaacagagatccatcaaagagagcaaaaaaatatgaaaattaagaattaacatatagttcaatgttgtaataaaaataagaggaataatttaatttctgtaaatgtttggtgttaggtgatatttcaatataactgatagctattaatgatatgtaatttatatttaatrtttaataaattagatgtagattatatatacttatttacttattataaacaactaattggcattcttttcagatatccaagccagttgctctcctttctktatgtacctcactctccccaggcattaatgtcaagtgttttttgcagaggaaaatttaaccctcaacacgagcatatgcacaaattcaaacacatatctaaayygacattcacatgtcctttctctttccctacacacatattccagtccttcatccctaccccaatattttaggtaataaaggacctaacagtgacttaaacccataaactgggtrttcaagagttaagggtagggacccattaattcattcactgaatattactgagttcttatacatactctgctgtatacactgttctaagcactaggtacacatcagtgaacaaagtaaagtttctgcatagggagcttacattcaaatgcataagatacaaataataaaacgaatgaatattatataaggtgragatgtgttattaagaaaaatacatggtgcactaagcactaggtatacatcagtgaacagatgtatagtttccacatatggagttaagcaaagtttctacatatggagcttacattcaaatgtgtaagatacaaataataaaatgaataaatgttatgtaaggtggagataagtgttattaagaaaaacacatggtgccaagataaaaagaatgactgggtttgccatgtacattatgttcggtatgccchatatacattaacttctttatgcttgccatatacattaacttctgtatgcccaacacctaacaagcaataaatttctattgaatgaatgaacaaacttatgagacactctgtggtagcttctgtctcattggtaacagtgataatattgtatctaatgagatttatctaaatacagtaggtctgaattataaaaggcgataggattattaaagactagaacaatgaaaaataaaagataaccaaatttctggcatctgaccaagttggagtaaagacagaacaagagggtcacatatatatgagaaccaaagggaaaaggctagcaggtctgtgcccttgctctgagttctggagatatggctgaaagaaattagtagtcttttaagggttgtgtttatacaaacttctggttaggatttcagtagccatgcctagggaaggtcttaaaatgaatcctctgcttaggaaagcagatgtctgtggaacggggaaaacagaaaaagaatcagaaaatgaatcattcctttcacccattctagaaaccctcaaataaacgagtttatcttcaggataagttttcaaagaaatagtggttttaaacttgaacatgctttaacagagaaagtatcttacattctgttaatatctctaaaaaatgcatcagaaaatttaccctttcttagtagccaaaatgattatttcttgggctagcaatttctaacagtggggaaggaaggattgcagagtgataaatgagaccacccttacatcatccacactgtcttctgttttccatttactgctacacacacacaaagaacatcagacttgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttactataccttttgtagtatgtgaaaatcagatatgcttaaaggaactagacctcaccaactcaaagcagggaggggtcatatatgtgaatgttgagtagcacccaacaaagcagctaagcacaagagcattttagaatacttgtttcacaagagagtggaaagttccttttttgagattaggaaaaaaaaggatcatggaattttacacttgaggcatagagatatcatcttcttttataggaagggagaacaaagatgaaaacataatctcataggctacattttcaaaaccaatcctcagtaatttttttgccataaaacaatatactggaaagaaagaataataaaagatcactagctaagaaataaattccatgccaatcagaacattctagatggggaaatcacaagcaacagatagatacaaagacatttggcactaaactgtagtccacattcgtgagccctggaaaagtgtaagtctaagacacagaatctaattggatttacatagaatgttccaattaggtcccaggaagagattaaaaggtatatgaaaaagcagtggacagtcactaaggattagtgagaaaatatcaaatcgacttttacaatttcttaaaagatggttagaaccagcctgcctggattttaacactgagtttatcacatactagatgtgtgaccccagtcaagtgtttcatcacctctaaagtgggaacaaattatagcctctcatgggagtattgtgaagtttaaatgtgcataattcttatacaaatatttagcatagcataggagattggtcagggtggtgggaaaaattgtagaaagatgcaaacctycttggaaggctggaaggtttacaaaagcttcggaaaaggatttccgaaggaaaaaaaggaagtttaaatgtgcataattcttatacaaatatttagcatagtgtaggagattggtcagggtggtggcaaaaattgtagaaagatgcaaaccttcttggaaggctggaaggtttacaaaagcttcggaaaaggatttggatgaaggcagccagattctcttacctggtgcctgaaagcttagtttaggtaacatggggatgtaaagaacctgatctaggtaagttaaccgttggcgcacaggactaatctctctggggcagtggtggtgggggccggggggggggtggcgggggtgcatgaccatgttaattacccacaactgtgttgactcaaggcctttgtcattaaatctgtactgagtaaatgcccgcagcactggcttgtcagggccgtggctactgcaactctttctatgagtggcccagtccccagcctgctctttcattggatatctgtgatctgtgcctgagtgcattttttcatccgtcattcagtcagagactgtgggtcagacctggcatagcgtctggggtctcactctgttgcccaggctggagtgcggtggcacaataactcactgcagccttgaactccaaggctcaagtgatcttcccatctcagtctcccaaagtgctgggattacagatgtgaggcactgtgcccagcattagtattttaatgttgttgttatattgccaaacacagctaatgggaattgtttgatataaagaaaaaaaagtgggaagacatgctcatctcactactgatcatatctaggacattaactagatttttcacaaaccacatagcttaggactgtctactgcttaagactatactcaggctcaaacttttttaggggagaagtaagcattttaaaaacctaagtggtgccataaaatgtcacaaaatacttaccagcataaacatatacctaatatttccatataaaaggtttatgaaatagtcaaaatcaaatttgtgtgagctgttttcaatccttatgtctagcattttcccccttctaataagttcatctccagatttaattaacaatctctaatcatttatggtcaaagatttttaaagttgacttttattgtttttaggaaacattggtctgctccattataacttttcttttgttagaaacagaacttgcaggctggttatggtagctcacacctgtaaccccagcactttgggaagcccaggtgggaggatagcctgaacctcaggagttcaagaccagcctgggcaacacggtgaaatctcatctctaaaaaaaaaaaaaaaattaggtgtggtggtgcacacctgtagtcccaactattcaggaggctgaggtgggaggatcacctgagcccaggcaggtcaagactgcagtgagctctgatggtgccactgcactccaggctggccagcagaatgagaccctgtctcaaaaagtaaatggaatttatggtggtaaagttcaacatcttgtcaagacaaagactgcatagtttctggagaaataaaccttctgggaatatttccaaatggaatctagaagacagtgcattgatatagaggtatatttacagatatatttctacattaataaagtaaagcataatatcctttataaattaatgtcaagcctagcccagacactgaaagcctgaattctgtacccacataatcaacagtctatggaaactctgggaaccatgccactggtctccaacctagcatagttgagaaatgacacattcttttaagaagcattcatccaggaaatgagtgtgtcacaaagcaaaccagtaaaaggaccataacttattttatgaatgaagaatatagggtactagccaaaggtacagctcccttatgagtatgttataatttctcattcttttcttttatcacgtgatggatagatagaactctaacaggaagaaaagtaatcatgtcagccataagaatattgtccatgtcatctcataattgtttttaatccattttwctatatttatccctattccaagatcagatctttccacctgcccctccccaacaaaaaaaaagaaaaaagaattcatagacaagaagacacaaagaaatgggagacaagaaaacacaaactaatcaattttattcatactactcatgaaaagcaattacatttttacataaaatcattaacacatacaatagaaataataagagtaatacatctgattagaaatacaatataggaaatagattttaaaatagcatattttagtgatgaaatttatattttctacttatttatagcagcatctgtaagattcttctatctgttcatagttaactagcagcaaaatattttaaattacagaaattcagtagatgtttccctccaatgtttcattcatacagaatgtatcacgttaaccaaacaaaaccacttatatttcctgaagagaaaaggtgggaaaagatttcatcagttaccagctcccccaaaaaaagaagaaacgagggagaaaggatggaagctagaaaaattttgcatgcaattactaaaaaatatattctcaaccactttgaccaattataggtggattttgtgaaatctacatatgtgtgtgttagtgraagttatgttaactttattttctgactttatactgcagttgaaaaatatgtggaagtttccaggaggcctgtcagagcctgaagaagatattggtgtgtatcttttatatttttaattggcttaaaaatgttgaggaaattaatgtgtttactttcttgctttatagctaagaataaaaatttaaattttccaatttgttccgactgagtctgaacatttcagaaattacctcagagctgatataattagcagcataatttctaatattacagtttattccattagtagaaataatatcattaggaacataccacctattcttctgtttatgactgcttctggattaatctgtctgaaaakgagaagctttggatatacatcagtaaagtttagcattaaaggttattttggatacgactaatattgttgttggaattaaactatgagaaaacaaattcctgaccattccatcacagaggatgaatagtagcctttaaatgaactttgaaataaatataataaagtcagttataaagcagtgattatataattcttcactttatgaaaattgtwtctactatttatttttaatagtcaggwagtcaaaacatagtaaaatgtcatataagaaagtctcaactgagaaataatcccctaacacaacttactgagctcagtatttaagacaaggaaatataaaataagctaagaattatttatgtcactgatttacaggaaatcgaaaaatagaaaccaaattttcctacctattccttaaactattgsatcaaattcartgtgtatcatgacaaatcaatgtatttgtttgataccaatattatttctccatgaccttttccttaatatgcatgtcccctattctatttagccaacaatgatattaaggcaattttctaaattgtctttaaatattttatttaaaaatgtccatgtacttaaagcttgatttttaaaacttttacacaaatcaaaataccatacatacattatatagccaactcgtaacaatccatcagaaaatggattgcattaagatatatctctagccaatcttggtttcaggtacttattgaccttttgcttagtttatgcttattcttctgttgatataaaagatgattttgtagtggtgtgaatgctgaaagagaaggccatttgttctacagcctaattctctcacactatccactggtgccacgtgagagcagagcatgtgagctaattaagcttatgttttgcagccttacccaatctatattgggcaaaaagcagtctgcaggtttgcaaggcttcctctctcctgcatcttgccttttcaaatraattgatttttttcatgtgaactcttatgggtcctctgaatttcagctgtacttacttgtagatgtaattgaagaaaaacacatttccaagccaaatatatataatttcaggcctaagtatactccagaatccttcttaaagtccagatgattaaaaattcactacctttttttctttaaaaaaaaaaaaagtgcttgtggttgtcacaacaactcacctacccagagatcatatatgcctcagtcatgtggaattaagaagaaaaaaactgccgttggcattagccatacttcctaagcttagtrtaaattaaagctttgcctgaaaattcataaaaccctgaaagcagctrgaaatgaaaactgacagtagaggtctgaaagactatgtctatatgaaggcatttctaactcaacataaaacaaaagatattcttaatgatgaagctgaatcatctaagaattactgaaattatttaaactctgtatttaggaaaacatgcaatgtactttaggaatactgccatcacaaacagttaaacatttatattggctcaaacagtaaaccctagttaactgggaaacacatttgtttgaactccttcattctttcataatactaggtaaatgaagaattgttatccatagtgttttttaaatatcaagagggtcatatagaaaatagaatgcaatcctcaaggcttttgtataaaataataccctaagagtataaaggtatccacaagattaaaattgacaaactgccttcttaaaaaatcgtattaccactggcaggaagagtatctgctgcattagccagmgaactataaagcagctgagccttatcagagatcatcagtgcactagagtcagagggaaacaccaggaaaacccacattctgcagattatttcccattatattttatttcaatctaattctattattaaatataacaaaatagaaataacaaatataaactccatttcattattgtcctgtaactaaacaaaacaatacaacatatttaaacatatctcttcatcagcaaaaataaaaacaaaacctcttagtttttcctatgttcttcaaacctataaaacagcaaatgttatttcagtttggcttacagtatattaaaataataaaaaatacaacagaataaagcacactatcttgattaaaaatttcaattcatcttgaaatccttggggaagaaatatccatcttgaggtggaagggtctcccgcatactctggagacaaaagcacttatttgcccattcaattttcagtcagttagtgattcaagttaaactgatcaaaactactcaggcagtgctgattttcagtcagctgctatggtgactgctgagcagggcagatttgctcactacccccatccrgtgcttccacgacatagaaacagcatagatcatgagctacatgccgaacttttgattagtggtactaagagctaaataggatccccataatttattttcaaacataaagaataaaaatggacatttaaacaagttaggagatgttatatcaaatttaagactagtgctactatctttaataataaatttaataacaaacatgtatttccccataattatttttcaaagcataatgaataaaaatggacatttaaacatgttaggggatattttatacaatttaagactagtgctaccatcttaaataataaatttaataacaaatgtattgcacatcagagtaaaaattacttttcttattaaggaaaatttctctttttttgagacaaagtctcactctgttgcctaggctggactgcagtggcacgattatggctcactgcaaccttgacctctcagcctcaagtgatcaaccctcccacctcagcctcccaagtatctgagaccacatgtacacgccaccatgcctggctattttttgtgtttttttgtagagacggggtttcaccaggttggtcttgaactcctgggctcaagcgatcctcctgctttggcctcccaaagtgcagggaatataggcatgagccactgcacccggcctagatttttcttttatgctttcagttgtttctaaccatgtttaacctatgggcaaatctcaattgtaagggaagtcagcatgtaattgaaaaatggcagacraatgccttatgttttaaaacattatactctttctatgcatctttccatagctattagagggaaaaaacaagagcatatccaggggatgggtaagacagtctatggtaagacagtctacagtcacagcacatgggaattgagacatgtttctgtgacttcctcttctttgcatgtttttcaccagtagaattactgcaagggcaaatatcatttactatttgacaaacaagaaaaatagaggcaaaacgagtattggaacaaaaatctttgtctgtgacaattgtgaagctttccagcaaagtggtagaggaaggcagctttttaaagggcttctcctaaatactttgggagacaatgacagaacatcacaaaattagagaaagcccagttagagggaccatctggatgtgtagaaaaagcagccacaaaaatatgttaatggcaataaaaatcctgccacayaaatttgcatttaattgaaaaatcaaccttataaaatgtgaaaacctttgttgaattataaaattatttatattccaagtttcttgaaaactgatcaaacacctccagcatttcggtgttgaagaaatgaatctaagttctttggaatcttatctcaagaaacaaaggaactgcagccatgcaaaatgttttaacttttcaatctatatttttaccttttgggaaaaagagcagcaagaagttaaaaagagctgaccccaaaaatgtacaggtagataagcctccaagtagcagccaaagaaatattcagcatttcaaaagcttcttgaatttacagtggtaagaaaatattttgggatttcttgatatccacaaggcaaagaatttgtattgaaaactttactttgttagggtaatgttttgagcctttacataatgctactttaactgaaaatctttgatgatacagtttctaaaagtgtaattattattgatttgtacatctctttttttamgtaggagacacagcggttcgagaagtttttgaagagactggtataaaatcagaattcaggtccgtcctgagtattcrgcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaagatcattgctctaggtaagcttcactgggtaacagcagatgcaatataaaagggagaatatacattttacaacttttgttatttttctttactgggacaatggttacatattttactactggataaaaaattgtttgaccaattayccaaactgagctatacacatttattttcttttactctcattaacaaatttctaaaatatacttcttctttcatgtgaaatgagattagatgtggccattaaaatcagctcttagcagacattggaagaaaaagtatagctttctgcccaggtcctgttttggatccaagtttatactgcccagttcgtttcagtgccacataccaactggtgtatttccttgaccggtaagtattgtagttattagattccaatcgttcaaaaaagaaacactcatccgtaacacatttctgaaaaataaaggaagaattacctgttattattatcattattattattacacttttcatattaaatatttatgatagtataatgcctattctgctcaaccagcagcagtgatgttgggttcagcagggcaatcaaactaacaagattcaatgggccaaaatgtgacacagactagttctgaagaaggatgcaggccaggaacacagcatgtcagcaggacagcatcaagtatgtctcttcagtaggagttcagagacaattctccagctccaaaacagacaggtcaggtgttaaacacaaggagggacatacccagtaagaagaaatatgctatgggaagcccaaagctatagctyccagcagtatttatgatccatccacactcttcccagtcccaaggtaggttaccaatcagggatcatttttacttttatcagaagcagcagtagaaggctaacccattgtaatctttccatacagaaggaggtttgttaatactttactcacaagaagagttaattccccaaattttaacaaaaagttttaagtggctaatgttttttaaggsataataatgaatagtttattgtacagaaaatagctattggtatataatgccaaaaataatattggaacattatattacatatgattaacaatctccaaacactgttagacaatgaggaataagtaagtatcatactgatttctggcagtctctttcaggagggagggactttgccttttaatttcaattcaactatttatcaaaaaaaaaaaaaaaaggatagctggctttcaaaaagacctggaaataatactccaagtaatggaatttaatagctaccacattatttaagataaatgttcggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaawacaaamcaaaacaaaamaaaaaaaaaaaaaagataaattgttcaaaaagcaacttcacagggtagcactgaagatacttactgacctcaaaggggaaaaattaatttattcacttcaaaaggaaaaatcatttttacattataattatgtgtatatatatcaatcgaatgataaacttatatagaaaacacatgtaaattttatctaaacacataaatataagatgtatacagagacataaatatatggttttgtattaataccacattccagtttatttctatatactcatatctaggaaacttcaggtttggaaaagcccacattaaaaagacttgaaccttttcccagattccttggttctaagataaggcaaacaatggcacaaactgtgacaaaaacataaattaattggcaaaacaaggaaaagagctggcataataacaaaaatgtaaagtaaagcctgggaaagaactaaaagtgactaatgtgtctcagccatctaaagtaagggtgtggtattagatcctgtaatcttctagagataagaattttactggatatttacttggttttaatattttgaccactgttaaatggatttttaaaaactgaaatacaaacttaactaatttgcctattatgtaatacgttactcataaagaaactcaattcttcatgatgcaaataaatcacagccttacagagaagcacacattgacaggacccagctatatgaaacacaggactgtcttgtgctgttcataaagattcaaatgtgataagagtgaaacacctaaacttagagtaatatagaccaatatattccaaatccaatacttttactctacctctagtgaaatttagtacccctctcgtgtgaactgaagttaacctgttactttattctgtcatcttcattgccactgataaaagaaaaaaaaatcttcccttttctctattccaggtttatgatcaagaatagaagcagaagggaaacaaagagtgaaaggaaaattcatagtaaccataaagacaacatgaaaggtcaccatggaacttcatagactgattccccagaggtaaatttaaacaacagcatttagtcatatgttcatttgttggtgttctatcagcttcccggatgccccaccttgctagctggcactccctacaatgcttggcatactagaatactaactattccwataacatttgccttttcagccagttcctaatatttcagagaaaagaaacagtaccagggactaagtggatacatgatagaacccacagcttattaattaattaatttacttatttatttattacaaaagttatttctacttttgaaaaaaaacagtggagggaaggaaacttacatctgtgctgaatgttcagcaatgcaaatttactaaacaactgttttgctcttgaaaacaaactgcatttttttaaaaaaatgagtagtagsgccaaaatttagtggtcaagaaaagtagatgtctaacagagcaacatatgtacaattttcaattgtctccattctgagtttccaagtcatcttcagtgactgtgatctcagtgtgcctattaaaaactggtgcattataattttattaatctttataaacatatttaaagaactgttttcctattatcagtgtttgctcaccatttcaaacttcggataaaaaggggtcttcagaggaatgccaccacaaagaaagtggcttctaagggcttataacaacttgtaccttgtttccaaagccttattttatataggcctaagagctgagaaatcccttaatgcatgattattgactgcttttatgcatatactttaaaagtcacaacaatattttaacattattatrctcattaacaaatgaggaatttaaaactcagtgcttttggtaacatttcagattttggataccttttgcccttacatctacttgatacctttatatcaaattaagtttttgtttatgtgttgcttttttaaaattgaagaataatttagaggtacaggaagcatagagtttaaataatacacttactcattcaatctatatatttttttcttctaggcatctaagacacatcaatgaacaaaactgaacaagatccctgcctttatgccactcaaattctagctgggggagacacacaataagcaataagcttaagtgaataaattatattctatgttagaatataagaaaacttagaaaaatgtaaacctgaacagggtaagagggactaggaatggtgagtggtagaagctaggtgcaatattaaatagcatggtcacagtaggctccattgagaaagtgacatttgagcaaatgcttgaaggagatgaaggcgttaaccatccagctatcagagaagagcattcccatcagaggaaaagccagtgcaaaagccttacaacaggatcatatccagagtatttgaggggtagcaagtaggccaatgtgggaagagtagcaggaaatgagatcagagaggtaatgggatgggagagggggcagacctcatagttttgtaggctattgtaaatatttggctcttattctaagaaaatggagagccactggagtcttttcagcagaaaaataacatgatctgacatctttttgtaggattattctcgctgccaagactacagagggccaaaagcagacttagaccagttaaagggttattcagtaatacaggcagagagaatgaaggttcagatcatggaggtagcagtagaaatggtaaggaggtgtctgcttttgtacatattttgaaggtagacttaatagggtttcctgatggattggttgcatggtatgagaaaaacaggggaattaagaatggcactgaagtttctgttctagaatgataaacttgccatcaaatgcggtggggagggctatgagtaggaacagattttataggaaaaggttaataattcagttttgtatgtgttgagtttgagaggaatatcagacatccaaatggagacagtatttactgagcacctactatgcaacagacacatcatttaacttttttccttcttttttgctaatgctaataaccacagaactagaaattaaaaagtactaatttatttggaataccaggaagtgtgttatatacaataatgccagtaaacaagtattctcaggtctaaaaggtataaacctaaaaaagaaatgtagatgtatacatatgatagtgatataaatttgtcatgtgttagtgatggggcaacacctcaaggttcccctggaggctgtccacataaaccagcttagtttatggttctataagaggggcccaataaccatttattgatattgataatgatgctaataatgttaaagatagtgctggcagtttgaccccttgtagggagtatttgaatagagcagactctaatgtagcatgaaaaagcataatcaacacttttaaaagtttgttttttgtctggatagttaatttactttggaatttcaaaaagaaaataaggttatgtgagatatttctacataatgaaaaactgatcccaggagatggcgggagccatgtttctcactgttgggggtggcaggttacacacaagcaagtgggggggactgctaaaatattcatttgttattgatggattaaggttggagatatcagtatgaatgaactcatatttagatgtttttgttttgttttgttttgttttgagacagagtctccctctgtcacccaggctggagtgcagtggcacgatctaggctcactgcaacctctgcctcccaggttgaagtgattctcctgcctcagcctcctgagtagctgggattacaggtgcgcaccaccacacctggctaatttttgtatttttagtaaagacagggtttcaccatgttggtcaggctggtctcgaactcctgacgtcgtggtccacccgcctcagcctcccaaagtgctgggattacagatgtgagccaccatgctctgcctcatattaatattgatacagatggccaaatatagaaatatttataaatacatgtatatacccaggctagtatgtaccaccatttcttgctctgtcagcttaagcttagagggcttagaagcaaagatacttcagtagcaacaagcacacccagcattccagtttgtggtttctaataccattctctaataaaagaaaccaatgctctttggagaaatggctcattctagggtggagtagggaatatacaaaatgagcctggagcatcttgtaggccaaaaagtaatgaagtacttaaaataaatgcattgttgagagtatgtcaaagaggagggcacaggagccaactgaaagagctcccaatggccaaagctggaactatttgagcaacaaaataaataatgtagtattggattgtaactcaaagtataaaataaatatctgtgaatacatattgatataaatgattgaataaataaataaatggaggaaaatgaacacatttcccaggcaaaagaatgacgatttatgtagatactacccctcaaggaggtggagcataaccatcatctccatctcttaagtgtggactatgcatggtgacttccttccaaacagtatagtatggaaaggaagtgaaagagtaactttacagtggacacaaatactacctcagccaggtaagcaaggattatatcatgagttatcagtcatgaagataacatataccattatatgccacaaaaatggtactttacttctatagtcttcctctcaaacactcaaatccctatctggccatgaaaaaaacatcaggycaggtgcaatggctcacacttgtcatcccagcactttgggaggccaaggcaggaggattcttgagcccaggagttcgagaccaatttgggcartatagtgagacctcatytctactaaaaataaaaacaaattagtagagtatggtggcatgcatctgtagtcccacctacttgggaggccaaggtaggaggatcgcttgagcccaagaattcaagattgtggtgatctatgatcacaccactgccctccagcctgggagacagagcaagaacctgtctcaaaaaaaaaaaaaaaaaaaaaaaggaaaaaaaaaatcaagcaagttgaaggacattctaaaaaatacctcaacagtactcctcaaactatcaaagtaatcaaaaataaggaaagtctaagaaactgtcacagtctggaggaaactaaggagacatgatgactaaatatggtatcctggaacagaaaaagaatattaggaaaaactaaggaaacatgaataaagtatggactttagctaataataacatatcagtatgggttcattagttgcgacaggtgcaccaaactaatgtaggatgttaataaaagtgaaactcagtgtggagtatatagatactctctgtgtcatctttataacttttctgtaagtctaataccattgtaaaactaaaatatattttttacaaaactgactctagggctacaagtaccatcacaaaaaaggatttctcaagtcactagatacagcaactctagctataatgtgaaaaataaaagcacctcatgcattcctgtgctctactatgcccaaatacagatgattcatatatacatatcactttatttcaccagactgtcaacagcatgtttgtgaagatattcatctattctgtctactgctgtatcagtgcttggcacatagtaagtcatcaataagtatttgctaaattaatgaacaaatggaactttttcagatagcttacaataaaaatataattcaatgacatttacaaaatctaaataagaactagagaactaggactggggaaaatccagactaggaactgaaatacagaatatggtttaactttatgaactatttactccctaaggaaaatagaccagatgacctttccaagagttgactatccaaacttgacatctgtgaggatctctgaagggccaagaaacctagcttctaatatcgccttgatccctaactaacttgtattttcaatcaagtcctttaacttctctaggcatcactttcctcctctgtaaaataagaagattggattagatggtctttagaatccctcctaatctctagtagccttagtacacaataaggaaagaaataagcacatgagccaagttctcctcacatccccccagcacctcctctcaccccaactctcccttccttatgcatcggcctcacaatactagtccactcctaattttagatttgaaccttatgaccatttccccatgctctgtttactgggttgtttattcttttacagtacattgatttttcagttttggcttttgagggagcttgctcaataggaatccaaaagtgcttttgcttataccacttctgagaattaaaaacagacatgatgtaagtatcaatgttgactatttcagaaaaaaaagaaacatccaaatagtgaaaagttaaaattaaatttgatctttttattttttatttttttgagatggaatctcactgtgtcgcctaggctggagtgcagtggcgtgatcttgattcactgcaatgtccacctcccgggtccaagcaattctcctgcctcagcctcccaagttggctgtgattacaggtgtgcatcaccatgcccggctaatttttgtatttttagtagagatggggtttcgccatgttggccaggcttgtctcaaactcctgacctcaagtgatccacctgccttggcctcccaaagtgctgggattacaggcatgagccattgtgccaggcctaaatttgatcttaaacctgtaatacctataggttgcataacagttttaagattgagttataaaagaacagtaattctcattatgcaataacctttgtattttttctagtattttatctcttaaaaaggatatatattcctcttcaattactgtatttttctcacaaatttcatcagtatagattgtcagtctggataattgggctctcagatatctattttctctactttactttattatagatttcatgtcattgtgaaggcccctcaattaagaaagttattctgtaggtaaaatgtattttacttttacagaaattacatgtatatcctcagagaatatacattttttcatatttcactattgtggatcaatgcaaattacattctaatactgagatattaatattttgttcagggtatatcatgatctatatagcattatatagaaaacaatgtgcaactttctggcagatgaagatcagtaaagttttttcataccaatgctaacattgaggtcatttggtgatttaaacttaaaactacaattaacttcactttatgcaattttcttaaaaatctgtaattttgtgaacacttaaatcatcaattctaatatttgttctggacttctgttgctcatagcaacaaaatttatcctgctatggaatggagtaagaagtctgttgtgcattaaagaactatttaacttcagcttccaaatacaggctttggcaattaaatatagttattttttgaattttcctatttcctagcttcaaaaggaaaggaaagacccttaagaaatgttttcaaacaacacaaaatcggtaacctgaaaacatgcataccattaatatgtgaaggtgttggggaaaaaacggtatacaaattagtcttttttcatactctaattggtaatcaacctaacataactcttaaaaaccaaaatgttttttgtatccacagcactcttctttctgggaggaaactagactgctttagaaatcactgcaggaatcacagagtaaaatggagaagaacccagggatgtgtcataacacagtagtctgaaaaagggccaggtagaagagtgggaaggactatgcctctggcaagtgcaagttcataaattccagtttcttcaagttacgaggcacatctgcatccccagatgatggctactggtcagaacactgaactcataccaaaagctgctgttgttgacagtttaatgtctatggatctgactcggagagaaatgtgccacttactgaatcaccaacaccatatctttggtgttgaggtggggcacgcttactttttcatctgaagattgacacagcccaccaagaacatttgaaagagacaggattgctgctgaaaaggcatgacatcaagccacacaaattggatggtaagactagagattaacttgtgaacaggtcgtatgacgagagctgaaacgtacaactggatcttggtcatgccattcctcaaaggagactaagaaatc

SEQ ID NO: 13348 - DNA, 68123 bp, Homo sapiens
aagtaatacaactcagaagatagttcaggaaccggtggggttcctgcaggccccgagggcagagcctctgagggccaaagagcagcgcactgaaccacagaggattattctcaggcctgaaacatgatggaatttggcctgctctgttttgaacttgcttggaacaartgacccttgtccacttatgtattccttccattttctccatttcagaatgaaactgtttatactatgccattgtatttggggagaggtaactggttttctagtttcatagatgaggaatcaggataaatcataccaagaaactcacatacacctgatttagatgatttagatgatgatatttaggactttttgactcgatggtatttaaatgagatttggaatttagagttaatgccggaataggttcagaaatttgaaatgggttaagaatgggatggatgtattctgcgtgtggaaaagacatgaattttgggggaccagagaatggactataatgtgttgaattgctccccaaaaaggtatgttcaagtcttcatccttcatacctgtgagtgtgagcttatttgaaaatagggtctttgcagatgtaatcaagttaagatgaggtcacattggattacggtaaaccctaaatccaatgactggtgtcctcacaagaagagggcacacagagattcacaggagacccacagggaaagaaggtcatgagaagagggaagcagagactggtgtgatgcggctatgagccaagaaataccaggtgtttctggaagccacccagtggaagtcaggaagaggcaagaaagtattcttccctatggcattgggatgcagcaggtgcctgctgacaccttaatttcagacctttagcctctagaacttcaagaaaatacatttctgttgttttaagccacccagyttgtggtaatttgttatgacagcccaggaaactaatgcaaacctcttatggctctatagraccacgtgattgtacggcactaagataatctaaccctttatatttctgttatcccagttgtctcaattatttgtgtctttatagggctgcctcttatttttgccctaattttctctcccttcccccctttatgtcttayatctgccccgccrtgcttttcttaaaactttgctytgccycttctatcttcttttcttcctttttcctaatactttttttctcaacagggtctccttccattcctgatgaaaatctattttctggttctcttgcctatacagggtccatcctctggatgggaggaatatactccccatcccactgaagtcagctgtggtcaaatgacttatgttgatcaaygaaatgtaggcagaaatgataagtattacacccaggcagaagcttcacaaaccaagcatattttgctgtatctgtttttcttctgccaagggaattggtccatcagcctacacwccagartaaagacatgtaacagaattgcagcagacctgcaataaacatgtggcaagaatagaaaaaaaaaaaaatttgttgttgtaagcatctgatatttggggattacttgttactacagcataacatgttcttcttacactccctaacattcaatgagaaaactttccagatctcccttttatctaatgaataaagatcaaactgcttagcctgatatctaaaatccactagtcctggctgggcaccgtggctcatgcctgtaatcccagcactttgggaggccgaggcagatcacctgaggtcaggagttcaagaccagcctggcmaacatggtgaaaaaatacaaaaattagccaggcgtrgtggcacacgcctgtaatcccagctacttgggaggttaaggcaggagaatcgctggaacccaggaggcagaggttacagtgagctgagattgggccactgcaatccagcctgggygacagagtgagactctgtctcaaaaaataaaaaataaaaaacyaaaataaaataaaatccactagttctaacctatctttctccttttagtttcacttattttgcttcaaaatttattactaaaaaaagcaattaattacattacacrttatatttaattttgttaaatatataatgtgtagtgtaattttgtgaaatataatgtgtaatgtataaacataatgtgtaatgtgtaacataataatgtccacattatatttaacaaaatattgtgcacattttgctactgtcttactcgttaattgctctctgtgtatcaagcctatgcctaagaccaaatagagggtatgactaaacccatagaagggctggcctgggaaaggatagctagaataaactcctgcaagagtccatagtcagaaaatgacccagagggttaataatcaacacagaactgagagatctgaaattgttcagtgtcaarttatgatggtactgtgggggtaaggaaattccacaggcagagatcagtaactcacctggaattgagacctcaagatgggtcccagaagcaagacccacagagaactaaatatcaaggtattaaaaacataatgggraaaatattttaartgtaatggggtgttatgggctgaattatttcccccaaaattcataaattgaagttctaacccccattgtcactatatttagagacagagcctttaaagaggtaaattaaggttaaatgaagacrtaaacgtgaggatctaatccaacagcactggcgtccttataaaaagaggcagagacaccagaagcacacatgcccaggggaaggactgtgtgaggacacagtgagaaagtgaccatccacaagccaaggagagaggcctcaggagaaaccaaccctgctggcaccttgatcttggacttccagcctccagaactgtgagaaaattaatttctgctgtttaagccacccaatttgtggtattttgttacgccagccctaggaaactaatacattgggtaakcaaggaagagggtcctacaggccaggtcctggccaagatcaatacagacactctgtttttactgcagctttttcactcacccatacttacctccttcctggggatctccactattccaaaagaatcatgtgacctctgacaatgagcatatgccttggctcttggactcctaataggcaggaagtacatctttsatatcacccagaggcttctgctatatgtaacaaagaagttctgtatatgcttgaggattaattaacgtgttctctgctccttcccctgaattaggggtttttaacttcatagaatccctgagaggatactgggggggagtttcatagatgggttttaggagcttgcccacagctttcatcagattctcaaagggaatcctaacactaaaaggtaaaaaaaaagaaaaaagaaaatccatttagatgttgacatctgtcacatcctctgaccaacagtgatgttacgtctcttcatgtacagtaacataatgagctttttgtcaaacttttcccaacccatttggacgtctcatacgttttctaaatctgatctgtagctccatctgttaggtgagtattgttgcaggtttattgtcctcagctttctgaactrtaaactattttagaaaaaacagcttcagaaacaatgagagtttgaatatctgccaacaaacatttccaaataaagctatactgaaaagacaccgcraattcaaaggccttttttwattcatttttctctcttgttttgttrtaagaaatacagtgggtctttattaatcatgttataaattaataagacctccaataaaactgaaagtcaaaattctcaagctttgccacctacaaatgaactctctaggtacctatttacatttaagagatgaatccagtttgctttaagtaattactttttaggttaacacagttacataagaaaatttattttgatcattttacagaagcataaaatatcaattttagcagaaaaaaattttagtcgggtaactttttttccagagccctttaaatgaaatttttttctacattctcgttgaattgatgtaatcacctgaaatcaatcttacaaagccatcttaaataaatggggaatgctagttagaataagaagttaatattttgggtccccaagaaaattttctttagccaactaaggccaaatcctcagaaatgcttttcttacttattctgcaatagtctcactgctcccaagccccttgggagacttggaaaaatggtctgtgtcttccacacttctcagagcagatgtgcacagaggatgtgcacaccagggagaagcatggtcaaacactgcccacccctttatccttcctccgaggagattgctcaacccctagaccttggctaaggaaaaacatcctattgtctgaggcaaaaagacatcaagtcctttcatgctgtcctgggaaaggcggtttggaacaagttatcctgattctagagacgtgagtgttcccagctgcaccgtgacttgtttttggctcctaggcaaagtgcccagtttcctctgctcccaaatttctccaactgcaaagtagagataatccttgttacctttttcttgcagtgttctgaaaataaatagggcaaataattctaaagtgttttgagagatttggctgagggcatatttgcctagaaatgtaggtgggggtttttggtttattttggttttattttgtttttgtcagtgtttttgcttttggccagacgttggcatgcatttagaaaatctaaattaaattaaattaaattataattattcatctgatgataatggaacatttacaggatgcaaagcactgtgctaggcaccaggagaatgcagaaagggcacatccccttccttcaaggagtttacagctttctcagaagcaggtatgatatatatatgtgtctatatcacataatagagggattatagataagttacacaagtgtggctgtcagccatggtagctgatttggaatcccatcctgtaagttacagttggakaccctagaaaaaacacccttactaagctttggtttcctcttatgtaaatrataatagctaacatttattgagtgtctgctacgtggcaggggtgttctatgcagtttatcatgttaactaacttaaaactcagaacaattgcagagatagatattatcatcatttccatatgtatatccctgtcttatagataaaagcactgatgctttagagaggttatataacttgtcccgggtcatagttaggaagtggtgaagataggatgcaaatccaagctggctggcctcaaattctgccaatccaaccactgtatgacactacccctcaaatgggaacacagtaaaacttaccatgcgtagtgaggatcaactgataataacgcataaaaagctgttarcacagtgtctgacacataataaatgtgtgataaatgtagaagtagcagtagaagagattagacacmtacaaacaaccagaatcccgggccaaaaataagtgcacacctccattctttttatgggaaacctccttcttagataccaaccattataaccatggagttacagtggagagctgtgttgaggggagaactgcaacatttctgaatcagcatacaagtgatctataatataaggagcaatcatttttatatatgtccatttccaaatctcattcaaagaaggttaaggtatctgaagtacccttctattaaaattcagactgtatttgctagaacaatttccaattgagcaacgtaaaaatgcatctgctgccatttctcttcttccctcctttaatccctactccccaatttcctttagaaagaaacaacagcatggagtttcttttcaaggtcttaaaataaaaatctccaaaaaagggatgctgcttataaaacctttcagagttgtttgaaaaagaaaaaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatwtcaactccagtagacttgaatrtgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtaagttgtaataaatttacggcattatctaattgcatttgttaagctgatttgcgtgatctgataaagctgtcaaatatttttgcctaaataatacaaagccatttatttaccaaaaaaagttttgtgtgatttacagaaaagatacttcatagagaattttaccatttgtattcatgttttcttgtttcctgcgaaattaaatagcaagtactaataaatgatggtgattttagtgaagaccaagaatagaaatgtggaactgttgatcgcctcagtagcattcagatcttagtgaagcctgaatcctgaaatgtgttttgtagaagtactttattacatatatgaaataaactataaagaaggtagtttttaaaaaaaawttcaaatcaaataatttgtatgttttccatgtttaaattatctaaagttattcaatctcctgagcctaacagcaatgtagaaacggaactttttgcttttccaaaaggtaggaaaatttctccttttatactatattcttgtttgattatttttaagttattgcgattattttccctttcttggttcccttttacagctttayaactaattattttttgcctcctactatcatttgttaagatgctcacacatagacctaaaatttctctaattcttgatratgtcttatttacaaaagcaaaaatgggagargagaattaaagagctaaagagattatggtaactcatattataatgtactaccatttctggctctcttttctaaaataaagcaataatgtaggttgtgcttattcatccttcccaggtattaaaggtcactctgcaagagaaaaaaagaaaagaaaggaaaagaaaagaaaaaaaaacatgcttttaactgcagatcaatactgttgaaacagtacaccaagaggtactgcagaaagagtatctcttttgcactgcctttaatctgcaaagaggttaaatatgtcaccttggcattgtatctgagctctcctctggcccagggcctaagcacattgaatagaaatgttcactcagtccaagtcagcagaaatcttttttttttttattctcccctttctcgtagacaccagcttttttcagttcacagcttactcagtcaaacctgatggttgtgactattgttaactatgattttttttttattcaaaacaccctctttggaaagatttaagttaatatttctgttcatttaataagatctagcaaagcagagcagtttatttcatctacttatcrtccaatcaactagtgccactttccacattttggagaagaatattcacatgttatttatgaaccttgcctttttctttcagagaatttttcacacagccattgagcaattagagtgctggcatttccttcctaggtcttttgagatttaatccccartagctyctcatggcacagattcacatatcaactaagtaaaaataatagtgatgacagaaataaaatgaatagtgatgcatctggacaacttgaaaacattatttatttcatttcctcttgactgttctttttactcagttgacttaaacactgctattttacttaagtttagcaccatatccagaactggttgggaacatttttctaccgagaagggcataaacaacttgttagaagatctgaagtgcacatagtcctcacttatccctctagaatgatcttcagtggmgaaggagacccccataaataaatccagtagaacttcccagtaggcctggcttcctgagagatgtccaaccaggccagggtctgtttcttacggggctcacagggcatcttctgccaaaggctgagttagcgatgatagcattacctagggctagcctggcttttgtcttagtcatcaaaagatggatagaactttgaaaaacagagtgcatggtcttgatgattgttccaaaggtggggaggcaatctaataaagtgaataaggccatgacctgtggtttatatctgaccatatggaccctgtttatataagaccgtggtttatatccaagctttaccacaaaatagctctgtgactttgggcaaacaacttcatctctttgtgcctcagtctcttcattcatggaaatgggattataaaatcagtagctacctcagagatttgttgtaagaaktaagtgaagaaaagagccatgtttggtacattaaagcaatcaatcaatcgtagataatatgaaagtactggactaactatatgtccctattgaaactccgtagaacgggaactgactctagatattttctcagggtttcttccttgtacttatacgttttgctctataataaaatatgaatgccaggtgtatgcctctgaggcagcacagcagagtggacagagcatgggcttcagagtccaatgcatctgggctagaatcctgactctgcttcttacaatcagtgtaagctttggcagttacttcccacctgcatgactcagtttactcatctgtttagcaaaatggggataataatacacacaratgaggtcgttgtaggaatgaaatgtgatgtttattaaatgccaagtatagcacctggcagagaagtaaacacataggaaagttgactggttgctcataaggaatctcgtatatcagtgaggcctctgttacatacttgcaatgatttctctggtagtaacaatggagatcaagaaggaaatattctttgaattgccttttttatccaaagaaatgtaaaagtaaatcggacactactattttcccctggtggggggcctcaacacgaggtatttattactatgagacttcactgctgcatcagttagtagcttcttaatggccragtcaaaggaaaccaaagaaagtgttctatgycagcttgccattacacagagtgagaagaaatgctgctttgctgtcaattctgttttattggcccacttggacaagagggaaagcccccaacatttcttctttcttatctcttctaaaggcaagaatagggcttttgacttgctccaggggatattttttcctctctaactgaaattcaagtgaaagagtcttttttttgtttttttgtctttgtttggtgtttttgtaaacctctcccctatgttcctagcattgaaatgtaagctgctttttctggctgcatgtagcaggagcaggctgtcgtcatagcaatgaaagggtgtagagagactcctgcttcatgacctgctctgggaaataactcttagtctgctttaaaatccttctttagaaatgaagtctccagtcctggcttgtttccttcctattacacaaccaacttatgtacacccattgcagtagctaaatgtttcctttaaagatttagtgaataggtattttaaaaatcaacaagagagctgctaaaacagtggctagtttactgtggcatacaggggaaaaacaactgggaaggcaaagaaagagaaatagaaatggcctcacatgatacacatactgcagcaaaccctgcaataawtccatttttcaagttcccactgcttcctcccatcttcacgatgtgctatggtgtagtggttatagaggggaattctggggcagactgcctggacttgaatcctggcactcataccttctagttgttttaatctaatccattctgtgcctctgtcttctcatctgtgaaatagatataataacagtcataaaattgtcatgggaattgaatgagattgagcatgtaaggcatttattacagtatctaacccatggtaaaggttggctgctaagctcaggagcctcagtttcccccacttgtgaaatgtggataacagctaattcataagatcattgtattttttttttttttgagacagagtcttgctctattgcccaggctagagtgcagtgacatgacctcagctcactgcaacctccaccwcctgagttcaagtgattcttgtgcctcagcctcctgagtagctgggactacaggcatgtactaccatgcctggctgatttttgttgttttagtagagatggggttttgtcatgttggccaggctggtctcaaactccaggcctcaagtgatctgcttgcctcaggctcccaaggtgctgggattacaggtgtgagccaccatgccaagatgatcattgtatgattaactaaaataatgaatgtacatgctcaataagtagtagttattacaattctttttcatggttttgttattgaaacagcaaggttccagtctaggtcctgctgctcacttcrtagaaagccaatcactgagacaacaagtattgccaatgaagaaggctttaatcaggtgctgcagctgaggagatgggagcacagtctcaaatccatctcactaactgactwaaactaggggtttacatagcaagggaaaaatgtaacaatgtgtaagaaaataagaactaggtaggggtaaggaaacaatcatggtgaataagcggtcaggcatctgctgcagtgatctggtgagtttccattcttttmtacttttttagaagcctgaaggtcctgtcctgaggaaggaacttagataaaacaaatataagtttcacactttaagaccaggagggtcaayttctatgtttttcaaaaagatctgtctgtgggactattgggtaagtttcagtttgatctaactctgacatgaatggcctttttgaacttagaattcccagtgagtcaaatataatgaatagaggcctcagaattatcattgcataaatgtgaaccatttgatttctacagggggaaaaaaaagaattgtgactttttacatttataaagactcatctcatcttgattaacaccagggtaaaaagtattaaaacatcttatctttcattaactttttattacgttyctgtttcagttcctccagtgttttctaggtcatgcaattatgaaaataagttagcatktttatcttacatctcaaacaactaatgtattcagtgttctatcccatgcaaaattccagaaatgcagcaaggagcaaaactagagaggggctgagctcttgtggtgcttactatgtagttatgaaaatggtcattaatcaaaccatcacaataatgaaaactgcataggaccaaacataaggtgcccccaaatacaatgccatcttcatctttctagtgagaacatcctcaaccaaagtgtttrgccaaacagcatgtacaaatgggtaatatattgtaatgtacacttgggatatttaatctatggttcacatacatatttaatatgttaytttaatttaaatattttatacttattaacatgactttttcctttctcacatwtcatgaaacaattttgttaaaactcttcatacgcatctttaacaccaatgtgtatgttcactggatccacgctgtaattatctaatacagagcacatcatcaatccttctgcaagttgctaaacwtctgctgatgctgcaaatttaatccccaggcattagtcctcactcgtggtcatgttctccacactttcattactgactagattgtttttccagtgctttttaaagggcgtatttaaaaaccacttgaaactgtaagtgtggctttctaaaactatgtgattccaacttgcaataatgaagtcatacctcaggaataatgactaaacctgctttaaatatctttatctattttttcatccattttgtcaaggtgaccttcctaagaataaaaataagcattgcttgagattttttttttttttgagacagagtctcattctgtcacccaggctggagtgcagtggtgtgaccttgggtcccygcaacctctacctcctgggctggagcaattcttctgcctcagcctcctgagtggctaggattacaggtgtgcaccaccacgcctggctaattttttgtacttttagtagagacagggttttgccatgttggctaggctggtcttgaactcctgacctcaggtgatcacccacctcggcctcccagagtgctgggattacaggcatgagccactgtgcccagctcttgagatgatttctaattgtttttttgaatagtactttgctgctcaaaatgaagaaactttggaagcacttgaatataagtcaaatccctcttttttacggcaggatttggtggcgtgagaaaaaacacattttatttgaacacatgccatatataatgatacactgaaataagtgttatgaaggcaaaacacctttgttccaagagagtatataaggatcctgacctccactcaggatcaataatggctttccttgatctgaagtctgaatagaggttaactctgtgtgtgtgcgtgtgtgtgtgtgtgtgtgtgtgtgtgtgtgtgtgtgtgtktttggtggtggtggctgggaggagcgggtgctggagagagaattctgacagcgtgaacacttgtgcaaagaccctggagcaagagggatcgtggcctatttgaggcactgagaggcagccagctcccgagagcaagggcagagcagtggaagatgtaaatctccataatactcccttccctgagcactaaatgtatgtgccctttgcttgattcaggtttaatgtatacttttaacgtctggatggatttctggttagtctcaaagccccaacaggcatgaccatgtctatccctagctcagactcttatggtggtaggttcaattaggaaggatgatgggcagttgaaggtcagatgcccagaaaagtcttaagtcattgactctgagtatatcatatacactcacagggctgggacaccttgatgtcagatggtgactcagcagagarctcaaaatagaagaacgtctttttcacccttcagatgactttagggccaaaccatagagctctccccagagactcattaatactttaaaagctctaaagcatcagtgttaacactggatcaggtaacagcacgtatatgttagccaaaatatgactaagagatttgctctctgataacaaggcctttgactattatgtaaaaacaaggtgaacaggaacgttctgagtctgtttataaagtacctataataattgttttgtttactacatttcccagaaaggaaatttttccatagttgtaataattgctaaaaatagcagtctacaggcttcctctgatataaacaaattcaacmgaagatacctggccttatttggatgcatggatgtacatactccaggaaatgataggccaagagtaataagaaaaagaaagtaacaagacaaacctctcctttttctagtacacatggtatgtctttcttagttcattaaactttagacaaagtgataaacagatcaagttgtcatcatctgccttgaaacccaaaaatattgaaacaagttccctaggcccagaagggaaggaagaggacttgtaaattttgctgaggctgccacagaaggagctaaccactggagggttcagactggagggttcagaaaccaggggaatgctaggcaacacaaggaaaattcaattagaaagacttgaagcaataactaccagcactaaaatttccagggagtcactgatgtggccaatatgaaagaggaatcctgttcctcctttcagaggtatggatgactgcgtttacagtctggttcagtgttcagacagcttattaatgcttaagagaaaaggaaagagaaggaagatagaaagaagaagtacarcaaggcaagaagtgcccaggggagcaggtrtgctaagttgatttaagtggcatggcaatatacagaacttcaaaaataaaatttatcttttaaaatttaaatgtaaattaatgttctaaaaaactataggaactgaaaataaatcaaatacaaatatctacttcgacctaatcttactgtaatttaagtttctaggaaatatcatagaaactgaagtggaaccaattacagaaaaagaatgcaaaataaaccatagtaccgaaaataaaaacatattctggtcgtttgtgtaggttccctaataaatctagacggagaatgatgtttttgtgttttagtgtatgccaaactttagacaccctcctcttttctaggagatacaaatttcaggagcgatatttagctattacacacatagcttttcatcagagatgggggtagctgacacacacatggcccattctgcccatacctttcaggtcaatctctgatggcttggctgggctgtttccagctagcagaaaggatattcaggccccttttccttgcttttccagggacagagcttgtagagtgctgagaaatccaattacaacttcctttcatggtgaaatccaattacaacctctcccatggtgaaagccaatctttttgatacaaaaggaaactaaacaaaagggcttcaggcaggggatatgcttgtgctctgccttctcactttgacaattatgcaggaaggttgcaatgaccttggcttgccttgcttaggaacaaaagtcataatcttctaccccctactcccacaaaaaggaaaaacgttttcatatctgattccaggagtttggggagtttcctcaaggatccattagtcaggcaaagcaaattttgagccaacacttgctccctcccacacacttttttttccggcaagatgacttttcttattgaacttggaatgccatgttaaatgataaataaattagtgaattatttaggccaatatcctcccataatctgttcccaacaacttttttttttttttttttttgagacagtgtctggctctgtcacccaggctagagtacagtgtgcagtggtgcaatctcggctcactgcaacctccgcctacccagctcaagtgattctcctgcctcagcctcctgagtagctgggactacaggcacctgtcaccacgcctggctagtttttgtatttttagtagagatgaggtttcaccatgttggctgggctggtcttgaacttctggcctcaagtgatccacccacctcggcctcccaaagtgctgggattacaggtgtgagccaccgtgcctggcctgtttctgmtacctttgtgatatccaatgctgtgtgtcaccctttcagccaacctgtttgcttgaggttagtgagactgtagtactgcttggagaggggtcatcctaaattcctaaaacctggttgagataaacggaaacagttctcaaaacagtaatttatgaaaatagatattttatgagtacttgacacaagtctataattgctgagatatttaawaataaaattactaaccacattctattcaaatctctgtcacttctgtataatcactgtactccactgaatgtgtgtaaaatatgtatttgcagcttatagggaaaaaaatttgcaaattttcagaagaatcatgcagtcaactaataggttcttagttgaagattagtggagtggggagtggtaaatggttatctttttcaaaacttaggacaaactttacactaggttcaaataaaagtgctatggctacagagttaatgaacccaccattcaaagtggccctaaatagctctgaaagcaaagcatttttacattatttgattcaacttgagttatctaattgcctatataatatgatagggacccaggccggacacaatggctcatgcctgtaatcccagcactttgggaggctgagtcaggtggatcacttgaggtcaggagttcaagaccagcctgaccaacatggtgaaaacccgtctctactaaaaaatataaaaattagccgggcgtggttgtgtgcacctgtagtctcagctactcaggaggttgaggcagaagaattgcttgaacccgggaggcggaggttgcagtgagtagagatcagccactgtactccagcctgggcaacagagcaagactccatctcagaaaaaaaaaaaaagatagggacttgataggaaggtaccctgagatatacaaaaatcagaagaattgacctttatgataggtaaataaaacatgtaaatggtttcatgacgtgtttggtcagatgttcatgctgtcttagctcattgaaatcatttttaactttcaagccattagttcagtggatcctcccaaccttttactggggaccaaacaattttgagctaattctctctaaatcaagggagtattctattagaattcagaagaaacaaagcacaaattcttaaccctaagtgtcttctttttctctctttttcttccctgttgcccaactccagctaatgggttttaaggactttataatgagaagcaggttaatgtcttactagaaaaacttttcaataatttcctaaaatatggggagaagaaaatagtggaagatgttgttataaaatagaaaaatgcttggttgaaaccttggtactcgtattgatcttgtactcattagctttttggataggcataggcggggaagagaagtatcagcatcatctcactgataaaaacagctgatgtcttcttacagtctgaaaatgaagccattgatttcaaaagcaaawgttttattatactttgaaaaacactctggattggatcattcaaggttatgatagcctgagataactgcagcctcaaactcccgggctcaagcaatcctcctgcctcagcctcctcagtagctgggactacaggcacgagccattaagcctggcttgaggggaaaagtcttttcccatggtgggaggagaagaattaacagctgtggaccagctgtgggcaagctgtgtcttttccttgcttgaaggcatcttyttaacattttctctctgaaggcataaataagcttccaggttttcaccctattttcaaagaacttttcaaactctagccttaaaatccattagggtttattacatctgcttctttcagaaaaggtagataataagtaactttgcaccactgaggtaagcaagcaattgtttcccatattaaatgtgttggccctcaccaaggtacatgagaagcttggaccacgatctgaatcctaaagggacttctgctgggactgaatgyttgcattagcggttcacacaagaactaaatgctcatcaaagtacaccattattccccagaaggtcccaacaccatgagaatgaggctacttggaactgttctttggtattatttgttgtttttcttaatcctagaagagaactaccccccaataaataattcttggtccattcacagagctgaaagcacttgaaattcctctcccaactagcagaatttaacaactgacttactctgttagcaaaagagaggcaatttccactgaatccaaaggagttttatattatactggtagagtttaactaataagggaaattcaaataagagcagtcagaggataaagccaagaactaggcattcaggggaaagaaattacaggggtagtagagaaacaaataaattaaggggtagggagaagagttaaaggcagaaaaagcagaggattaatctatctgataattacaggggctaggytttaaaaggtgtattgtcttactattaacaacatgaagccaatcattcagatattattaagttactgcaacgtcacaaacgccaggactttaggtgagccatcctaagagcrgattcagggtttgtgaagccaagagtttatacatatgtttggaaccttcttttttaaaaatataaaagtcaaaatcaagtctagaactttgtatggaggctgcacaagtgaggggccttgaaactcaagcttcctagttttatggcacgtctatcctggccatattcaaatgtctataccccaaatacarcaaaaagttcagaaaaataaataaatgtaaatatgagaaaatcctgtgttctctttctctgagaaagagaaaatagtarcacagataccatagtaggacttgagcaaagaaaaataaatatggccaaaataatgtctcccactataacacaggrcagggtgtggtggaccctttctgaaggattggcaaatgtctgagaaaaagaacaggcaactgyctccctggatggatccatcccatctggagctctggaatgagacacagtgagattagtgagtggtatgataagacgagaaactctgaaaggcatgattaagakatggtgaaaggtggctattgcacaagcttgggtaagataagcctgggggatcctctaaatataattaaagtaatccctcaattacacattatagaaaaggaggaatggactagtttcgcctgagcaagaaagaaacagacctttaagaatgtgtctgaaaagctgtgcctccgggtgccctttggcttccatgctcctcactgctgaccaggcacagtggcaaagagggatggtcaggaagcactcactgaatggtagttctgtgaaatggaggtgagggtcacagatgggagtgcatggrtggtacacaggtgaagtgcttagcataraacctggcatatagtaaaatctcaggaatgtatatgccattgaatgagctactattaaatggtctaagacaaaaatgtactttttcaataaaataatactttgatgaccataagtgattctactactgagtacatttgagtgctattccacacaaaaatatttaatgtttacagccaattatatatggcttcttacaaactcagtgactcaaagcaactgtttcataatgtctcgagatctggtgggtcagaaatttgggcaggcctctcagaggtactcagctaggagatgagctgatctggagtggcacaggatctctccactcacgtgtcctgcgcatttgcaaggacagatgcaaagctgggattggtagaactgttgaagtgtcttctgtgacatgacagactcagaaaatggctcaaggctcccaaaatgagttttccaggagattaggtaaaagttccaaggtttcttatgacctagcctcagaagtcccagaacatcatttctatctcaatcaattggccaagtaagtcactaaacccagtccagattcaagggaaggagaattagactccacctctcaacaggagaaatagcaaagaatttatagcaatctctaccataatatttatacctattaaataagaaatgtaagaaattgtctcaaggcagttactcatgtgagttagaatagagttgacatttgtgggtgtttggctcttaatgggagacctatttctgccatgacaaatgattcctctggagatttgttttaatggtacatgggtcagccaatagaaaaactctaggcatttgaaattcaaatgctggatgttctctataaaatgctgtctagctatcatcttttaaaattccagctgaggttctcctgaaagtttggtaatgagacaccctgttcctaacagaaggaaagggctctccttccagttacctatcatccctcatctttaacctctctaaatccataaaaagaaacagtgggatgaagaaaagaaagaaataacctaaggactctagtaaagggatgaattaaagtgtctgaattattcattattggggttattaagccattttctgccttatgcatgtttcaaagatatgataacatctttcatttcatttttacagttggtgaaattaccaaataactataggatcacatttgaatctcaaaacaactccagaagatagataagaaaatgtaatattacctttcctgttttgtagatgaagaaaccagtgacttgatcaaagtctcttagctggtaaaaggcagttcaagtctggaacttagatcttccagttccgtaccaactgtcctttaaactatgcagctgcctttgaataagctcacgcatttgagcaaaataatattgatttagtttcacatcaatactgcatatttaagtctttgagaataataattctgtgaattccaaaatttgtctcatttttgcatttttcatctggagttttattttctatttctgcaaaaataatctgtattttgtagtcagtgcacaccaaactcgaatgtctcaaaataaatgactttttactcatccaagaataaatggtattcatcatacttagcaaggacatcatggttttgatttttcaaagtactttgcaagcatcagctaattaagcctccctgagtcttcagtatgacagttgttttcaaaatatctctcatttcccaggaaagttctccattctgtcttatttatacaatcagcacatttgctcagttcttaaaataagaagctaaaggccatgaaattatttttgatcaatatgtggcaaatacaattagctcagtgagacaaaaatgyccagtgactagtctaaaggacaacgtggaacayaatggaagaacacaaggcgttttaaagtctagatactggattgtcccacaaggtccttcaaaaataaaacacaggcatcttctttataattgaaacttgaaggggtttcctgcttggatcattctaaatgacatgaccatactctgcgtttaaattttgttttcaattacaggatggaaaaaaactcttaaaaaatagttccatctttggactcagtaaaaatcagggaccattcagtaaatgttggctctcaaaaagcctgcacaagtggccatctgaggttatatgacaatccctagacttgttctatgccttaaaatatcttccatacagctacgccaggattctcagcattcgatagctctttttgggttaagaacaatgtgaacatacctcttacctgagaatagaaatacattaattcaggaataatcttttttcttttttttgagatggagtctcactctattgctggagtgcagtggctcaatcttggctcactgcaacctccacctcctgggttcaagaaattctcctgcctcagcctcccaagtagctgggattacaggctcatgccaccacgcccagctagtttttgtgttttcagtagagacggggtttcaccatgttggacaggctggtctcgaactcctgacctcaagtgatctgcctgcctcagcctcccaaagtggtgggattacaggcatgagccacaatgcccagccctaattcaggaatattcctatttcctcggtatggtttagatgcatgcaaaaaacaaagatttaaaagtatagaatataggataggtgagtttgtgtttaatgagtgaactaaaagtaaatatgttctggaactagctcctgggaagcttgaaatcccctaggggaggaagatacggaaaaggggaggagaaacactaaggttcttttcccttatatcacacttaatacaagacatatgtagttaatacaagatataaatgactctaatgatattactgatgacaggcagcaggcagaacaatgaaaataataatcatttgcatgtgtaaggtacttcagagtttgcaaagagcttcctcacctcaccttgcaaggagctacctttgacatyggaaggaactggtattcccatcctatatatgaagtttggagagagaaagtaatttgttcaaggtagtatttagtacttggcaaagccagggcccaaagccagaacttctggcttctagtctgtagcctgttcactagtctgtttggggagaatattggatactgagtccaaagctcagcgtttctaattcttgcccacctcttaagccttgtacatttggccaaataatttagactcttcaaatttctgtttctttacatttaaaaattctgtccctcctttcttcattgaatcaaatgagacagtatataagaaaacactttataaactgtgaaatgctaaataaatacaaggaatgtataactaaatccatcttaataagttaatattccttggaaccctgcctcaagacatccttacagttaaactttcctcccttttgtgttaaagaataaagagttcctccttctctttggagttaaacctttcacatgtgctttaatagtagaccagtaaatatgtatccaggatttaccaagatggtattgtctcacttaatcttcatactattttatagacaatgagctgaagcccccaaaagctacacaatttgcttatttacgcaaattaagtattacagcctatgacatcctgtttcagaacttatgcctttaattgttatgaaatattgtcttgctaatggttttggcaactggtctgttttgccttattttggttttcggttgctgtaaaacagtatgctctcacattaaatggcttaaaatcacatccytgtatttgctcataattctccaatctggattgggctccactgcatgattcttctgctgattttgtctggagttaattcatctggcttcagtgagctaggaacacatctggggctgaatcatccaggagggtctgttatcctgcaaggttccagccacatggtctctcatcattcaatagtctgggtcaagcttttgtacagcatggctgatagcttccaccaagaggaaaaactccaatgtgcaaaggtttaccaagtttctgctggcatcatgcttgctaatgtcacattggtcaaagcaaatcacaaggttaaggcccacatcatagggaaatgaagcccagaagttgtggtttactgggggtcatcattgtttaccattatctcctctcttaccctttatcttcaatttttccttatttacctgtcttttcccttcagcacagaagggaaatctggggccgggcatggtggctcatgcctgtaatcccagtacttccagggggctgaggcaggtggatcacctgaggtcaggagtttgagaccagcctgaccaacatggtgaaacccccatctctactaaaaatacaaaaaaattagctgggtttggtggcgcatgcctataatcccagctactcaggaggctgaggcacgagaattgcttgaaccctggaggtggaggttgcagtgagcctagatcacgccactgcactccagcctggaaaacagagtgagactctgtctcaaaaaaaaaaaaaaagagaaagaaagaggaaaggaaaggaaaggaatctgaatgatcacattcaaatacaaatataaatttcctgtaactgcatattccctttaagctaccacgttactctcctttgcacagccaatcatttttagagtggtctacactcactgccctcacttcatcactgcctgttcattctccaatcactgcaggctggcatccaccgacaccacagcaacaaaactgctctccctgagatcctcaataacctctgcacttccagaggcaatggataatttcctgaccttgtttgctttgaactctctgtgacatttaacacttcccttttctcatgtgactcttctttctctcactgtttgtatctttagctcttcccatcctctgatggtgcctaatgatcttcactccccagggttctggctccagctctctgctcaactggttgaataactgctcatgctacagcatgcaagctacatctgtaaccccaaactccatgcttacctccagacctatctacccaagtatctactagatatctctactcaaattcaacaagcccaaaactaatccaccgtctgtcttctaaaaccaaaccttcctcctataatccttcaccttggtaattaataccaccatttactaagttgttcatatgagaaatgtgactcaagacttttccttctcatattcctacaatatctaattcgtcattaagttttatctgttctttttttaattatttcttagaactatccagttgtgttttggtaaatgagcaacccattctctgagagagggagaggtgggtgacacttgatggttttcatggtgtgactgatcctcccaccacaactgattttgatgcaggatattttcttgaccccttcacggaactcgcggcaggggtgccttgtttactcagcccgccctgctcaatcccttgcaggagggagtgcgcaagcgaatgactgcaggaacctgagcgagcgaaggcaggaactggccactttggcaccagcaggagcaaactccatgtgggcccctcaccagcgtccaggtgtgggcaccagccacgccaagccccagagggcgtgtaaccatactcttagctccaccgtccgcagacagcagtgtgttatcagctcagtgagccctttgcctcatcacgtrgggcarctgccttccgccagcaagggcaaagggccagtgcgaccgcctttttggrtacctgcacgtagtgtgtccgagttcttgtccagtgcccaagaggaatgaggtcacacagatgaattgaaggatggcgaatgtggagaattttttttttcagtgacgaaagcggctctcagtggagaggtgagctggaaagggaatgggaagggaagatccctctcctctgaagtcaagccacctctctcctatgtccaggcgcttcttctcgacatcaggctgcttcttccctctgctggctgagttctggggtctttatgggcacaggatggggacggggcaggccgtaggtagttttggaaaaggcaatattcaattggtaaaaagacagtattcagaaakaaccaatcgggagagaatggaagttctcactttgggctgtgggtttcaggcttttcggcttgaaggtgggattttgccagcgacccgcccctgtatgcctacagtttctctgcctcctgttgctatcaattttaagctaccaacatgacgccactgaacagaatcgggaagagacatgcggaacacatattatatagtatttccaccaacagatataatagatgtaaataacctcaaaagagtagataatagtaaaataattatgaagtgatgagtttctactattttctttgcttttaacataattaaattatacatgtatgtaatttaatttttaattgatgactttaacaaccaactcaaaaaagtcttgaaatgtaacaaacagctctcacaaaccagtacaggttggatctatccctcttttctccactcctaagaccacagcccaaatgtaaggctctgaccacctcaccttgatgttacaattgtctctcacaggtcatgctactggtctgtcctccacacagctgtcacacatacaaatctggttatatcatcacccctgtccacacatgtgtgyacacacacagacatacacacatgcgtgcacacacagacacttacaataattctttgggtccctatagctctatggctggaatttttaattccttgtttaatgcactatgacttttacaatatggctatctgcttacttttgagccttatctaccccagcccacttcccctattgacagcctagagacccaaatattaacatcctagagactcgatgcttctgcaacttcacccatgctgctgcctgccaccctctagagtacatctagctgtgtgagaacatccttcatacagctaactactgtttattagttttcaaacctcagatcaagaattaccttctctggaggtcatctctatacagtagttaagaacactgtagttaagaacacagacagacctgatatcaaacagaagtgttaaatatctgctgtgccacttcctagctgtgtaaccctgaacaagttacttaatctttatgcccgagtttccttactagtgaaatgattacaataatgtgcttacctgatagaactgttcagaaggtttaaagaatatgtgtgtgcaaakctcttagaatagtgcctagarcttaagtactttggatgtagtaaagttagctattatcaactacctaatttaaaaatgcctcctatctctctttccattgcattatgtacataatcatcacattacactatatgattttatataaatatattatatatttatagatacattattagtatatacatatatagatacgtgtatataatacatatatagatacatgtatataagtatatagattayatatgtacacatatagtatacatttagccctcaacctgtgggatctgacactatctccaggtgcacatacatagtatatacacatatgtatactatatatatatatatatacttatatacatgtatctatatatgtatatatttatctatatacgtatctacattacatacatatatgtatctatacacacacacacacacacacacacacacacacmcatatgtttcatccacggttcctgtctcataattcccatagacctttttataatgttataatgttggtgcattttaggcctcataagcggacctcagaataacaggatttctctctctctaatcttctatttttttacctgctactttttctccccaaggcaggactctaatcttccyctgcctttacctaccttgtgtgattgtaggtcataagacccccatttcagaaggggttctgccccatattctggaggaaggaatgttgcatggagaggccaagaagaggcccagcacagtgatccatgtctgtaatctcagcacttttggaggccaagatgggacaatcgtttgagcccaggagttcaagaccatcctgggcaacataggaagatcctgtctctacagaaaaaaaaaaaattaattacccaagtgtggtggcaatcacctgtaacctcaactacttgggaggttgaggtgggagcatgcttgggcccaggaggtcaaaatcacgccactgcactccagcctcacagtcagagtgagacccacctcaaaggaaaaaaaaaagaggccaaaaagaatctgaacagatgggccttaccgggtttccccactcagcctttgagtactaaagcataccctttttgtctaaacacatttctatgtggttgtcaatggtgcctatcctttcatgaagtctccataaaaggcccaaggggacgaggtttgaagaaattacaagataactgaacctatggaggttcctagagggtgtgttccggggagggcttggcagctctgtgccccttcccccatacctcaccctttgcatctcttcacttgtatctttttgtaatatcctttattataaaccagtaaatctaagtaggtgtttccctgagttctgtgatgcactctagcaaattaatcgaaccccaagagggagtcatggaagcccaacttgaaaccagtcagccagaagttctggaggcctgatcttgtgactggtatctgggaaagggaagatgtcttgtgagactgagccctcaacctatgggatctgacgctatctccaggtacacagtgtcagaattcatttggaggacactcagctggtgcctgctgcagagttgattgcttgcatgttgatgacaaaaaatctcccacatttggtcacagaagtcttctgtgttgattgtagcgtggtgtgagaccacaggaaaagcagttwgagattttycacacccagaaactcttaagagagaaactatgtgtccytgtgcttaggcagtgtctagtaagtactcaatgaatgaatttaaaaaaaatggatkagtgatgcaagttctggccaactggacattctttccttttgattcattcagctacatttagatttagggaaatgaagggaacttgtgagatcatgtgagatcatgcggacagattaaaagggaaatattttctcaaatttaattagttatgcatgttgctgcaacaaacaaaaagaaatgagccttatgatgcaaaacacgtttgataattcttactccccttttaagttgtaccatttgtaagaaaatagggtagcattccatgtgcctaattccactgttatgtgtgatgaatgtcggaaayactcctggcattaaaaggagcctaaatgtgtggccagaatggactttaatgttccactggacaatttttctgacctcacagcaaaacttaaattacattattttctgagaatctaagttgtttattcaagaatcacaacttaacttatcaggaagatgagagaaaaaagaattaaaatttattgagcatctcctaggtatcaggcatttttaccagtaccatttcttctaactctcacaaaactgaattagatgttttattagtcaaggttctccagagaaacagaacmaayaggagataggtaggtaggtaggtagrtagatagatagatagatagatagatagatagatagatagatgatagatagatagakatatagataatgaggacttagtttacattaatggagccagtcccaagatctgcagtcagcaaattggaaagccaagagagccaattgtatagttcccgttcaagtctgaagacctgagaaccaatgatgttgagttctagtccaagtctgaaggcctaagaattggagggctgatggtgttaagtcccaatccaacagcagaatatcaatgtcccaactcaaacagataggcagagagagagagggaattctcccttcccctgcctttttgttctattcaggtccccagtggattgaattatgcccactcacattgggtagagcaatctgctttattctgtctacsaattcaaatgttaatttcttcagaacacaccctcagagacacacccaggaataatgtctaagtagatatctgggcatcccatggtctagtcaagttgacatataaaattaaccatcacagatgttatccccatttttagatggggaatctgaggcttagagggctaagtaacttgccaaagatcatatagatggcaaatgttgctccagagttcaaatgcatgtctctctaatctgaaagcaccagtctgcttccgctaaaccaatggttctcaatcagggcgattttgccccccatggaacatttggcaatgtctggagacatttttgtttgtccctagctggtgggggatgggggctcgctactgacatctaatgggcagaggacaggaatgctgctaagcatcctacaaggcacaggacagccccccacaacaaagaatcatcaagccaaaatgttaacagtgccaagataaagaaaccctkcactaaaccatactattttgtatttctatagttttcaaaaccagtagaatagtaataacatactgatctaaaatataaggctaggcacagtggctcatccctgtaatcccagtactttaggaggctgaggtaggaggaatgcttgaagccagaagtttgagaccagcctgggcaacatggaaagaccccatctctacaaaaaaaaaaaaaaacaattagctgagcataatagtttgcacctatatccccagctacttgagagtctgaggcaggaggatcacctgagcccaggaactggaggctgcagtgagctatgattgcaattacactccagcctgagcaacagagcaagaccctgtctcaaaaataaaaataaataaataaaataaaatataagtgactatagttccataactctaataaatatttgtggaataaatgaataaataagtaaacattgaatttaaaatgtagaggaaagaaactgcgtttttcaatgattctttacaattagcattcactargaggatagaatgttttaaattatcatcgctaatagagtccacatatttactttaagcatgaattacyatatataaaatattttattttaatacaataaaaatcatggaatatattttagtgggtttagtagtttaaggggaaaagatagcagcaatttaggrttcatacaattaatggaattattttcaattttagaatcctaaaatattagggttagaggatcatctaggtctcactcttcattgttcatcacttgagaaaactgtatctaagaaagggcaagtgactttcccaaggtctcctggcagtcagggacactgctagagccagaatccagctctcctgacagtttaatgcttttcttgttttaaggtgtttttcaatgtattagagttttggggcagcggggggaggttgctccatgtttttacttaaatacatttttctttcatggaaaattgaattcctatgctttttgccttgtttaggccataagatgttttattgaaagaaactttcaatatcaagtaatccaaccaaccttctaagataagccttttccttcaacacaaagaagtgcattttgccaagtacgtaccatcttactccttaaaatgtttggaactttttgtttaaaaactcaaactcaaagtgaaatctcaatttgtcacaatggtggtttttttgtttgttttgggatttttttagtttttgtcccccttccttacacctttgtgtaagaggtaaaatggagaatttgcaaaataactagaaaaaagctggagtgggagccaggaaatctagcttcaatcccagctccccttctacagagctcagtgatctccagcatgtcacactgtaggctttctaggcctgttcttcatctgccacatcctggggttgttgtaaagatcaaataaggtaatatcccatttgtaaatttatttggtaaacccaaagcactatggcaatagaaatgtcaagtatattttatatgccattacccgttctaaataaagtaaacacccattccattgttaatattctaaatttctccttgttatatgtagtcattttcagaaggatcacttagaagaattatacttgagtctccaagtacatgtccttttcattaaaactgggaattgattagtccagactagtaaggttataaatgatttaagtttctccccacacccctgattcaaccctcccacccccaccccaccacacacacacacacacacacacacacacacacacacacacacacacacacaataccaaatcactttctatgtgcagctttactctctattcttccaactgactgttccctggtccaggtggcccaccctggaccacctggatttgaatagtgagataggtaaaaatgtgttcttgttcccaatatgatgaggaagtctatgctatagccctgttttcttcaataaaaacttcatttgctgctagtttgagaggccgaggcaggtggaccagttgaggccaggagttcgagaccagcctgggcaacatggcgaaacccctgtctctactaaaaatacaaaaattagccaggcatggtggcacatgtctgttattccagctacttgggaggctgaggcatgagaatcacttgagcctaggaggcagaggttatagtgaaccaagattgcgccattgcactccagcctgggcaacagagcaagactctgtattaaaaaaaaaaaaargaaaaaaaaaaacttyatttgctgagttagaaccaaagacccacaaagacccacaggaattcctatgtgtcacactaaaaatgatgatgataatgacrgaggaaaatatgaagaaaatatgaaatggaagtcatctgttgtgaaatggagatgaaacatatacatatgttgccactccctgctaaaattccagaataatgataggaaaagaatagtaataatatagactcacagtgactgagataaaagaagaggagacaaagaagacaagtgtcaacacatctttagaagatggaagactgacttagaacagggaaagcttaaacctaagagtctgcagagaaggatgccatagacaaagaaggaagccattcacactgaagaacccatgcaagtttccagaattggaggcaccaggtgatttggaaggcagggtgaggatagaggctgaaatctggagtattggttgaaagcctatcagattaactcttagattcaagatccttcctcctgcctgcacagccaggggacttccatgtttcaacacaaacaggaaaaagcttattctctggctctgcactcagaataaacacaatgtcaggtgggaggtggagccatacagaaacctagggactaagtgaaaaatcagtgtgtgcactgagagaactccagtctcttcaytgatttcacagaatgctagcaaccaggtttatatttgcttctcaaggtaagaggtatgaatttctcctctagagaaaagaaaatctccctgtaatatctgtcaatgacatttggggtgccccatcaagactgtcaggttactgctccttggaagccctccaatgctccatggaactattctttggaagccytccaagccctgtccataaagttctaattggctttctagtgactcactgcraagtattaatggacagccaaatacatcagacattagagaaaagctttcaacaggaaaaacaaagatcaaaacaaactaactggggaaaaaaggaacaagaaggaaacagaaactgcagggtgcagaggaaattttcaaaatatttgattaatatcctcaaggagacaagaacatatgtcacactaataaagaacaggacaatattaaaaagaagccttcgggaaataaaaaattaacagtatataagcatattctcactcatatggaagcgaaaaagttgatctcatagaagtaagaagtagaacagaggatacttgaggctgggaagggtraggagaagaaaggaatagggagctatttgttaaaggacrtaaaactatagctaataggaagaataagttctagtgctctataccactgtaggatattatatatttcaaatagctagaaagaagacactgttcccaatacaaagaaataataactgtttgaggtgatggatatgcaaattatccttatctgatcactatacattatatgtagtgaagcatcactatgtaccccatgaatatgtataattgttatttgtcaatttaaaaataaaattaaaaaagaaaatgaagtataarggtataattttttttaatcaataaracaggccaggcacagtggctcatccctgtaatcctagcactttagggggctgaggcrggcagatcactttgagctcaggagtttgataccagcctgggtatcatggcgaaaccctatctcyaggaaaaaaaaaaaaatcaataggagagatgtaaggtaaaagtgagaaagtttcccagaatgatagacacactgttgaagagaagagcaaaaatgattagcaaatcggagaatcaaccccagaattctgatatttaactaatataaattctagaaagaaaagacaaaaaatagaagggcaaaaatcattaaggaactaacacataaaatgctccccagaactgaaatatataaatttccaaattcaaagggmctaatgagttcctaaactaaatgtaaaagtatccaaactaaggcagagatggtaatatttcagaagactagggccaaatgtaaaaacataaaagcatccataaagaagaaaaaaatactatgttcataaaaacattggggaaaaactcacatcagagttcttactagcaacactggaaattataagaaaatagaccaatgttttaaaaaaaattctgagaaaaaaawactccaatctagaattctatatctattcaaactatgtatcaagtaaagggtaaaatacagatatttttctaatatgcaataccttaaaaattctgtctcctgtgtgtggtttctcaagaaacttatggagtatgtgcttcatcaaaatgagggagaaaactaagaaagaaaaatatatgggacttaggaagcaagaaatcaaacagaagaaaaaagacaaaggggattaccagggcgtggtgaccccaggtatggaccccaggagaaaagctgcccagcagccggrgatacaccagtccaaargaagcaagaactccgaggctctgggagtgccacttccaaggggcgaaatggacacgagggatttccttasggggttgttgatgtagctctgttgttgttattgttgttaccatattaagaggaaattttaaattttgttggaaaattcaggaagaataagtgatgggtgcacaaaaaagtacgtaaaaagctttaaaaggaaggcaatttttaaatcaaaaccaaagcaaaatatcgttcaagaaaataaatgtcagtgtggttcaacacatgaaatgactacttggttcagctgtgaagaatatttacattgtcatgaatgttaaataaaaatttaaacaagaattatgataaaattattttaggaagagaaaggaggaagagaagtgtgtgcgtgcgcgcgtatgtgcgtgcgcgcgtacgtgtgtgtgaagtgatagttgttgcaatattaaatccctagagtaatatttaatatattttaaaatatccatttaagcacattgtttagaaatattggaataagtagcagaagaaactgctcagtttctttataaacctcaaagtcttacttaaaactctgtgaatgtgtttatgtttgcaaaaaataatttaaaggagtcatctagtatttctgggcgatccataaaacctctattaaatactaaaagctgcagccctaatcccagttacaggtcagactaccagacttagggatatcctgcaaaaaaatgtaggctgcccactactttcaagaaccacaataatataactggtgtgtgggaaaagccttagacccagagttcatctggagacaacttacttaacctctctgagcctcacttgtctcrtttctaaacttaaagagttcgttcggaactaactaaactcaaatgaaaggcaaataccaaaagtgagacagatcaagcacaaacgccagcatcccttacagaggacagtctcaactcagatgcagccaactgctgtcatgaagacctgttgttgctaagaggtcagatggttcaagagaaactggaaatttggattttgacatgaaacctctggaatttaaaatactrgtttaaaatgcacagtgcctaccaaaccaaacctatctgcaggccacccctaactcacagattgccagtaaagacctctaaatcagatgaacattaataccctctaggtctattactctgtggcagtgcagtgctgcatgactaaaaatcttcactgaatgaatgtgtttctttaccactaaacaggcagcgtgtttttactcaaccttgacatatgacttttttttttcattatgaatactcatgaatcttaagacctgagatctgcacagagtctttactcgaagaagtactgtcataaacagagataggttctgccgaacatggccggaccgaaaaatcagggagcaattttcacaggtacacaatcgagtaagaactgccatcaatctgtcttttcagacatattaatccacaaagatagaaatcacttttatatgccaaggacaatatcaagctcagtatttgctaagactatctttcagtttttcatgaggaaacttttccctgccactgataattatcttcttggttcacagatctggaaagcatgaagactgggctttttttcctatgtctcttgggaactgcagctgcaatcccggtaaatttcctttcttctgttattacatctctttctcctgacatttaatgcagaaatcctccatttaaaagaaaatgttcttatataatggtttgaaattctctttttattttaattatattctttattgcccaagtaacaaacaaataactggaaaactcaagataaggtacttaaaaaaaaattttagaactatcaggttctacaggacacaataaatatgcagcagaaagtttgggctatcagtttattagccatagaatcagcccaaatacacaagagacaggaagaaataaattctcccagggaagctcatcacattgttattataaacccaagattttaggccaggtgcggtggctcacgcctgtaatcccagcacttcrggaggctgagatgggcggatcacctgaggtcaggagctcaagaccagcctggccaacatggcaaaaccccgtctctactaaaaaatacaaaaattagccgggcatggtggcgggcacctgtaatcccagctactcgggaggctgaggcaaggagaatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaaccaatggtttaggcaggaaacgatatggtaatcataaatcagctcctaattcacccttgggaggctgtccaagcaagtatgctgaaagtaggcagggctagaatattctcttcttcatggtcagatatattggccccatttgcacagcaataaagcagctgtacacaaatcagatcatttgaaaccgtgtcagtggcctcaaaacaaactgaaagttaaaaaacaaatgaaaccatagcatgaatgaccactggagatgttctgcaaatgattcatgtaatccttcattaaaccaaaggattcgtgccatattttttttctttttcaccaaatggaggaatcagcctcctttaaagagacaaaacaatttctcaatcgtccctttcctcccttcttctctaggtctaaaattctgtccttgctttttggataagttgttagctagcttctggttgacaaatgtgtcagcaaaaacaaactccatggcacccagaccaagctgttcttggaagacagagtttatacccaccatcaggaatcatgcttaagtagtatggagctactctagctgaaattatacattacaccctgaaatcacaaaagcgggacaagttaatgttcaacactgaaaggagttcccacaaaaccgttgttttctcctgaaaatgtgctttgtccttgtggctgttgctgttatgtaaataaacattaaaaagtgtctttgggccacgcacagtggctcctacctataatcccagcactttgggaggtcaaggccagaggatcgcttgagcccaagagttcaagaccggcctgggtaacatagtgaggccacgtctctacaaaaaaataaataaaaaattagccagctgccatggcatgtgcctgtagtcccagctacttgggaggcacaggagggaggatcccttaagccagggtagttgaggctgcagtgagccaagatcgcacacagcactccagcctgggtgacagagcaagactgcctcaaaaaacaaaaaaagtgtttgaaccaaatgtttgaatgacacacttgcatttagacacattccagatgtttcctttctgggacaatttgatatcatgtaaacctagccaaactgctagaaagctaagtatcttctcatagaaatgacctattaaaaatttgtataattttccctgcctgcctgaattctccagatgaaaatggattctgtgtagttgggagattccaaatagatttccagagttaaataaatagaaatatgcccatartgataaaacataatttcaattgcagaatatttctgaaagtaaaagagctgccattttttgtgtgcatttcttcctgcttgggcagtaggcggatggagggggagagagagtgaccagttctccactaataagcctaaaatctcccccatccattgccttctatgatgccccctgctggcagcttaccaaagtggccaccattctttctccttttcccccttctttaaggcttctttataaactttttcaaattcattacccatcttaggtgaaaaggagataagaagcaaaggagcaaaccaaacctaatatgaatcctgtactttggccagaagccgtggctcacatctgtaatcccagcactttgggaggccaaggtgggcagatcacttgaggccaggagtttgagaccagcctggccaacatggtgaaatcctgtctctactagaaaaataaataaatacaaaaattagcagggcatggtggcaggcacctgcaatcccagctactcaggaggctgaggcatgagaattgcttgaacccagcaggtggaggttacagtgagccaagatcaccactgtatttcagcctgggcaacagagtgagactctgtctcaaaaaaaagtttaaaaataaaaaataaatcctgtactccatgactattacacagtcagcactacaggacctgctaatggaataaaaataagttaatccaaatagaatctcagtttcatacttacacctggataggccatctgagtgtccagagtatctctctaataaagatccatggtgaatatctgcctcagatactgggcagtttatattattgacacagtgtgacattagtactagaaatagtaattttcagttgggcaactccttaaaatttataacatattttttatacataatcttattttgatatttctgctcacttgatatttcttgccaccttgagagatggcagggtagaaattaatgaccttggccggtcatggtggctcacacctgtaatcccagcactttgggaggccaagacaggaagattgcttgagttcagaagttcgaggccagactgggcaacatggtgaaactccatctctacaaaaaatacaaaaattacccaggcatggtggtgcctatagtcccagttactggggaggctgaagtggaagggtggcttgagcctgggaggcagaggttgcagtgagccgagacttcatcactgaactccaccctgggcaagaggctggagttaattaattaaaaattaatataatgaattaattttattaatgttttttaaytaataaaaaatattaacgacctgtcaaaccacagatagaaagtaaatagcagaggcaagacttgaatggaggcctcttacctccaagttcagttgttcaacttccccatcatgcatcactgcccagctctttatccaagtctccaatcttgctagaaataggaccatccctctaatagaaattaatactccagacatgcccttttctacttaggcttagtgccctgtctcacacagwctgaattaattctaattttttttgtttttgagatggagtttcactcttgttgaccaggctggagtgcaatggcacaatctcagctcactgcaacctccgcctccagggttcaagtgattctcctgcctcagcctcccgagtagctgcgattacaggcacccaccaccacacccagctaattttttgtatttttagtagagacggggtttcaccatgttgtccaggctagtcttgaactcctgcccttgacctcaggtgatccacccacctcggcatcccaaagacctgggattacaggcgtgagccaccatgcccagccccattaagatttcctgaccaacgttaaggccaatggcgttaagaaatcaaataaatattgataaaaagtttataaatttttctgctaattatcggtgggtacttaaattaggcaaatgtacaatactatatcctatggttaattttatttgacttcaactttctgctaaacaacactttccaaaattgtaaagtacaaatgctttgcaaaagtttaaaaaacacagaaaataatttcaaaactcaaagytaccattatttaaatgcattttgttttattttcacccagtctctgcataaataactttttcttaaacacaattgagattctgcttccacttaacattctgttctaggcatctgcttatatcctcaaaaactctagagaatatttttaaattgttggtataaatgaagtatattsctactaataatgatgacaacaagagtaactagcaaatttgtaaattagcatccagacatgaataacaaaaaccagtttttaattttttcagacaaatgcaagattattatctgatcattccaaaccaactgctgaaacggtagcaccygacaacactgcaatccccagtttaagggctgaagmtgragaaaatgaaaaagaaacagcagtatccacagaagacgattcccaccataaggtaaaagtaacatcatttatattaatacaattttttaattctccaaaggtcttagtttcaaagcatggtaaaagagattatgttatttatgtctcagtttaatttttttaaaacatgatgatcacctcaactgcctccaatcactagaagaatgatgaggattaatgagttttactacttgggctgagctgctgtatacttgtttcattttataaaatccaaattcagtttaaacctgtggctacagaktgtgaggaatattataaacatgtttacatgatagtgtgtgaagaaraagaataatgaatattaaatgttaccttaggcataaatatggttacattatcatttgtttgaagaatgaacttttttttcttttaaggctgaaaaatcatcagtactaaagtcaaaagaggaaagccatgaacagtcagcagaacagggcaagagttctagccaagagctgggattgaaggatcaagaggacagtgatggtsacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagwaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcamtgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggtaaaattattttaaatggtccttgtccaataaagccagcattatcaataaacagtcatgacctttctctgtgctctcacagtgtcctgtatggatgtctactagtacattactaaaatatattacagttatttctttttaggtctatctctatcattaggctgagaatgcctgttttatttgagttcccgtagatgcagatcttggatttgagtgttgtttatttaagaagcacagggaacaaagaggagtgcagaagtaacacaagaaggaaaggaagctaataaaaggaacatcattcaagccatgtaaagacattttctcagaagtattccatttggcgactgaaggagctagggtacttcttttggctgaggattgctagaggggtattaatttcccagcatttccagcctgtcccttgagtgagccaggtcaatttccatgatttttcaggcacggaaatgcagatattggccattgaaagtccctggaactagctggaatgataaattatgacagatctgaaggayaggagatactggcaactgctgctctaatgccttgaaagcagatgccatattgttttcgagttgaatcaccagtgtccaacaaaatgtctctgacataacaaaagagccaacaatgtttgttgaattagttataaagattaaggtcctactttattaagcaaacacataccaaaatgataatctggaaactacagcaggatcggggcagggaggaagcatatttggagctttcattcaaaatcctggcagccacaaagtcctgtgccagcaggacttggcacagattttggtacacaaggtcaatggtaacctcagttactgagaactctgctgccactctaacgtaggagttttcttataccttaaaagcctggtatgaaagctttaccaacaaattcagagagatttccaatgtaactctggcttaactacaaaatcacaagataatactacatttctagtgttttctcaaatccaaagaggagactccaagtcttattgagtaatccccagagataacgcactaaatctcactgataaagatagaaatgggtcctgttctccaagggttactgtctacctccacagttgtgactgatttccctttcttttttcttttttttttttttttgagacggagtctcactccttcacccaggttggagtgcagtggcgcaatctcggctcactgcaacctctgcctcccaggttcaagcaattctcctgtctcagccactcaagtaggtgggactataggcgcctgccaccatgcccagctaatttttgtatttttagtagagacagggtttcaccttgttggtcaggctggtctcgaattcctgacctcaggtgatccacccacctcagcctcccaaagtgctgggattacaggctccatttcttcttttttttctgttttgttttgtttttagagatggagtcttgctctgtctcctaggctggagtgtagtgatgcaatcacagcttactgcaacctcaacctcctgggctctagcagtcctcccaccttagcttcctgagtaaccgggaccacaggcatgcaccatcatgcccagctaatttttttttttttgggggggggggtgggtagagatggagtttccctatgttgcccaggttggtcttaaactcctgggctcaagtgatcctcccaccttggcctcccaaagtgctgggattacacatgtgagccaccacacccagcctggtttccctttctgagatttgaaatgatttgagcatgaaaaatactcgtgaaagtatgcacagtggaaatataaattaagtaatggctctcctcttagtagattttaacttttgctcttgttattctaaaggccaagaaagcagagaactcatcaaatgaggaggaarcgtcaagtgaaggcaacatgagggtgcatgctgtgggtgagtatgcatgaagcaagctgtttgtgactatatcaaggaagaaatggaatctgccactttgggcttgtccctccatcctttgtgaatgctgcacagaattttttctctccccagtcctccccaaggaaatgctcccataaattgttgacattttcttgtgcatacttgatatacaacaatgggtaaatgtgtttgcaaactggaagccctgttgagatattagtgaaagggctagagttcttccttaaatccttttgcttctgaaaagacttaattctatcttatttattctcaaatctgtaacttgctgatgaatttatatcccatacttgataaaggaccttattcctccccctatcacaaacattttgaatttcagccttatttcacttctgaccagcttgcacaacgttgcactaaggacttcagactatgaccatctcaggcatagaagagctgtctgttctttgcacatctccaatccaaactgctgcaagaggaaatctagattatcatgtaaaataatcagtaaaattatcatgtaaaatagaaggttccatctgacattaacacatcaattaaagaggattccaatgtcttcccacttccaaatttgcaaatttcaaggacttcaaaatttccccttcattagtgaaaatgaaactagttgagtgaatttgtatttacatactcaatttaactttgtccatgcttcctgcccaatcttttctgttagattcttgcatgagcttccagtgtaaaagaggccacatctgtaaggcagaccaacagggaaaacctcactgtgtctgccaggatccagtgacttgtcctccaacaaaaccccttgatcaagtaagtattcygcaaaatagtctttaagtggctccaaaaggttagtgactgaaataaaaatatttgccattgaaatttttgcttaaaaaaggtagatacctaggttatcatttggttatttgggatatttggaacatctgcagttttcattctactgagcttatctagagctaaattgtcatcaccgttggtacagtttagttgatttttttgatgccaaatggaacaattacgattttaatagtctcacctacctgaccacatctttggcacagcgctgttatcagcatatgagctttaaggagcagagtgtcttccagtgagcatttggctctatcagctttttcttctacttatcttccataggtttgtggcactgacaatcagacctatgctagttcctgtcatctattcgctactaaatgcagactggaggggaccaaaaaggggcatcaactccagctggattattttggagcctgcaaatgtaagattatgtccctcctgtcaaccatcatctctgagagggcttggggtgaatctggacatgcctgaattatctatatgcaaacagggaaaagctgatgtagttctgaacacaaaaattatcaactggagaaacttaaaaaataagaactctcaggccttaaccgtaggagattctgatttaactgaactaggttggaatcctgacattgttttttttatttgtttttgaagtaacctagacaattctaatgtgcagccagggctcagaaccactatgatamtgctatccacttaatcacagagttgaatcactggaattttgctacattatttgccctcttcccaatttaagttaagcctttgccaagaagtctctgacaacacatttttccagaagtgttttaaggctgtcttccttccccaggatattctcaattgtgtttggctccccttaccactaagtgattctccacattagcagtgctcactaatgtttccgggtctcctccccttccagacacaggagaggatgaaacatgtcagcctcctggacgttaggtatgaccatatatcttgctttgtccagggaaatgtgaaaaaagtcatctatgtgagttctgggcagaagcattcaagagctggggtatggttctccatcctctgctcctttgccaccacaaactctctttgagatagtggcctcaaaaaatggcaacgtcattggtggctggcaagatggccaaataaggaccactctggtttgcagctcccagtgagatcaacgcagaaagagggtgatttctgcatttccagctgaggtacccagctcattgggactggttagacagtgggtgcagctcacagagggggagccaaagtagggtggggtgttgcctcacccagtaactgcaagggatcgggaaactctctcccctagcgaagggaagctgtgagggactgtgctgcgaaagacagtgcattctggcccagatactacgcttttcccacagtcttcgcaatccacagaccaggagattccttcgggtgcctacaccaccaggaccctgggtttcaagcacaaaactgggccaccatttgggcagacaccgagctagctacaggagtttttttccatatcccagtggcacctggaatgccagcaagacagaactgttcacttccctggaaatgtggctgaagccagtgagccaaatggtctagctcagtggatcccacccccacagagcccagcaagctaagatccactggcttgaaattcttgctgccagcacagcagtctgaagttgacctgggatgcttgagtttggtgggggggaggggcatccaccattactgaggcttgagttggcggttttcccttcacagtgtaaacaaagctgctaggaagttcggactgggtggagcccacggcagcaccagaaagccactgtagctagactgcctctctagattcttcctctctgggaaaggcatctctgaaagtaaggcagcagccccagtcaggggtttatagataaagctcccatctccttgggacagagcacctgggggaaggggcrgctgtgggcagagcagacttaaatgttcctgcctgccagctctgaagagagcagcagatctcccagcacagcactcaagctctgctaaggaacagactgcctcctcaagtgggtccctgacccccatgcctcctgactgggagaaacctcccagcaggggtcgacagacatctcatacaggagagctctggctggcatctagcaggtacccctctgggacgaagcttccagaggaaggaacaggcagcaatgtttgctgttctgaagcctctgctggtgacacccaggcaaacaaggtctagaatggaccttgagtgaactccagcagacctgcagcagaggggcctcttagaaggaaaactaatgaacagaaaggaatagcatcaacatcaacaaaaaagatatccacacaaaaaccccatccaaaggccactaacatcaaagaccaaaggcagaaaatccatgaagatgaggaaaaaccaacacaaaaagcctgaaaattccaaaaatgggaatgcctcttctcctccaaaggatcacaactccttgccagcaagggaacaaaagtggatggagaatgagtttgaggaagtgacagaagtaggcttcagaacatgggtaataacaaactcttctgagttaaaggaacatgttataacccaatacaaggaagctaagaaccttgaaaaaaggttagaggaattgctaaccagaataaccagtttagagaagaacataaatgacctgatggagctgaaaaacacagcacgagaacttcgtgaagcatacacaagtatcaatatccaaatcgattaagtggaagaaaggatatcagagattgaagatcaacttaatgaaataaagcatgaagacaagattagagaaaaaagaatgaaaaggaataaacaaagcctccaagaaatgtgagactctgtgaaaagaccaaacctacatctgattggtgtacctggaagtaatgaggagaatggaaccaagttggaaaacactcttcaggatattatccaggagaacttcctcaacctagcaagacagaccaacactgaaattcagcaaatacggagaacaccacaaagataatcctcacgaagagcaactccaagacacataattgtcagattcaccaaggttgaaatgaaggaaaaaatgttaagggcagccagacagaaaggtcggaatacccacaaagggaagcccatcagactaacagtgggactctctgcagaaaccctacaagcaagaaaagagtgggggccaatattcaacatgcttaaagaaaagaattttcaaactagaatttcataaccagtcaaactaagcttcataagtgaaggagaaataaaatattttacagataagcaaatgctgagagattttttcaccaccaggcctgctttacaagagcttctgaaggaagcactaaatgtggaaaggaaaaaccagtaccagtcactgcaaaaacataccaaattgtaaagaccatcgacactatgaagaaactgcatcaactaataggcaaaataaccagctagcatcataatgacaggatcaaattcacacataacaatattaattttaaatgtaaacgggctaaatgccccaattaaaagacacagactggcaaattggataaaaagtcaagacccatcagcatactgtattcaggagacccagctcacatgcaaaaacatacataggctcaaaataaagggatggaggactatttaccaagaattggaaagccaaaaaaaaaaaaaaaaaaaaaaaaaaaaaaaaaaaaaagcaggaattgcaatactagcctcagataaaacaggctttaaaccaacaaagatcaaaaaacacaaagaagggcatcacataatggtaaagagataaatgcaacaagaagagctaactatcctaaacatatatgcacccaatataggagcacccagatatataaagcaagttcttagagacctacaaagagacttagactcccacacaataatagtgggagactttaaaaccccactgtcaaaattagacagatcaccaagacagaaattaacaagtatattcaggacttgaactcagctctggaccaagcagacctaatagacatctacagaactctccaccccaaattgacagaatatacattcttctcagcaccacattgtacttattctaaaattcaccaaataattgaaagtaaaaactcctcagcagatgtgaaagaatggaaatcataacagtctctcagaccacactgcaatcaaattagaactcaggattaagaaactcactcaaaactgcacaaatacatggaaactgaacaacctgctcctgaatgactactgggtaaataacgaaattaaggcagaaataaggaagttctttgaaaccaatgagaatgaagacaaaatgggccagaatctctgggacacagctaaaacactgtttagagggaaatatataccaccaaatgcccataagagaaagcaggaaagatctaaaattgacaccctagcaccacaattaaaagaactagagaagcaagagcaaacacattcaaaagctagcagaagacaagaaataactaagatcagagcataactgaaggagatagagacacgaaaaacccttcaaaaaatcaatgaacctaggagctggtttttttaaaagattaacaaaatagatagacagctagccagactaatagagaaggaaagagagaagaatcaaatagatacaataaaaaatgataaaggggatatcaccactgatcccacagaaatacaaactaccatcagagaatactataaacacctctatacaaataaactagaaaatctagaagaaatagataaattcctggacacatataccctcccaagactaaatcaggaagaagttgaatccctgaatagaccaataacaagttctgaaattgaggcagtaattaatagcctaccaaccaaaaaaagctggggaccagacagattcacagctgaattctaccagaggtacaaagaggagctggtactattccttcagaaagtattccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatcaagtcaccttcatccctgggatgcaaggatggttcaacatacgcaaatcaatgcgtgtaagccatcacataaacagaactaatgacaaaaaccacatgattatctcaatagatgcagaaaaggtcttcaacaaaattcagtatcccttcatgctaaaaactctcaataaactaggtattgatggaacatatctcaaaataataacagctatttatgacaaacccatagcaaatatcatactgaatgggcagaagctggaaacattccctttgaaaaccagcacaagacaaggatgccctctctcaccactcctattcaacatagtattggaagttctggccagggcagtcaggcaagagaaagaaataaagcgtattcaaataggaagacaggaagtcaaattgtccctgtttgcagatgacatgattgcatatttagaaaaccccatcatctcagtccaaaatctccttaagctgataagcaacttcagcaaagtctcaggatacaaaatcaatgtacgaaaatcacaagcattcctatataccaataacagacaagcagagagccaaatcataagtgaatgcccatttgcaattgctacaaagagaataaaatacctaggaatacaacttacaatggatgtgaaggacctcttcaaggagaactacaaaccattgctgaaggaaataagagaggacacaaacaaatgctcatggataggaagaatcaatatcgtgaaaatggttgtactgcccaaagtaatttatagattcaatcctatccccatcaagctaccactgactttcttcacagaattagaaaaaaactactttaaagttgggaaccaaaaaagagcccatatatccaagacaatcctaagcaaaaacaacaaagctggaggcatcacgctaactaacttcaaactatactacaaggctacagtaactaaaacagcattgtactggtatcaaaacagatatatagaccaatggaacagagcagatggctcagaaataatgccacacatatacagccatctgatatttgacaaacctgacaaaaataagcaatggggaaaggattccttatttaataaatggtgctgggaaaactggctagccatatgcagaaaactgaaactggatcccttccttacacttcatacaaaaattaactcaagatggattaaagacttaaacataagacctaaaaccataaaaaccctagaagaaaacttaggcaataccattcaggacataggcatgggcaaagrcttcatgactaaaacaccaaaagcaatggcaacaaaagccaaaattgattaatgggatctaattaaactaaagagcttctgcacagcaaaagaaactatcatcagagtaaacaggcaacctacagaatgggagaaaatttttgcaatctgtcaatctaactaagggcttatacccagaatctacaaggaacagatacaaatttacaagaaaaaaacaaccccatcaaaaagtgggtgaaggatatgaacagacacttctcaaaaagaagacatttatgcagccaaaaaacatatgaaaaaaagctcataatcactcgtcattagagaaatgcaaatcaaaaccacaatgagataccatctctcaccagttagaatggcgatcattaaaaagtcaggaaacaacagatactggagaggatgtgaagaaataggaacgctttcatattgttggtgggagtaaattagttcaatcattgtggaagacagtgtggcaattcctcaaggatctagaactayaaataccatttgatacagcaatcccattactgggtatatacccaaagggttacaaatcattctactataaagatgcattcacacatatgtttattacagcactgttcacaatagtaaagacttggaaccaaccaaaatgcccatcagtgatagactggataaagaaaatatgacacatatacaccatggaatactatgcagccataaaaaaggataagttcatgtcctttgcagagacatggatgaagctggaaaccatcattctcagcaaactaacacaggaacagaaaaccaaacactgcatgttctcactcataagtgggagttgaacagtgaaaacacatggacacagggaggggaacatcatataccagggcctgtcaggggctgggggactaggagagggatagcattaggagaaatacctaatgtagatgatgggttgatgggtgcagcaaaccactatggcatgtgtatacctatgtaacaaacctgcacattctgcacatgtatctcagaacttaaagtataattaaaaaaaaaaaaaacggcagtgatcctgagctctggggagactgcaatgagcagagccctcctgccaacttgtattggacttgkagcaggattgcaaaattgacttctgtttctttaagccackgagatttagcattatttcttactgtagtatcagctaatagctacctttttctctattcaatagcacttgtgccctccacctacaaatttcaactctgattctacagcagtgattctggggcctagctgcacatccaaatagatcttggagctttaaaaacatcctgatgcccagacttcacgccagaccaatcacatcagaatttacttgattggaagctggcatttggtatgttttttaaaaccccaggcaattttgttgtgctgctgccagggctgaggaccactgtcataataatggggmcctgagaaagctctgtcagttgccagaagtcgttaagcttcctattatgaggacttgccataggacacaaataagcccaaagattacagtacattttctgcttgtaacagctattcctacttgtacggactttgaagtgattcagtttcctctacggatgagagactggctcaagaatatcctcatgcagctttatgaagccaactctgaacacgctggttatctaaatgagaagcagagaaataaagtaagttatccacaggttagcttcttcaatgtctgtctacagggcatraggaagaaagacgtggtgggggggctacctacctctgcatactggcaaaagcccactatgcttccccatgcccggttagcccatgtggcttaacagaataatagatgtcaccattcacgccacaaggtttcagacaccaccaaaccgccccattcttcccaatggtcagtggcctgaattagggctcttcaattcctacctagagcaagctctggttgagcaaagttaatataaatttagcattgatctagtcagtccaaacatcttatttaaatctaagcatttgttttgttctcataggccagacatagatgtatgatataaagtaaatccattactcaaaatatcagtaatmtattaagattaaaaagcacagaacattgattccaaaagcttccagagaaaattcattcaccagatagttattgagtgtatcctgggtgccagaaattgacctaaatactggagatacagcaacgaaaagaaaatctctgccttcatgagtttacattctgggtgaagagacagactctaaacaaataagtatatatgtgtgtgygtatgtaatgtttgtatatgcatatatttgtacatacatatatatgcatatatgcaattatatatagtaaaatgagcatttatgtaaatataaccaaatcagcaaatatatgtataagtatgtcagttgggattaaacatggtgtgaagacaaataaaacaagaaggagggtgtgcattaactgtgtcagatgctgtttataggttatgagttgaagactgagaattggccagggatttagcatgtcaaagtcatagctgaccttgataggaactgttcctggggtgggagcatgtttcaggagggaagctccagtggacagagttcaacagagactaggaggaatggatgcagcaagtatagacaatcctttcaaggagttttgctatgaagagataaagagaaatggggtggcagctggagtggaaagtgagtacaagagtcccacctagcagtgggagatggtagaggatgtttgcacgcttctggaaataacccagtcaagaaggaaatrttagtggggagcagagaatgcgcacaactgccagagggcgttcttcgatacatgtcccacccagaggagagggattggacttaggttaggagcacaggaaggtcgcagggagcaaagttgtggttctgggagcaggtggaggtcctgtttgcttccaattactcagtgaaataagaggcaacatcacaagctgagagtttcacaggcactgctcaagaataatttctagcccccgtcttgaataccttgtcacagagagccttgagggtattagctatgaaacagggaaatttcaatggggctggccaagcaataacacaccagggtgaaagcaagactgagtgggcactggatggatgacctagaagactaagagtggactctgtcatcgggggaaggagcagcacttttcactaactaatcaccttagtcaattcagcccttttcattaaaacctcatagtttaaaaaaaaaaaaaaaaagcagcgaacattacttggttaaaagaaagaggcaaaacatacttaaaatatttaaaagtttaaaaaagaatttaaatttcttctaaaaaccagaggtttcttacatcaggtgctattctgtgtagacatgagaaaggcctgtagtattgattggaaggaatttcatttagttgcacatgatgtcctgagcttgttttcccctatcgtgttactgtcactcttcaagtaaagtttatagcaagtgacaagtccattacatttgtctgattctctgacagtcttctgccttcctaatcccaggtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggataggtaagaactctttacctttccatttctagatttatctctctgataaaatatctacatatctatgcaaaaggaaaatctaaacagatttaggacatttcccagttccattttagaatactgaaatgcctggttaggagtctaaacacaaagctgctgtgtatgatgtactctagaacttaaggtataataataataataaaaaagtctgaaacttgatagagcttatgttgataaagtttatgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttgatcgtaaattcccaagattggcccaatgtgggtcaagtgactacatctaaaacaatcaggtatggccagtagatgagaaccaggttgtaccaacatgactgctgggtacacccctatagatttagggtggsggaaggacagttcctgtgaagacagaaamcttgtgaatcaacatcccaaaagctgtcaaccttacccacaaatactttatttcgttggcagtttttatctgtattctatttatatcacatatacarcaaccttatgggagaaaaatgtccttggtgagcctgagagttaaatcttcatgcacaagctactcaattaataggatgccatgtatttcattgcagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaaggtaaattcatcaccagccaaagaagagggatgtcttcttcctcagacaagccctaagccctgcatgcttcatagagaggtcctgccacatgttcgaattggaagctagaaaaaaaaaggtggcagcttcccagataggactcccttggtgcacatgctgtcattgcgaagtcacttcttactacctttatggcactgttttcaaagggtagcaagggtgaacatgcattgaggtctcaacagtcagctaagcctagaaagacgtgtgaatccagaattgggccaaatctcagcaggctttgtgtccttccttatttcatatcctaccttaacctgggccttgggccaaacttttcaaaattacacataaagaataaaaaagcaagcccatttctgacaatgggagatgtcagaacatctcagaatccattaccaacacactaaagactggattttacatcacaattagtgcygggataatcctttaacccaaaactcacccatggcttcaccctcaatgaatgggagctgtgggagggtagatcagagtattctttctttaytcctgcagtggaggaaattaaatttagatgcttgttttgctgggttatgtcttaatatgtttccttttctttccttaagttaggcttgaattttatgagcaagtatgttttcaataattaagatatgaaaggctgggcacggtggctcatgcctgtaatcccagcactttgggaagccgaggtgggtggatcacgtgaggtcaggagttagagactagcctggccaacatggtgaaaccccgcctctaccaaaaatacaaaaattaggcgggcttggtggcacacgcctgtaatcccagctactcgggaggctgaggcaggagaattgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatcagatcaatttaaccattccacaaggtatatatattttaaaaggtcatgttttacatgataaatacataccatttttatttgtcaattaaaataaataaataagaaaaataccactcacagaacataaattaacagtgaacatcaaatctctgaaacagagatttcattcatgtttacaatatacccttgggataaacatgcagctaagccgttaaagaaagtcagttcatcaaatgtcagaagttcccaaaaagaaataacttgtgcatacttcatttttaaaatatcccccatgcatatgtagaatgccttgaaattagagaggaagaggtgaaagtatgaggatttacttattaataaataggtaagcagagagggtcagtccttttccttgcaatatcattctgtgaaataaacattctgtgaaaggatgtatatttttgtaagtacctagttctgtgtattagttgtctatgctgcatagtgaatcaccccacaacttaacaggttaaattctttctcacggtttccaagggtcaggaatctcacagtaactaacctggatggctctggattaggatctctcattaggttgtggtcaaggggtcatgcagtgcggcagttatctgatggcttgactgcagctaagggtctacttctaagcccactcccatggctctttgcaggagccttcagtatcccatcgtgtaggcctctggtctacagggctgcccacagcatgrtatctggattcctccagagcgagtgaccaggyagaaagagagaaaaagccaagactgaggccccaatgtcttttataacctaacctcagaagttatatatcatgatttctgcctcattctattggtcacactgaccaatcctgctacagcaggaggaggagaaggagaccacagggggttggatgtcaattgtctttctaacatctatgatacaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctccgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattcagtcagaacacgtaaacaacttactgctttggaatgtagctaaagaaaaacaaatttatttgtaagtatacccttctttccttcaaggctgagaaatctacaggagaagataaagtttagccaatgttttcctgaattttaactgcctgtgatagacgtgctcatatattcctcacatagctgttattaactagctgtgtgaattagggcatgttgcttagcctcagtgagtctcattttccttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccaccaaagtgtttcaaacaagccagtgatttccctgggtttgtatttaagatggattctcctggttacattgtggtggggccaaagaattgttgagagaatactgtggtaaacccaggcaagagctgatgagaacttgaactaggggagtgaccaaaggggaaaaaaagagagaagtaaacatattcaagatatattttaagatataagcatactcaaatatatagcatgtggaaataagacaatatttgataggaaatatgtgggagycgagagcagacaggtgagagactgaaaagagaagtgcaatgcctaggtccctggctcagagcaggcagggtaaatagaggtaaatagaggcatcttccactgagaaaacacaagaacagaagtggatttggagtaaatgacaaattccattttagatacgttgaattgtaaagtattaggttgcctcctaagtgttagtttcatgcaaaagtaattatggtttggccattatctctaccactccatcaaaactaccattatccctaccatgcccaccactgatgggcacctacattgattttatatctttgctattgtgaatagtgctgcaacgagcatatgagtgcatgtgtctttttagtaaaatgatttttttataaatatacccagtatgggattgctgggttgaatagtagatctgttttaagttctttgagaaatcttcaaactgctttccacagtggctcaactaatttacattaccagtgtctaagcattctttttctctgcagcttcaccagcatgttgtttttagactttttaattacagccattctgactggtgtgaaatggcatcttattgtgagatggttttgatttaaattttcctgatgattagtaaygtggaactttatatatatttgttggccgcttatatatcaagacagggttttggaactgaaatgcatatttgaggattataagcatacagagaataattgacaccagggaagggaattaattctcccaaggaaaacgcattgagttacatgaaaaggggtctaggattgaacactgcactgagaaacaacaacatctagatgatggataggggaggaagaaagaattcagtaaggagaatgaagtttctcctgaaatgaaggaagaaaaccaggatagtgccatgcaaaggaggtgtttcaaagaggaggaagagattaacagtgccaaatgcgactgagatgtcaaagaagttgaaagaaataaggatatcctgggtagccttggttagagtagttctggtggaatggtagacatggaagtcacattctatgggttgagaagaaaagggagattagaaagggtaaggagtggatgtttgagtgcaggaaagacctagaaaagctacagagcattttctaaaaaaggggagcattttttagaataaaagagatttgagcactcctttcatttactcattcatttgctcaagaaatctttacaggccrggcgcggtggctcacgcctgtaatcccagcactttgggaggctgaggcrggcggatcacgagttcaagagatcgagaccatcttggctaacacggtgaaaccccgtctctactaaaaatacaaaaaattagccgggcgyggtggcgggcgcctgtagtcccagcyacwcgggaggctgaggcaggagaatggcgtgaacccgggaggcggagcttgcagtgagccgagactgcgccacttcagtctggcctgggtgaaagagcgagactccgtctcaaaaaaaaaaaaaaaaagagagagagagaaatctttacagatggtctacataaatgcaggcactgttctagaggctaaatatgaaacatatttaaatgctaatggaagggtctagtaaaaaaggaaaggtggaagaaggatgtaagaaaaaaagaggaaagtaaaaggagaatcttgtgaaggtcagaagagatcttgagcataggtagaggaattagccttaacgtcaagaaaaaggacaatctcttatctgagcaacagaaagaagacaaaggctatgggtgcaaatataagtaaacgtataactaatgaagctattatctccattttacatatgaagccagtactcaaaawwaaaaaatcaaagtccataatctttcccattctctgggctagataaagattattagcaggaaaattacctagtgcccacacagagtagtataatagtttgttagggtgggccatgttggtaaggagtgatcttatatttgctagaggatgctgtcttcttccacaggtatggcracaatttctttcacaagctactcaattaaaaactggaataacctagcactacacttctatttatttccattatttttcagctcaccttctagattagtatactgggcacttcttggctggacctcccgttaacctgctcttcctctatcagtggttctcaaccctgcagccaaattacctgcagagttttctaaacgtctacatgccattagtccacccctagggattctgattctagagtccagaggtgaggcctaaaaatacatatttgtaaaagttcatgagtgatgttgctgtcctaccaaagttgaggatcaccattatactgccttattagatggtttctctaatcccccaactctaatattgtttgtgctactactctggctactttctaaaagtgtcattttgcttcttgtttttttatagaggacatagatgaaaatctcttgttttgaacgaagattwtaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaatgcttatgcaagtgtatttccagttattatttagacaatcaaatgtaaaagatcaacccaagactcacacttcatgtcaaattataattgtgcttcctaaaccctactaccttaagtgtgtgtgtgtgtgtgtgtggttgagaaaaaagtgtgagacatctcttacaggaaacaaatactcagtggcaagataagaggtgctcattaatgtccttcatcattatgtaagtttaaacagaaaaaaactaatatcaagtgcttttttaccaaatttgatataaaatgtagaacaagctgggtgcagaggctcacacctgtaatctcaacactttgggaagccaagtcgggaggattccttgagctcaagatttcaagaccagcctaggcaacatggagagaccctgtctctatgaaaacttaaaaaaatagccaggggtggtggcatgtacctgtgatcccagctacttggtggacttaggtaggagaattactcgagcccagyaggtcgaggctgcagtgagctattgtgccactgcactccagcctgggtgacagggcaaggccctgtctcaaaaaataaataaatgaaaataaaatgtgaaagattatgcactgcttgatccaattaattctaactttttgtgcagttgagcatgtgtgctggggaagagggcggccctgcaaaaatttcacataatcattgcctcamaataaagaaaatgtaatggtaaaacaggtagagggccataaagcgtcttgatgtccaatgtagaaagagattaaatattattaatgtaaattgatagcgaaaaacctgtcataagcaaaaatttgtctttttatttgcgctcttctttggtaactattacagtaaaagctagatcacaaaaatatgacattataatatagttttccaagttctgaagtaaggcaataaaaggacatgtcactcactttatttgactatttgaaagaaaatggttttttacatatttttctagctgaaatgaaagatatcaatacaattatcttttactattttttcaaataatcaaaaatgtgttgttgttgttgttgttgttacaaaccttatctgtgatagtcactgagagaacatgcccctaggaattttatctgaaagatatttacagaatagtttatttttttatcagaataatcttctctgagtatttcaaaatttcattcgttatctctttcatagctcaataaattacttattctttttttttttttttttgagatggagtcttgctctgtcacccaggctggagtgcagtggcacaatctcagctcactgcaacctctgcctcctgggttcaagmgattctcctgcctcaacctcctcagtagctgggattacaggcgtgygccaccacgcccagctaatttttgtatttttagtagagacgaggtttcaccatgttggtcaggctggtctcgaactcctgacctcgtgatccgcccacctcggcctcccaaagtgctgggattacaggcgtgagccaccacacctggccaattaccttaactagaaccatatcatactatgtcctttctaaaaaattaagttcaatttgattaatcaaaatcgaattaagtattatttgtaactttttccaactacagaaataattttaggaactattccaaatttcagaacgtttttatatgaagctgaaaaggtcttagctaattacaaactaggttgctggkaacagtgaagttgtattcagaggtattaattaggcctaaattatcttttaccctcagacaactttcaaaaatattttagaatagtgaaaagtgattttaacaccaaggtaaggaaaccacctcaatatctactaaaaaattttgtttgaaaataatattcattttgaaaygaaaaatatttaataagagaaaatctcaaaccttaaatttctgtatcatttaaggctcttacatgtacagctagctcatctattatagaggcacgttaatattcttggtggtcacaatttttaattgtgggttgtttgtgataaagacatactctaatcccaacctaagagatkaagttattttctcagtaatcagtctgtaagtctacctctgtgtaattgagatattttggaagttggagctcctggtgtgaaagcaattattcagtttagctttgaattttgtgactcatattgcccataaccataaaggcattagtaacatggcttaaatactagatgggcatagagattctaggtgatcacactgctccttgaatttgttgctccaagggccactgaagcaaaggtaattgaagagatatatagtataatttggactgattctaatgcactagataaaagaatgtaacatattcttgtattgggtaatttaatgatttctaayaggtccacttctaataagaagaaagaaattagtgtttgaatccagaaagaagaaaaatacaaagaaaaaacatgaaaaaggaaaagggaaataagttgcctaaattcaggcaaagtagcactaagattgaaatcagagttgggttttagatatatataacagatgaagtgtgatttatagatataacttgcctcaaatgctggagataagtcttaataataacatgataaagttgtttttctttcaaaatccaattccagaatacagtgatttggtttgaaactcacaaggtaagttaatttgaattaagtrcgatttttaaaacataaaaatgtctcctttcagaaccaatggaccaataaaaggccagttgatttcctttattgaatctgaatttactcatattgtgctgattttctaccaacccattacatcttacaaaatttttcccatacaatttccttcccgagaactataactggcaataacagcaaccagactatatgaaggcctggtaagtctcacagaggtacaagcttcaggtggatttatttgtgtattacataaaaactttcctctcattttagccagtagtgatcaattactaataataagcatgatgtaacactggtgtttaaagatttgtgagtagaattgagcacagtggctcacacctgtaatcccagcactttggaaggctgtggtgggaaggttgattgaggccagaagttcaagaccatccttgcaacaggggggcaacatagcaagaccccatctctaagaaaatttttttaaaattagccaagtgtggtggtgcacacctgtagtcctagctccttgggagactgaggcagaaggatcacttgagcccagcagttcgagggtacaggaggctatgattgtgccactgcactccagcctgagtgacagagcaagaccctgtctcaaaaaaaaaaaaaaaaaaaaaaargatttgtgtgtagagatcacaaacgcaacttcagggaccaaacatgtacagtgtataggccgaactgtaactttataagaaagtagaaagtaatgggctatgttgggagctaaacagtgcatgtcttgtctaaggaattcaaagcttttaaaaacactcttgtaggcttacaaaacctatgtttggaggcaggatttatcttgaccactatttcaacacctctaaataggaataggacttacatagaaaaaaactcgaaatgatctcctaccccttcaattccaggctcgacctttagaatgaaatttctcatcttggctggccttttgagcactgccactgctctgcccatccccgtgagtacaccctcctcagctgctgactcaatttcagatttagagtcatcgcatttctcggctagaaagcaggtcttatcttttcatttcacaaaagaggaaagcggaacccaggaaagtcatagaactaggagttcaccactctttgtcagtccaagactctgcccagtacaaatctcagctccatatgccatgtgctagctgtgtgactttgaactaacccatggtttccttgtctataaaatgagtcctaggaacacctcagagttgcacggagatgatttttttaatgcatctaaggcagagaagggtcctatttgaaagataggatgttctcaataaactcagtgatatagaacaaatattctgcagtgacccaggtctaaattaagcagtttgaattgagtttcatttgtaatgcccttgccccaaaccatctcatgttttcttaaaaggctgttacatggaaatgctctgacaccaaaggactatctacctcattgtagatttgattttaaagaaggaaatatttaagataacttacattgattactaaattatgaatataaaaacaacttatgcctgaattatatttgagtgatcatacagacacacctttaaagtccaatttttgaaaaccagatttggataaaaagctacattcatctatagtgcccttgataacaaacctaatttgtttctttagaccacaatcctttttgccaaagctggcaagtatcgtggtctaaaattccaaacaatttgtattgcctgtttctttaggctgatgggaatgctgcagtatacatatttcattaattctaatatgtactttttgatatttcagcagctctgaaattgagctgtgtcttaaaaacacaatttgataaagtgtcacggcagcttaacagcagcgcttttcttttttggtaatttatgaaataatggtgcttttgacaatgatagcatctaagaatatatgaaatactgtaatcccagaacatcattaacttcacctatatagacattttgtcatcaactgactatatacaaatgagatccactgagtctaatctgggtttactagtctgaatatgagggcaccaagtaggcaagaaactctctcccctgcacactttgtatcaaaggagcttttgaagaagtgagggagctttcaaaatttgtgtttggggtgcagaacttaagtgtacatttccacactcccttcactttgagtttataactactgagaactaaatcaagaacaccattcaaagatttacaaaaggaaatattcatgtaatatggaattaatcttaagaaatgtaaataaaagcattctttggatataaatttaaaagcaaaaagccttggtcttccaaatcattgcacaaaattaattaaacttttccctattagatatccaactgctttttatttcagaagtgaagttacattactgatgggtataatgctccatagtggcttattacttattctcctttagaacaaaacctctctttagtggataatgtatttccatatgctgctttaccttgttgctgttattgttttgcaagctcgaacaatatgctgaaagttccagtgaacaggtgaacttctaattgtatttttaaataatgcattcatcattttaaaagtytgccattgtctgaaatgactgacatcatgtttctttttacagagatttatcttttacccaccacaagtaccaccatttttccctcaggtcctctttcccctacctccgcaaccgcccctggtaagcatgggtttggggaatctgaaatagctaaaaggatttatttgttggatggtggttatgaaactttccaaattttgatactgaaatatgaggctttaggcagtccccaggaatcagctattcaaacttctctcccatatagcttatagtggaacgtgrcaaggggctagcaaatttccctccaaatcttcagtgccctctcgcagtgtttctctgcacttactattaaaaaggtgtttgtgctgaattactttgaccgttacgagcttactctttatgaagagaatacttctttctataatatccattcttttgctttttcaaattcaccttgttgctttctttctctaagaagattttttttccccagctttmtataactttttcccaagttcaagcaaaatagttattttgcttttctgtttggactctctccaggctctcctaatatctggattcttaaaacattttttcaat

SEQ ID NO: 13349 - DNA, 16914 bp, Homo sapiens
aatttaagactgaaagtttaacatgcttattttgttaccagccttctgtgagcccaagggctatttgctttatattgatcctatttggatccttctgcgaagcttaaaatggccatgagacacgggttargtcatggtgaaaatggtaagaagccactttagtttcttcctgccaaccttccttcttgaatcagacactttaatttcaattgctatgagatcacatagtggaaacatgtattcccagagggtgatacagtgcaatactatccttaacaggcaaatccaaggcatagccagtcccaagttgatcactagtgcaaatcataaaatacctaagtaacttttaggtgactttctcataaacaccagaatgacaygggttttcttaacaaaatatcactggtttgagacctaggatgcttctaaaacattgttattgctcccagatttcctttctcagagaattaggagagaaacaaaggtttgttgaggacctgttatctataagttgtttcaggtgggtgctttatgtaatttgttcataaaatatacatatcaggtattattattgtcttcattttattgatgagaaaactgaggctcagagagattgagtaagtaatgtgaygaagattctgcagagtaatgtatgtttagtcagcactgaaacccaagtcaatgggtcttgtttctaaaacacatgttcttttcactctaccatacgtytatttcagtgaccagatacatgtagttttctgacctagaaakaaagattggattcattatccataggcttctgagttcacaaatcaccacagccagtcaactacctgagagactgttgagtcctcagctttaaacaaagttttctacttccctccaagttgaaagtgtaatagagacayaaaaaacccttcaaaaaatcaatgaattctggagctggttttttgaaaagatcaacaaaattgatrgaccactagcaagactaataaagaagaaaagagagaagaatcaaatggatgcaataaaaaatgataaaggggataccacyaccaatcccacagaaatacaaactaccatcagagaatactayaaacacctctacgcaaataaactagaaaatctagaagaaatrgataaattcctcggcacaygcatcctcccaagactaaaccaggaagaagttgaatmtctgaatagaccagtaacaggytcckaaattgaggcaataattaatagcttaccaaccaaaaaaagtccaggaccagatggattcacagccaaattctaccagaggtacaaggaggagctggtaccattccttctgaaactattccaaacaatagaaaaagagggaatcctccctaactcatttcatgaggccagcatcatcctgataccaaagcctgtcagagacacaacaaaaaaagagattttagaccaatatccctgatgaacatcgatgcaaaaatcctcaataaaayactggcaaaccaactccagcagcacatcaaaaagtttatccaccatgatcaagtgggcttcatccctgggatgcaaggctggttcaacatacacaaatcaataaatgtaatccagcatataaacagaaccaacaacaaaaaccacatgattatctcaatagatgcagaaaaggcctttgacaaaattcaacaaccttcatgctaaaaactctcaatatattaggtattgatgggacrtatctcaaaataataagagctatctatgataaacccacagccaatatcatactgaatgggcaaaaactggaagcattccctttsaaaactggcacaagacagggatgccctctctcaccactcctattcaacatagtgttggaagttctggccagggcaatcaggcaggagaaggaaataaaggacattcaaytaggaaaagaggaagycaaattgtccctgtttgcagatgacatgattgtatatctagaaaaccccatygtctcagcccaaaatctccttaagctgataggcaacttcagcaaagtctcaggatacaaaatcaatgtgcaaaaatcacaaacattcttatacaccaataacagacaaacwgagagccaaatcatgagtgaastcccattcacaattgcttcaaagagaataaaatacccagaaatccaacttacatgggatatgaaggacgtcttcaaggagaactacaaaccactgctcaatgaaataaaagaggatacaaacaaatggaakaacattccatgctcatgggtaggaagaatcaatatcgtgaaaatggccatcctcccaaagtaatttatagattcaatgccatccccatcaagctaccaatgactttcttcacagaattggaaaaaactacttgaaagttcatatggaaccaaaaaagcccacattgccaagtcaatcctaagccaaaagaacaaagctggaggcatcacgctacctgacttcaaactatactacaaggctacagtaaccaaaacagcatagtactggtaccaaaatagagatatagaccaatggaacagaacagagccctcagaaataatgctgcttatctacaacgatctgatctttgacaaacctgacaaaaacaagaaatggagaaaggattccctgtttaataaatggtgctgggaaaactggctagccatatgtagaaagctgaaactggatcccttccttacaccttatacaaaaattaattcaagatagattaaagacttaaatgttagacctaaaaccacaaaaaccctagaagaaaacctaggcaataccattcaggacataggcatgggcaagtacttcatgactaaaaacaccaaaagcaatggcaacaaaagccaaaattgacaaatgagatctaattaaactaaagagcttctgcacagcaaaagaaactaccatcagggtgaacaggcaacctacagaatgggmgaaaatttttgcaatctactcatctgacaaagggctaatatccagaatctacaatgaactcaaacaaatttacargaaaaaaayaaacaaccmcatcaamaagtgggygaaggatatgaacagacacttctcaaaagaagacatttatgcagccaaaaracacatgaaaaaatgctcatcatcactggccatcagagaaatgcaaatcaaaaccacaatgagataccatctcacaccagttagaatgkcratcattaaaaagtcaggaaacaacaggtgctggagaggatgtggagarataggaacacttttacactgttgakgggactgtaaactagttcaacccttgtggaagtcagtgtggcgattcctcagggatctagaactagaaataccatttgacccagccatcccattactgggtatataaccaaaggattataaaacatgctgctataaagacacatgcacacatatgtttataggggcactattcacaatagcaaagacttggaaccaacccaaatgtccaacaatgatagactggattaagaaaatgtggcacatatacaccatggaatactatgcagccataaaaaatgrtgagtycatgtcctttgtagggacatggatgaagctggaagccatcattctcagcaaactatcgcaaggacaaaaaaccaaagaccgcatgttctcacttataggtgggaattgaacaatgagaacacttagacacaggaaggggaacatcacacaccggggcctgttatggggtggggrgagggggtagggatagcattaggaggtatacctaatgttaaatgacgagttaatgggtgcagcacaccaacatggcacatgtgtacatatgtaacaaacctgcacgttgtgcacatgtgccctaaaacttaaagtgtaataaaaaaagaaagaaagtgtattaggttgatagctcccaagtgatacagttttaattctttgaaaaaagattaaaaaatcacaatgtacctaattttgaaagtaaagctaaattatgaatgtaaaggacttcccattatgacctttgtccccaactcatgagtgtgtatatgtgttttctttccttttttgacatttaaaaaattatttattttttagagatgggatctctctgttgcccaggctggagtgtactggcatgatcacaactcattgcaatctccaactcctgggatcaagagatcttcccgccttagcctcccaagtagctgggactacaggcatgtgccattacacctggctaatttattttattataattgttacagccaggctctccctatgttgcttaggctggcctcaaactgctggtttcgaactcctggcctgaagtgattctcctgcctcagcctctctaatagctgggattacaggcaagaaccactgcaccaggcaactctttttcttttttgtttttttttgttttttgtttttttgtttttttgtttttttgttttttgagacrgagtctcgctctgtcgcccaggctggagtgcagtggcacgatctcggctcactgcaagctccgcctcccgggttcacgccattctcctgcctcagcctcccgagcagctgggactacaggcgcccaccaccacgcccggctaattttttttgcatttttagtagagacggggtttcaccgtgttagccaggatggtctcgatctcctgacctcgtgatccgcccgcctcggcctcccaaagtgctgggattacaggcgcgagccaccgcgcccggcctctttttcttttttaatgaaataatagagctagtagaaaatagtttgctttttaaagtgcttacttaataaaataaaaagtgggcaactcraaataaaaaatcaaacaatatctaamatgtttaaaagatttttaaaaatcaaaatataaaataatatcaaaatttaaaaactgggattctgttccccaaagttctgttcaaatctgttagatttatcttcccttgaccctaagtaatatcttgggcaagccctagagcttctttcctgacccttagttaataagatgttatctggtcacattcagtcacaataatagactcattttagtaataaacatcttaagactagtaattaaaactctttacttcacaccaagtttcctccccaagcttggcctgttcctggctggcagcctgaagtagggaaaggagagatayggtgaccttttctttgtacctttctagctaccctctataccctgacccyacatacataattgagctgtggcttctgactctactgggtttggggatgagaggcaktgagagtaaaatgaaggrgtggttttaattaatggcacagctaaaactggattttgttctctctgcacatggcagatgtttaaagctcattctttcttttatgcaagtttttacaccatccagcctcatttgtacctcttgaatttttgctcagtggcctatcaccattcaggatcaagacaaaaatcaatgagcacttattgtgtgtcatgcaccctacaaagtgccaggatatttatccaaactcctggcaatgctaaacacaatgcaaaaagacatattagaaaacgaatcttattaactttarcttttcaactgtatttcatcataaagtcttactttacaagataattgctgttgtgaaaaagggaaaggtcatggtctcatttcccagatgttatttgatatatgctataaattatattrcctccaacatagtctgcactttgaacttagaaaaacaatcttcagacggcatgcattctaattcttgaaataagtatgcccacaaactgtartttaagacagaataggtatgcttctcatgttttaattcagttgaatttcagaagatctcaggaatgtacagaacgagaattaagaattaatwadaataagaattaattaattgcttgacatagagtagttaggtgatttcctgaactttaagcttccacatcacartatgaagttggttyaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtaaagactttatttctttgtggctcattctttgctttcttacaaacatttttctttctaactcctaaatctctaggagattacagatagcttacagatagctcctgatgtggtagagaggatccagaagatgttcagaggagggaaaccatattytcccttcttacattaggaagaatccactatctcactaatggaagaaaagattctttgagtgctgttctctgaaacacaccaaaaagatccagaaatgtttccttcmctctttaactgaaaaatgactttttttgttgtttacagtaagaaaatggcagcgtgtaatgataacttccagatctgaaaatgttaaattctaggagatggaaaaacaaagaccatataagaaagtaatggaaaargttctcttaaaatttatagckctgaataagttagatttaattctgatttcttctaacttaaaaaagttttggaataatcttgagaagctgtgtagttttctccagggcgtttaatttaactgatttataatttgataccaatactctggcagcccatatactatacaagataggcaaacaaatttgtgtcattcccctaaaagaaaaatctgcatcaattatagcttacagtttaggaactctaagtttaaatttataaaagttgtagattcttatagtgattttggcttaatatttgctaattttctcatttttgtgtcagaaagaaatgccacaagaagcaaatagaactataaagttcaaaatgttaaagccactaagaaaaacaaaggggcatttaagaaaaaagaatactgtatatgtggaattaaagatgtgcttccttataaatatatgaatatacattttaatccttcatttratatttctagaatttgatttacttaacactgaaatgaacagtttgttaatcttattaaggttgctcagctctaagattctataattctgtactctacttaatttttctcaagttatggaaaaacaactttaatcagttctcttgatckgattgaacctgaacttctrtagaagcaatctgaatgttcttgtgcaaaggcaatgctaccgagttttcttcccaccctcaaaataaacaaacaaaacataacttggaaaaataaacacttcctatgggatttgactttattttctccattgtcttaccttttacaggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaayctagcagacggaactgaactcagggtaagaatttttttttttatgagcaatgcattcttgatttttctacccaatattaaaatgatttctgctctatttcattggatggtttaattaatgcagktctccttcactaactgaagaagccaatgaagtttgtctacattatatattrcacaaattggcaggrtatttaaatatgyttttatttttatacgcatctgtgaagaatctgaattgaacagtaagaattagaaaactatcttttgaatgactgaatatagacctattcataaagaaatttaaaactgtgtttttaaacagtacagcaaaagaagcctttagagttaatatgtaacttaactgtaatgtttaacatgttgaaataataaaagaaatgaatagatgaacaaatgagtgagttaccaaatggaaagatttgatgtattgtaggtcattgggagtgtaccttttcatgtttaagataacacattttaggaagtcatcattttcaacaaattttttaaaaactttttttagcctcaacatttttctatttaaattacatgtttgtaatgacaatttaactactgaatgttttatcrtaagttatgtctttcyttaattagtaccacaatcacacaaattaaaacaagcacagagttrttaacatctccrtgaaactaattttaaccatgactatatttctggacacgtaacatgaaagattcagaaagaagtgctgctcatctgccttaaaattcagcgtatggaaattattgaagagaacaagcataatggttatcaacacatactctgtagcccaatggcctaggttcaatcctcactctgtgactttaggtgaatcactgtgccattttacagtctcctcttctgcaaagtagagatartagtatcagtttcatagggtcaccatgaagattaaatgaaaaagtgtgtctacagaactcagaacagtgcctgacatgtgtaagaccctaataaatgccattattattattattattattattattattattatgtaggggacctggagccttgagggaaataaacttattggaaaattcaaacggacagacaatggaaacgaactgaatactgtccgagaaattataggtgatgaactagtccaggtgagttgtcaaatttatagctattttcaaaaggcaaaaattactacaaaacaataatttttgtcactgctgagccagatcttcagtaaactgactacttcttttctcataaatcttactgattttaaaaatattgtatagctattttctgatgcctatttactaaagacaacttatatatgtcaaataatcaatgcctattttaactgaaaatataaatgactacaaaccaacatgtgttttaaaatggctgtatcccatatctgtataaatcttgctatcaagtacaagaaaaaattgtataaactcatactcatataatatatatgaatatataatataaaaatagtataaactcatatagtataaaactataatactactttttcttaacttagatgtaaaccttaaagataaattcttctgtttgttaacacctttcagacttatgtrtatgaaggagtagaagccaaaaggatctttaaaaaggattgagcattattcttggcrcacagtccaaaatacaaattggacagaagatctatattgtaccagaactrtttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcrtccatgttgctttatatgtagccttgccttttaaaagaaaaagtatgtgaatatgaattgacagaytgttttcgtagagagagggtcttactctttcactcaggctggaatgyagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccasgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagayatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattktattttagcagggtacatattaggggatggagaggggktamaatttttaagcatttgcagctgcaactctatagacttttgacaaattctttttcacactgatgtagataacagcttaacatttacatagttcttackacttgccacacactgttctaagtggtatatacatatgacatatatattaaaatgtaggaagaaaaatgtttgagtacctgatgaaaatgaatagagagtatgtaatctttgaaagstgaatactgygtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatctatgttcattttataatttcataaaaatcttcacataggaaatagtaattatttagattttcacatgcttctcttcataaaagctcaatgtatttttatccctctaatcttatgtgtctaccatatatgaatcaggaaaaggcaggtattaatctcaatacaaaaactgagagagacaaaggcacaaagaagtttattagcttgtctaatattgtacaaagtccatgatgaacagaagaattaaatgtaggtcttgactttcagcctagatcattatgatctatgctattactcagcctgttataaacaaaaatatattaagaaaaaaaatgtccttaattcctcagtggcacccaagaatagcactctaaatgagtcaggtcagactgtaaaataatggtgttgagtgattagacacttatctatttctagtctcattgcaggctgacttttttcaccatttatatcctttctagaattaaatttccactatttattagtattggagarcagcctattatttgttaagtgacttccatttcaacaaccgtttttygggaaaaccaaccttgtcattacaccaccctgcttggccaaaagagggtccctgacccaagagcagccaatctaccacaatttggccagatcatgagctctgtgtagaaggaaaaatgacaactaactgaacctgcaagaacctctttytagggagtttgaatttgagaagtacacagttagtagttgatagcaaggaaaaaggcttaaagaggacaaatagagcagacaataagtagaagtcatgagtacctgaaactatgaacaagcagtaaccrtagggtagayagcagaatgtcggggcagtcagaagcagttggagtagtagaagctgaaatatttacacatgcaatatggtatctgggwtwtgcttcaaattgctttctccccaatctaggrttggggaggaagattgatacaagttggcaattcttgcagctgttgcaaagtgcctgacacataataacatatgataggttcactgaataggaacacaggaattcattatattcatctctgtacttctgtatgtatttgagattttccataacaagaagttaaaaatatagtacttacatacacatataactccagaatccaaccacttcccatcacttccactgctatcaccttagtatgagccaccattatctttttcctggattactgttacaactctctaaaaagcccaagaacttctaccttccctactccacccctttagtctctttttctacacagcagccagaaggatcctttaaaaatctaaatctgatcacatcgcttatctgctcaaactgctgcaatggcttccattttcactcagaggaaaaagccaatgttcttacaatgacctgtaagaccctatatgatcagatgccctgttacctctccaacacgtggtcctgtttttcatgaaatatctgggggaagagtgtttcaagcagaggaaacaccctggagcaaagacaccaaggcagtagcaaacctggtaaatttgaagaacatagcctggaaagagtccccaaatcacccagagctgaccaaaaacaagaccaatgttcaggaaacacaggctgactcagctttcctaaaatttaggaatgatgtggtgaaaaagaatgggttttagaatcacagacttgcccaaattcttgtctgcccatttactgactaaaattcaagttctgattctctatttttctcatttgaaaaatggggwaaatgtaatgattttctgagcttgttgcaattgaggtattatgtataaaacatcgagtgtaatgcctggcatatacctggtactcaaatgtaacataaacatgtacccttctcctctagagaaaatggggcaaagtatatcctgagtagatgggaaaactmttttcttaaaatacctctcatggagtctgcgtgagagagtgagccttggcctggtagatgagaatacttagttccagtccagtctgtgacataactagctggggactttgggagagtctcttcatctctttggaatgtagtttaatcatctttaaaatgagaggattgaactagatctccaaattttctttcagtgctaagattctatgatgtctgaatracayttagtgattccttcctttcttaagcagcctttttggtgtgggtcacaggggacaggacattagaacaatggaaggtaggatgggaagagggaaatatttacattataaagtatggctggtttcatgggtgtatggcttgtgyrggctcagagggccctgtgcttggtttaatgctcttttcttactgtcctaaaattctcaatactttttgaacaacttctgcattttcattttacacagggccckgaaaattatgtggcttgtcctatttctatggattgactattaataagtacaaaagatattttcctatgagcaactagagagaatggtagcaagayatctcyaggcacctaaagaagggtgaatggatggatggaaaagatagttgcctgggataaaatggaagtgagataaggttatgtggtgatggggaagggaaaaaggaggtagatggtcacttcatcattaagaagtgcttctttaccttttgctacttgctttctctaaactatagtataagaatgccatctgctggccaaggatacagactctttcrgaggtttccaatgcagtgtctttgccgcatttcagtgtctagggagtgttccagaaaggtctgatataccgtagtctacactttaaaatgttaattattaaatgcttcttcagttccaaactccacactaaacaaagctaatacaaagactcctcttgaaccgatccactaaaactgctttcatttattgaacaaaaaataatttwaaaaaagcactatgtgccagacagcaagtatttaatgatgaacactattggtagagatatttaggtgattaagaatttcctcaaatggatacaaactctcaggctcatcttgggtctgaatcgaaataccaagaatagcatcatcatcttcagcattggatggtcatctagagtagggttatactctcactcagtgggtgctaatatgcagggtggtgtatattgccttcaggcccgatgaccaaccttcaagctattgtctggaacagattttactggagaattgactggaaaagaagagtatgcaagacagtggcagaagatgaaagtttgaagcaaatggtggaaatcaatrgtcatggataaagcatagtgttccagagggcttctctcatccatatatatcctcattgaagattccattagaatgatggattgcgagaagtcctccctgccatgtaatcaagatttccaggaatgaaagagggagcttaaacaattagtagttaggactgctgtgaaatgaaggagtagtagaactctgaaggaggacaggcaaggaagtgctccctaaatgtcagcccagtttcaaagccacatctctcagattacaggtagtgtaactgttcttatcaaatgattctggcacactcactatattcactggagaaaacacctgaaagtcaaagaacagtactcttcctaaacttgaaaacaaaatgtcttttaggtaaaggagtatatgctcaatgccytcactkggttttaatttagaaacttttaaacaagattttttttaaaaaaaggatactgaagggcatcattgtgacacagaacttcctctctttaacatatacttggaacagagaaacctcagtaaagatggaggttatttcacaatcccagtccagactgagtgtttgtcctgcatgttcccatggcacaaagtgttcaactccagcaataccattactctatattcaatctgcttgcctgcctcctctagtttgtgagctatatgagggcaaggatagggtcttatatctataccccacactgtatccctctaacacatagyaaatattaatgattgtaatttggggcatgctgggcagccccagcctcagaaagccagctttccccattctttcttaaacccagaagatctactgagggaataagtccttgttgttctttacaaacagataaacttattctgaaccagatcaccctagccatatctgattaggtcaaaaatggccacctgacccaagggcagtcaatttctatacttgagagcagccaatgataggagaactctgtccaagaccaataattctcattaattaaaaccaggtagggtctctgttgagaatttgacttcaatacacagagaaagtcattagctagtaatgatgggcaaaagttaagatacagatggaaaagcaaacaacagatgccatgaggtaaaagcagtcatgatgagttctagtaaacaaaaaccggatagaagaaaagaggggtgagataacatttttagatgtggaagtaatgaattcttgcttctggtggataaaaagataacttgttcagtataggctcctcgtattctgagtagccaagaatacatattcctttaaccaaatatgaaccaagcacctaccatgtgctaaatatgacatgagttttagtggtgaacaagacaaatctattttgttcccatggaactttgaatctgcttagcttagaatctagacatagaagacatattgaataagtaaaaattattgygataagtattataaaggagtaacggtaggctttcatagaaatatatgcratcttgaattatactttccattgaactatttttcataagatgcttaattgtacagactttcttgaattattaaagggcctaactcacacatcagactcctgtcatccttattttcatacaaattggctcctacacacaagggggatatcataaaatctaaataaatgctttatttataaaacatagcactaactcagatacagttaaatgcaactccttctaccactacaagttaacatttattaatacatggtgtttccaatgtgccaggtatttttcaaagtgctttataataccaattcatgttcatcatcacaacaaagtctatataataagaacaattattattagtctcattttacacatgagaaaactgaggcagagagaggttatataacttgcccaaggtcaacagccataagtygctgaaccaggatttggacccaagcagttgtcctagagtccaaattcaattttacttgatgtggttatgtaggtaaattttcattcgaaatatcrtccatcaaaatatatattaagcatgtcttatatgcaggcactatgtgccaggtgctgatctaggtgttacagctacaacaaagaacaagasagacaaaaatccctgtcatcatggaagggatacagataataaacaagagaatgaagtaaaatatatagtacattagatgatataagcgctattgagaaaaataaaaccagaaagagggatgtggagtgtcagaggtgagatcatgggtgcagttttaaatagggagtaagatagcactgaataggtaacatttgagcaacacttgaagggagtgagagaatgagccattctaagtatgttttagtcagaggcctggatttggatccttgagccagtgacagtcttaaagagccttggaattacactgagtgtttctgggctctgtaatatagtgagcctagggctggatacagtagctcacacctgcaatcccagctactcaggaggttgaggcaggaggatcccttgagcccaggaggtcaaggctgcagtgagccatgatcacgccactgcactccaggctggaagagactgtgtctcaaaaaaataaataaagagcctaattagcatagcctatgggggctcaaagttgctagctaaggaagaacagagtaatgtaacaaaataagcaatatgaaacaaacaatagactccttctatgttttgaattggaatttctgaagga

SEQ ID NO: 13350 - DNA, 57181 bp, Homo sapiens
  misc_feature (1)...(57181): n = A,T,C or G, or insertion/deletion polymorphism (see Tables 1-2)
ctgtgcagtggctcttgtcccttccggggactctggaagctaagtccctcgactgctgccccaagagctattggctcctgtggggtatggagcatctgagccagggcaggtcccgtcccatgtaagtgtcattccctgacacctgagctgtcacctaggggaggaggggacagaagggacagctcctaggtggccgagagggcagctcttgatgctgtcctgccagagtgctgcgtcccaggctcctgttcccctgagcatgccagagctgggtgtgccctatcctgtcttgagagtccacatttccttgagcctaagaggaaggccgcctggtgagcaggtattgatcttcctattccccacccacccgccaggaggccttctttgatctcctgatgagatcagatccctcctctctaacctctgggcttttttttttttttttttttctgacagagtttcgctcttgttgcccaggctggagtgcagtgacacagtcccggctcactacaacctccaccccctgggttcaagtgattctcctgtctcagcttcctgagtagctgggattacaggtgtgcgccaccatgccyggctaattttgtatttttagtagacagggttttaccatgttggccaagctggtatcgaactcctgacctcaggtgatccaccyacctcagcctcccaaagtgctgggattacagacatgagccaacgcgctcagcctgggctacttttttatgttactcatcataactgccattaaagcatgagttatagaaatatttttgttttgtcttatttttttgagacagagtctcactctgtcacccaggctgtagtgcagcggtgcaatcttggctcactgcaacctctgcctcctgggttcaagyrattgtcctgcctcaccctcccaagtagctgggattacaggtgcccaccagcatgcccagttaatttttgtatttttactagagatggggttttgccatattggccaggctgatctcgaactcccggcctcaagcaatccacccgcctcagcctcccaaagtgctgggattacaggtgtgagccactgtgcccggccagttatataaatctttattatagagccttgttccccacctcaaactccagkcccgggagagcaagcctcatctctgttgttcacagctgtattttcagttcccagctcagtgtgagtcacacagtgrgcactcttcaaagacttgctaagtggagaatttctatgtccagtcattcctggatcacttcttcacwccctcacgcagtcacaaagggagggctgcatktggaatttagcattcaacaggctggaagaggtccactgtgaccccagggttaaggcagatgtgaggctgccagagaaccaggttggtgtcacagaagcacrtgaaaggtctcacccttgtcatgccttcgtcaccctggattccattccttgtgtaggagcttacaaggcctgtgactttgggcaagttgctcaacttctctytgcctcrgtttctttagccatagratggggttagtaaatgttcatttcattgattctcgtctcacatttttttttcactctaatacttccaaaatcgagatgtctcttacatgtcttaatttaactggaagtggtattttccttggtgagagaataatagagagcaatttatccatagaattttttttaaagacagggtcttgctctgttgcccaggctagagtgcagtggcaccaacatggctcactgcagcctcaacctcctgtactcaattaatcctcccacctcagcctccccagtagctagctrggaccacaggcgcaccacaamcatgcctggctaattttttctttttttttccccccgaaatggattttgctcttgttgcccagactggaatgcaatggcttgatctgggctcactgcaacctctgcctcctgggtttaagcgattctcttgcctcagcctcccaagtagctgggattacaggtgcctgccaccatgcccrgctaatttttgtatttttggtagagacagggtttcaccatgttggccaggctggtctccacctcctgacctyaggtgatctgtccacctcggcctcccaaagtgctgggattayagrcgtgaggcacckcacccggccccctggctaattttttaaagtattttgtagagcttgggtcttactatgtcgcscgggctggtttcgaactcctgggatyaagcaatcctcccacctcagcctcccagagtggcgggattacaggcagaggccactgcacctggcctggcattagagggaatgaatatggtagtgcctgcttggtaccattcatggctgtgagcaccccgggaaaggataaggctgttcatttagcacagtgcctgyracatggtgagcactgggcagatgaccaccgttatctgtgttaatctggtgttttcgtgcatgttattcattattatgcctcccgtgctttagggatcttggaggattttcatttttgtcatctctgtggatcctcaaagagccctgagaggttggcctaagagactttactcacccacctcgcagacgygtgargtggggctcagtgggtggagaagccacctggggcatccctctgccccggcctccccactttacttctctccttctgcccacccgccaggtcctggctctgtccagcggctccagaaaggccagtgcggtgggtgatgtggtcaabctggtgtccgtrgacgtgcagcggctgaccgagagcgtcctctacctcaacgggctgtggctgcctctcgtctggatcgtggtctgcttcgtctatctctggcaggtatgcsagaggaggaagasgggatttgaacggagtcccccaccccctccttctccccctcctccttccccctcccacccttcctcctcctgacttagcattcaagaggctggaagaggtccgctgtgaccccagggttagggcaagtctgaggctgtgggagaaccaggttggtgtcagagaggcacatgaaaggttttacccttgttctgccttcatcaccctggattccattcctggtgtagaagctyataaggcttcctcccctctccctctgccccagcctcctcctcctgccctcctcctcttgcacccctccctgcaccctccctcctcctgcatctctcccaccttctgcccacgcaccccctcctcttcctgcaccccttccttttcctccttccccctcctcctcctcttcctctctcctgctccaccttcttcttcctttctgctcyctgtcatcttccctcccacttcttcccttctcccttcttctcctctaccgtcctccctctcttccctctgctcttccctctccttctcttccctttcttcttcctctcctcctttttctcctccccttccacccccatctcctccttctcctcctcctccaatcctgtctcaatttgcctactattgtctgatacgatgggaaaagtcctcaataaggatgaccttcacttgaccttgggcaggaagttcaccctctctgggcctcagtttcctctgtagaaagatgatgatgatgacgttgatacttccccatgtgctaytagggtacccagtaggcaagttaaccatgttttgaagttaccagtaaccctgaggcaccaccatagccactgtccacaaaacacaagaggagaacattttagggggaaaaattgctacttagtgttcaaaaaacacaaagtagccatcaggaaacaaccaaacaaaacaaacaaaacatttactttccaacttcattcctttaacgttgtggtataggattttcttttttwaaattaaaatcagactctgggccaggcacagtggctcatgcctataatctcagcaatttggggggtgaggtaggtggatcacttgaggccaggagttccagaccagcctggccaaccccgtctctactgaaagatacaaaaattagccgggcatagtggtgggtgcctataaccccatccactcaggaggctgaggcaggagaatcgcttgagccttggaggtggaagttgcagtgagctgagataatgccactgcactccagcctgggtgacagagtgagactctgtctccaacaaataaataaaagtaaaaataaaattagactctgtatcgggaactgcctaggctcaaatcctccttctgaccacttaycagttgtgaatctgtgtgcaaggaccctactctctctgtgcctcctgttcttgtctccaacgtgaggatcataattaacagtagcactcctgccccagaggggctgaggcattaaacragcccatatgtagaaagcacttaaaagggtgccrggcacacaactgyaccctgtaggtatttgtaatattatcattagttacttttccataaaggataagacagtagatgctttttacactggaggccacaccayctctcctgcaaatattcatctctgcccttggagtgcagaagtggctgtagaccayactaagcaaacaggcatggtattcctccaataaaactctatttatggatgctgacatttgaagtgcatatcattttcatatgtcgtgaaatagtatccttttgattttttttttttttttgagacagagtctcactgtgttgcccaggctttggtgcaatggcacaacttcggctcactgcaacctccacctcccaggttcaagcaattatccagcctcagcctcctgagtagctgggattacaggcgtgcaccacracatctggctaatttttgtatttttagtagaaactgggtttcaccatgttggctgggctggtcctgaactcctgacctcaggtgatctgcccacctcagcctcccaaagtgctgggattacgggcatgagccactgkgcctggccttgtaaaaactgttaatggcattttgattgtaattgctgaatattccaaaaaaaactckaatgctcatgcatatgattgtttttgctarggctaggggccaggactttttccagtgtcttcaccttgtattccagggccttgcaaacaataggcaggtgcttagcaattacaacataaggcactcagacagggcttcatgtgcagtacataaatgtcatcattaggaagaaagagagggagagaggaagaacrtgggaaaattcagggcaattgatcaggttgaccccaccgttgctaaaaatcagatgagaccaggcggggcacggtggctcacgcctgtaatcccagcactttgggaggtgaaggccggcagaacacttgaggtcaggagttcaagaccagcctggccaacatggcaaaaccctgtctctactgaaaatataaaaattagccgggcatggtggcatgtgcctgtaatcccagctactagagaggctgaggcaggagaatcacttgaacccgggaggtggaggttgcagtgagctgagatcacatcactgcactgcagcctggacgacagagtgagactccttctaaaaaaaaaaaaaaaaaaaaaaaaaaattagatgagaccaacaagatatccatagataatgsaccatgttactttgcttgtgtacttttcctgcctcttggtagacagttcctaacatcaccgtgaggtcttggtgaaggaggagtggacactgaggttgctacagtttaatgataccatttttcccccagacagagatgttcatcttctgctcacattccttgagtgtttttccaagccctgctgtgggctggtgtttaccctctgcgcccttctccattgagccactaggtagcgccattgccgcataaatgaaacaaactggcccaatgttagaaaatagtgttcccaggccaggtggggtggctcaaacctgtaatatcagcactttgggaggctgaggtgggtggatcacttgaggccaggagttcgagaccagcctgggcaacgtggtgaaaccccatctctactaaaaatacaaaaattagccgagtgacacatgcctgtaatcccagctactcaggaggctgagacaggagaatcgcttgggaagcagaggttgcagtgagccaagatcatgagactgcactccagcctgggtcacagaacaagaatccatctcaaaataaacaaacaaataaataaataaataaacatagtgttcctaaggactgagacgggaaactgaggcacacagactggagttggggtggggcttgtcaagagaatgggtccaaataacctgtgcagaaatctcagaaagtcacagcaacttaaaaatcatttattctaccccccacttccacattttcyagatatagaaaccaaagcygagagggggaagataaccatcccaaaatcaccacgttggtgggggagcagggttgccagagaaaacacaggacattcagtgaagtgtgagtttcagacaaamggaagaatttctcagtgtatgtcccaaatatttcacgagacttagactaaaaccttattcactctttatcttcaaatgtaactgggcattctgtatgatgatttactaaatctgacaacccttgcgagggatgaaatgaagattaggaaaataattaaacgcaataagagaaaatgccaaatgagaacaactctattcccattttgcakacaagagaattgcacctaagggagatgacttgccccaaggccacactcaaaactctcagggtcaggatttgaaccaggtcccctgattccataggtctcaactttactgttgtggctgggaacaccccccagtcccactcgtgtgtgtgcacaatctgtcttgaatataactctctccctatcgtgtaagagggctgtttccctccctgacattgaaggaccccaccttcagcaggcatctcctgacacagcagaccccatgagcacagatccctgggacctggtggctgcccttatcagattccctgacatccccatcttaggacccaagtctgaccaccttcggggtctgcagctgtgttacagaaaaggggtcctgatccagatcccaaaagagggttcttggatctcgtgcaagaaagaatycagggcgagtccataaagtgaaagcaagtgtttgtttgtttgttttttgagacggagtctcactctgccacccaggctggagtgcagtggtgcgatcgtggctcactgtaagctccgcctcctgggttcaagctattctcctgcctcagcctctcgagtagctgggatcacaggtgcccaccaccacacctggctagtttttatatttttagtagagactgtgtttcactatgttggccaggctggtctcaaactcctgacctcaggtgatctgcccgcctccggcctcccaaagtgctggtattacaggcatgatccaccgtgcccggccaaaagcaagttttttagtaaagtaaagatctaaaagaatggctactccatagagagagcaacccagagggctgctggttgcccatttttatggttatttcttgatgatatgctaaacaaggggtggattattcatgcctttccttcttagaccatatagggtaacttcctgatgttgccatggcatttgtaaactgtcatggcrctggtggagtgtagcagtgaggatgacgggaggtcactctcgtagccatcttggttttggtgggatttggccrccttctttactgcaacctgttttatcaggaaggtctttgtgacctgtatcttgtgccgacctcctrtctcatcctgtgacttacaataccctaaccgtctgggaatgcagcccagtaggtctcagcctcattttacccagtccctattcaagatggagttgctctggttcacgtgcctctgagagctgggctcctcgggatctcctgacatcctgccccttctatccccagctcctrgggccctcygccctcactgccatcgctgtcttcctgagcctcctccctctgaatttcttcatctccaagaaaaggaaccaccatcaggtttggcttttgggaaagggacggaccaggcaggaagtagggaggaagccacaggtcctggtgtgggagatgsggaggggagagctgagtgcgagcccacgggtctggctttgttcttgtcgtctgtgagctgcccatcactcagacctgcaccccctccccctatcstctcaatggacagtggctccgtccctccaatgttcaggccacaggccctgggtcagttcaatgcctttttctctcacatcccatctgtcagcagatttgcttggcatcaccttcaaaatgcatccaaaatgtcacacttcccagcataggctctccraaccccatgatctctaacccaggtcacagcagcaagcccctggctcactccccgcctctgccctcagcctctctccactcccagccagaggagacctatgcaaaccaaatacgttgtacccctcctctactcagacccacagcggccccattttcctcagactgagccaaagaccccacagtggcccaccaggcccgccctgagctggccttattgcttccaacctcaccttctacccatctcccctccttccctgcctttccccacacatctcccatcctcaaacctgcccgatctcacacatccctgcaggccttcgctttagctgttccctccacctggatcaccctcactcccgaagatcctctgtcacctccctgcagtcagggcggcttccctcaccaccctccagcaaggaaatggcacgtccatccctcccctcccagcagcagcctctcctttgcctgccctgggattgtttttgcttttttccccccacagcacttcccacaacmtacagggtcctacaggaagcacccggcagggttgattgccttgttttccttaactggaagctttgcaacagcacaggccactgattgtggccaactcggcatctagttagtgcttggcaggcagaaggttctcagtaagtgtttgtgaactatggaagaaaggagggagggaagaaggaaaggaggagaggaagragggaggggaaggagagaaaaggagggaggraaggaaagataggaaaggggaggaaggacagagggaaggagggaaggaaagaattgagggmggaagagaaggaatgagggagagaaggaagaaaggggggagggagggaaggaaatraaagagggaagaaagcaaaggaaagaggaagaaaggagatagggaaggaaggaaagaaaaggcgggaaagagagagggagagatgggggatggagggaaggaacttatttcctctcttggcccagctgtcccagtgtccgtctgtcacctgggctgtttcttcagcctcctgcgtggactcctctaaaacattctaggctgggcacagtggctgacacctgtaatcccagcactttgggaggccacacctgtaatcccagcactttgggaggccgaggcaggcagatcacctgaggtcaggagttcaaaaccagcctggccaacatggcataaccctgcctccacaaaaaatayaaaatttagccgggcgtggtggcgggcgcctgtaatcccagctactcgggargctcaggcaggagaatcgcttgaacccaggaggcggaggttacagtgagccgagaccacaccactgcactccagcctgggcgacagaggaagactcrgtctcaaaaagtaaaaccttctccaggcagctgcccctctgatgatgcccccgccccatggtgaagcacargagaccctgaattcttctgcctgactttaaagtgccaagtgaccctgcccacacgstcctctggtcacactgagtgtcctctgagtcatgctattccctgtgcctgggttttagstgcccccgccacccccctaccccccagcccccaccccccacccccatctcaagcccctcccctccctcttctccagctccatccccccatcctctgcctgctcagcacgcacttcctggtcatttaagatttagctcaggctgtaatcccagcattttaggaggctgagggcagaggatcacttgagcccaggagctcgaggccaacctgggcaacatagtgagaccccaactccacaaaaaatgtaaaaggtaaaaaaaaaaaaagacgtagctcaggcatyaaccacctccaggtagccttcctgatggtgtcatacccaggtgggctcaggctgcctctgttctccgggcatcagaggcttcctccrtggggcacattatcccaggggcactcctgcagaagtccaggtacaggatgatggtggttggaccaggagtgagggtcaraggtgctgagaggcagacaggtttgggacgcagtttggtgagatgaatgggatttgctgaagggtggctgtcagggtgcagggaagarttctcarctgtccctgtcttcatctctctttttccctccgatcccaggaggagcaaatgaggcagaaggactcacgggcacggctcaccagctctatcctcaggaactcgaagaccatcaagttccatggctgggagggagcctttctggacagartcctgggcatcyraggccaggagctgggcgccttgcggacctccggcctcctcttctctgtgtcgctggtgtccttccaagtgtctacatttctggtgacgtcactctagtctctatgctgagcagcactggggaaggagtgcgggggtgggggcagggtgaggtaggtggagccccccagatcctaccaccccgtccatcaaaacccactcattctggatcctgttctctctgggtccctgctgtcttctacaagaactaattaatcatattattctagcaaaggtggcagtggctgataaagtctgctgaactctcagagagagttccaggcttctaccgatgtggggaggagggtacagatgcaggggggtggcagaggtagaatcctgggtcagagtgacttccctgatcctggccagcagatgtccatagccaccctgtcactggacgtgatccttgtcctgccattctgtaatttatttcatattgctgtcagaacaaccttcctaaaccacagttttaaaaaatttgatacgtaggctgggtgtggtggctcatgcctgtcgtcccaatactttgggaggccgaggtgggtggatcacctgaggtcaggagttcaagaccagcctggccaacatggcgaaaccctgtctctactaaaaatacaaaaattagctggttgcagtggcgggcgcctgtaatcccagctacttgggagtctgaggcaggagaatcacttgaacccaggaggcagaggttgcagtgagccgagatcatgccactgtactccagcctgggcgacagagcaagacttcatctcaaaaaaaaaaaaaagcaccacaaatggcaccaacacctagagccctcaagtgctgctcctgcctgcaactttagagtcatcttccaagggactctagaatcacaagttccaccacgtctagaacaacagggctaccaagatcaaaaactctgctgtcccccgatgcctggaacctagaggcattaggttctcccctaggttctagtgatgcctagagccrtggggctgcgcactcatcaccattagcaatgcgctgtgtctttagagagagccttatgtagcttatgactgcggagaggacatgtgttagcaggactgggagtgggatctacggagggaagcacatgyggacatggcgggtgggccacatggaccgtgcaggcaccacagcttgcccaggctgccctatccatgcttgcgtgtctcactgttgccccacgtgtcccccccaccccccaggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggtgaggtgggtgcaagggctggagccatcctgggagagtgcgtgggctacacctggctccagcttccctacccctgccatttgcagagragagggaagacagagtgggagggagagggatggtgtggagctggaaaagaggcggrtaggggcaagaacagaggygggcagagagtacagcaaatacatctggaaggggtcagcctttggagggcaatgtgcagacctttccacacacacctcagaacatgcatacttgtccatctgcccagcaattccacatacaagcaatcatgtcagttcccttttttatacaaagcgattttgtttctcttcctttgctatctctagtcctttcagcatggtgaaaacaagaaacggyggcatacctgagccatctccatgttttttattttttatttttatttatttatttatttgagatggagtctcactctgtcacccaggctggagtgcagtggtgcaatctcggctcactgcaagatctacctcgcagattcaagtgattctcctgccccagcctgccaagtagctgggaccacaggcatgcacaaccatgcccagctaatttttttttttttttttgtatttttagtagagatgagatttcaccatgttggccaggcaggtcttgaaccgctgacctcaggtgatctgcccaccttggcctcccaaagtgctgattacagacatgagccactgcacccagtcttatttatttatttattgtgtttttagtagagacagggtttcaccatgttggccaggccaggctggtcttgaacccccgacctcatgtaataagcccgcctcagcctcccaaagtgctaggattayaggcatgagccaccgcgcctrgccgccttatttatttatttatttatttatttatttatttwtttatatttattgagacagtgtctcactctgtcacccaggctggagtgcagtggcacgatctcagctcactgcatgctcaaactcctggactcaagtgatgcttctacctcccagcctcctgagtagctgggactacaggcatgggccaccacatccggctaatttttttaattttttgtagaaacaaagagtcttgctatgttccccaggtctccaactcctggcctcaagtgatcctcctgcacttggcttcccaaagtgctgggattaccggcatgagccgctgcacctggcctaatctctattttaacgactggtctctttcttccccaaagatgggtttgtgactgggagagagcgcccccaggtggacaacatttgaaattgttccacacaatggcttgataaccttattggaaaagccaccatcctcttcccagatcttgtctgcagaatggcagctggcttgcttcggtgtcactgatttgtaggatcgcagaggtgggagatcaccaccatcaaggtcaccactcgggttgcatcgtttcccatgaactagaaagctttgtcctcacgcytcctatgcacagagcttggtagacaggaagctbttgccacacatcttgagacaccgacacccaaaacctgagttctttgctcttcttgctgggtgacctgcggcttcggttttcctaggcccgggtgtcctttgaccgtctggtcaccttcctctgcctggaagaagttgaccctggtgycgtagactcaagttcctctggaagcggtgagtgctgagtctggcaggaggggtgtgggagggatgggggatgtgggggccaccccrgcccataatggcaagccagcatcagyactggrgggagatgggggctgcgggcaatggatgacacgtgcagatcacgccatctgcgtgtcacttggaaactggcaccgtgctgctcttctttctgctagccattcagcgaccactsactgagcgcccactttgtaccatcctgggtgtacaacagggaacactctaacacagtggtccccaagctttttggcaccagggactggttttgtggaagacagttttcccacggaccggggagaggcgcgtggttttgggatgattcaaacacattccatttattgtgccctttattattattacattgtactatataatgaaataattatacaactcaccataacgtagaaccagtgggagccctgagcttgctttccgtcaactagatggccccaaagcgggtgatgggagacagagatcatcaggcattagattcttataaggaacacgcaacccagattcctcacatgcacagttcacaagtgttcrtgctcctttgagaatctattgctgctgctgatttggcaggaggtggagctcaggcggtgatgggagtgatggggagtggctataaacacagatgacactctgctcacctgccctgcgctcacctcctgctgtatggcccagttcctaagaggctgcagactggtaccagtctgtggcctgggggttgaggactcctgctctaacagaccaggtccttgtcctcatgcagaaagtcccaggtaataagcatgacagcattttgatcaagctggaaaatagcagcatttcaagcaccattgcacgatgagacttaccaagctcaagttacctgggcttccccctccaccccatccttcttttatgccacgggccaagacaccctcccccttgttgcactgaagaacctgggcaaactgtgtacctggaaaacacccacatagtggtaagaagccgagcctgtggcattcaactgcccaggtccaaatcccagccccagcactgactagctgggtgatcctgacaagtagatcatctctctgagcttccgtgttcccatctccaaaatgggcatgttaatcgttatagcagctaattgtgacgatgaatttaattgatctgggctaagccatgagagctttgatttttagaaaatctttcaggcaattctaactacgtcttaaggatcaagaaycactaatctaattacacttgttatcacagtgaaataataataataattagtagtagtagcagtagtatttttgagacagtcttactccgtcatccaggctggagtgcagtggtgcaatcttggttcwctgcaacctccgcctcctgggttcaagcaattctcctgccttagcctctcaagtagctgtgattacaggcgcccaccaccacgcctggctaatttttgtattttttggtagaggcagggttttgccatgttggccaggctggtctcaaactcctgacctcaagtgatcctaccacctctgcttcctaaagtgctgggattacaggcatgagacactgtgccggccacagtgaaattaataacacccccttcactctgggaaggctgggatttgatgataatttatttcagaaattcactaaytttttccataaatgaccagattgtgcatattttaggcctgtgggccacacagtctctgtcacaactgctcaaagcatgaaatagagaaatgaatggatgtggccgtgttccaataaaactttatttataagaaaaggcagcaggcaggatttggtctctgggccacagtttgcctccccctggattatgtagccatgggacacrgacagaacaagaaccctgcggggtcacccasaagccagtgagtagcagggcaatttgttcagtgggagagatttcttcctgcagcctctgcccctgkgggggcgggggatggtgcctgggggcctctccratgcaraggcyggccaggtcaggggtctcctgtaaatggcctcttgtgccctgcagctgccgggaaggattgcatcacsatacamagtgccaccttcgcctggtcccaggaaagccctccctgcctccacaggtacagaacgacacccgtagtaaccagcctcatgtttttagggagaagatgcatggggctcctgctgcctcccacctgagaggtggtgtaggtttccagcctgggactggagggtgggttwggctgggctggggctctgccggggaggttctcaggatacatctctacctcctgaaggtggggacctgcacagcatagaccagtatctcctgcagacggggaccagggcatctgagcctcccccattagggggagacacccctgtgctcccaggctggccaagacgatgccaagggagggctggctgagaggagccccaaggttcagccctatcagctgtgctcacttctgtgcctcctgtatcagtccraggtcatgatcatctatagtctccaactctatcgcttggtctttgtggccaaaaatctcagacagccctgaaactccctaagaagagaaggaatatgccccaggtagtatttgtattggttgtcattcactcacttcatcgatagagcactaggtatgggccacgctctgttctaggtattggggatagggcgaaggaaacagacaagggccctgctctcgtggggtgacatgctgatagaggtgaggcccaaacagaaaaccagagcaagggaacagagtacgatggcatgtctagcgagggaaggctttgcattcaagccgagatcataaggaaggagtgtctgggagaagagctgttcttttttttttttttttttttttttttttgaaacrgagtcttgctctatcacgcgggctggagtgcaatggcatgatctcggctcactgcaacctccaccttccggattcaagcaattctcctgcctcagcctcccgagtagctgggattacaggcgcatgctaccacacccagctaatttttgtatttttagtagagatgggttttaccatgttcgtcaggctggtctccaactcctgacctcaagtgatccacctgcctcagttcccaaaggactaggattacaggcatgagccaccgtgcccggcctgggagaagaaccttctaggcggtgggaatggcatcagcaaaggtcctggggcaggagagtgcctggacctgggtttctcaacctcagcayggttgatattttgggctgaaactcctttgttgggggctgtcgtgtgcattgtgggatgtttagctgaccccagtctctacccactagatgccagcagcaccccctactggttgtgacatccaaaaatatctctagatcttgccaaatgactcctgggggatgcagtcaccccctggtgagaaccactggccttttgtgttcaagaaacagcaaggaggtcagcaaggccagggccgagcagctgaggcacagagcggaaggaggcgggagatgtcattcctgatcgtcaggactttagctttgaccctgagtgaaatgggagtgctggcgggtttagctgggaagtgtcacgatctgacttgggttttaacagatccctctggtcactgggtggaggatgggctgtgggacgtggacaggagtggggcgggaccaagagtagcgggagggagggaggaaagagcctatttatcgcaagagccaaggcaggaggccaggctggtgaaaccctcaggctatagtcaaccctgtgtgtgtgtgcgtggtgtgcatgtgtgcacacatgtatgcgtgtgagcatggattgattgggtatgtgcatgcacttgtgtgtgtgtggatgcgtgcccacattgtgttgctgtgcatgctagcatgcttgtatgagtgtgcaaatgtgcatgcatgtgtgcacgctttgtgtgcatgtgtacatgcacaratgtgcacaggatagttcctcaaatagctagacaaggactgggaaaaagaacagccccacaggtcctcttggagactcccagagcaggaaagctcagctccgtctggggctcatccttcctcacagaggcgggctgaaccctaaccaaggtcatgtctcccctcttgcgtgtccagaataaacctcacggtgccccagggctgtctgctggctgttgtcggtccagygggggcagggaagtcctccctgcygtccgccctccttggggagctgtcaaaggtggaggggttcgtgagcatygaggtgaggccacccccagcctgtctgctaggatgtccccatcctgaaagtcccacttcctcgctgccttcccaccctccccatcccagccaagttcactttcactcattctctcyacctctcacccaccactgagagcccagctcccactgctcctcaaaacctatcccacctctgtccccatcatcctcctgtgaccaaagtaagttgtgttttagggtgctgtggcctacgtgccccaggaggcctgggtgcagaacacctctgtggtagagaatgtgtgcttcgggcaggagctggacccaccctggctggagaragtwctagaagcctgtgccctgcagccagatgtggacagcttccctgagggartccacacttcaattggggagyaggtgagagtttgggggtctttttgggacagggagacattgcagttgggagtcatttgggtccccgactcatcatgggcagtatgatggagaaatgagaggaatggttagggaagtagcggagaaaaagggctcagctcagcgtcaagcacgtgctaggtgctcaatacgtaatcactaattgataagcagaaatagacacaaagagagaggcagggagttgtggcagggattggcagtgaggagctctctgacaactgagagtgagaagacctagactcctgtcttactctgccctgccttgctgagtaatgttggtgtaattgcttcccctctctgggcctcaccaaggggtctggacagagatgtccaagaaacaggatatatgcatctggagctatggattgggcaggggttggcaaactgtgaccccaagccaaatccagcccaccacttgtggttttgttttttgttttgttttggagacagagtcttgctctgttgcacaggctggcatgcagtgatgcaatctcggctcactgcaacctccgcctcccacgttcaagcaattctcacacctcagcctcctgagtagctggaattacaggcacatgccaccatacctggctaatttttatatttttagtagagacagggtttcaccatgttggccaggctggtctcaaactccggacctcaggtgatctccccatttacctcagagacaaagcccaagtcatgacaatccctggcaaggtccctgtgacctggctctggtatccattagccccatctcccatcatcacctctcagctttactgcagccaccttagtctctgtgatattccctgatcccccayagcacactctggccccagggcctttgcactgctgttccctctgctggaaagctctccccaggagtcyccagggctcatccctcacttctatcaccttcacagagaggcctttcctgaccaccttatctaccaccacagccaccctactattgttagtgcaccctacacctgcacctgctttttctytttttcttttttttttttctgagacggagtctcgctctgttgcccaggctggagtgcagtggcacaatcttggctcactgtaacctccacctcctgagttcaagcattcctcccacctcagcctcatgagtagttcaagcaatcctcccacctcagcctcatgagtagctagaattacagccatgtaccaccayaactggctaatttttttttgtacttttagtagagatggggtttcaccatgttggccaggctggtcttgaacttctgacctcaagtgatccacccagctccgcctcccaaagtgctgggattacaggcgtgagcccctgaacctggctccccctgctttactatttattcttcatagcactttccacctgatgtgctgtctgccttacttgtttatggattgcctgtctctgtccccttcatgagaatgatggatccattaagagagcagcaactttgttttgctcattgctgtttctccagagcctagaaccatgcctggtttatgataacgaggcagtggttattagtggaatgactgaatgtaagaatgaatgaatggctgggtacggtggctcatgcctgtaatcccagcactttgggaagccaaggcgggagggttgcttgaggtcaggagtttgagaccagcctggccaacatggtgaagccccatctctactaaaaatacaaaaattagccaggcatggtggcgtacctgtaatcccagctacttgggaggctgaggcaggagaatcgcttgaacccagtaggcagaggttgcagtgagccgagatcaagccattgcactccagcctgggtgtcagagtggaactccatctcaaaaataaataaaaataagttttaaaagaatgaatgaaagacaagaaggcctagatagaaggaataagttaaagtaatcaatagtgcacaagggaaattatagttaatgatcatttacttgtatatttcaagatagctagaagagaaggatggttgtgttcscaatacaaaagataaatatttgaggtgatgactatctcagttaccctgatttgatcattacatattgtctacagcaggggtccccaacccccgggccatggatcagcaccagtctgtggcctgttaggaactgggcaggcagcacagcaggaggtgggcagagggcaggcgagtgaggtttcatctgtatttacagccattccttattgttcccatcaccgcctgagctccacctcctgtcagatcagtggcagcattagattctcataggagcacaaaccctactgtaaactgcacatgtgagggatcttatgagaatctaatgcctgatgatctgtcactgcctcccatcatccccagaagggactatctagtttcaggaaaacaagctcagggctcccactgatactgcatgatggtgagtcattatatattacaatgcaataataatacaagtaggccgggcgcagtggctcacgcctgtaatcccagcactttgggaggccaaggtgggyggatcacctgagggcaggagttcgagaccagcctggccaccatggtgaaaccccatctctactaaaaatacagaaactagccaggcgtggtagtgggtgcctgtaattccagctactcaggaggctgaggcaggagaattgcttgaacccaggaggcagaggttgcagtgagtcaagatcatgccattgcactcccagcctgggtgacaagagcaaaactccatctcaataataacaacgacaacagcagtaataataataatagaagtgcacaatcaacgtaatgtgcttgaatcgtcctgaaaccatcccccggrccatccccctgcccccaggtccatggaaaaatcgtcttctacaaaactggtccctggtgccaaaaaggctggggaccactgccctacaggtatccaaataccacttgtgcccctcgaatagttacaactattacatatcaatgaaaactaaaagaaaacaattaaaatttaaaatamaaaagtaggactgaaaagctgccactggatgagggaatagggaaatggatggtggtctcagtggagaaagggaaacaagagttggactcaaagagatagagagagtgagcaggaggagacagagtggattgggaagtgtaggtaactcctccaggaagcgtgcttgggaagtggagaagtgaggtcgggtaaggatggaggcattgttggcttgagagcgagtgccttggaagctgggcctgtccccagggaataggcatgttgagctgtacctcaccctgatgggcaggtgtgccctgacctgccacagcctgggcaccccagtttcaccctgtagatgctgactcaggccactgttccttttgtggccacagggcatgaatctctccggaggccagaagcagcggctgagcctggcccrggmtgtatamagaaaggcagctgtgtacctgctggatgaccccctggcggccctggatgcccacgttggccagcatgtcttcaaccaggtcattgggcctggtggrctactccagggaacagtaagtttgggaacatgtgtcagacagtacagggcaaaggcagaggaagcacttagcatccagtcctaacccaagtttatctcacctcccccttccacttgagtccaatttcctctttgtattggtcagcttttgctgtgacaatgytatgtaacaaacaacccccagatcccagcagcttacaacagcaggtgtttcttccttatggatctgtgatttaactactacagctttgccttggatgattggccagggtcagatgtactccttgtcttcttgttttgagacacaggctaagggagtcccctctgtttctctatttggatatgctgtttacaagaaaggcggcaggagcacaagaaggggagctgtccccactctgagtccagggacaatacccccaccccaacccccagctcaggaggctggccaagcacatgtgtgtaacttttttctttttcttttttttttgagatggagtctcgctctgtctttcagtctggagggcagtggtgcgatctccgctcactggaagctccggctcccgggttcacgccattctcctgcctcagcctcccgagtagctgggactacaggtgcccgccaccacgcccagctaattttttgtatttttagtagagaaagggtttcaccatgttggccaggctggtctcgaactcctgacctcaggtgatccatctgcctcggcctcccaaagtgctgggattacaggcatgagccactgcgctcggccgtacattttttttttctttctttctctctctctctctttccttccttcctttgtttcttttcttttcttctttcttttcttctctttctttctttcctttcttgacagagtcttgctctgtcacccaggatggagtgctgtggtccaatctcrcctcactgcaagctccacctcccaggtttaagtgattctcttgccttagcctccaaagtagctgagactacaggtgtgcgccacctcacctagctaatttttgtatttttagtagagatrgggcttagccgtgtcagccaggctggtctcgaacttctggcctcaagtgatccacatgctttggcttcccaaagtgttgggattacaggcatgagccactgcacccggccacatgtgtgtaacttctaccccttccctgcccagacacggattctcgtgacgcacgcactccacatcctgccccaggctgattggatcatagtgctggcaaatggggcyatcgcagagatgggttcctaccaggagcttctgcagaggaagggggccctcrtgtgtcttctggatcaagccagacagccaggagatagaggagaaggaggtactaggtgggctttgctgattctccaggcctggctcctgccacccttgggggaaaaggctcgaagggtcctactggcatgaatggagtgctctggccacaccctgtctgcaggcctaggcctggaagcagacagctctcttaataggtcacctttctccaagaatagccgataacatcatccatgagccaggggttgtgctaagtgcttctgtaaaaaatacactatttcatttgattctcacacatgccccagaggcatgtgaagttattgctgtcattttacagatgagcaaactgaggcaaagagagttaaatcacttgcccaaggtcacaagattagaacttgagtatgtccagctccagagtctatgcttgcagttgctatggagacagcccaagaargactttgatgcctagcaagctacaccrtgctagctagggtttctaataatccaraaaaacagtgtgctggatacatggcaaggttctggaagtaaagttgccaagccaagctcactcacaatgactgaaaagtagcaactaacagcacatcacagaggttagctcatttaatcaacataatgcccctgtgaggctggtactagaatcatttccatttcacagatgaggaaactgaggcccagaagttaaggaactagtcccaggttacatggcttgtaagtggcagcactgggatttgaacccaagcaacttgattccagagaatgtgttttttaattgctaccctctacactatcccttcatgacaaagcaaggattcacatccaggtctccctcaatctcaggctttgcttcttctgagaacatctgcttagcactggcccaacctggttaaaaccttaagtgttgattcacaatgtcacagtcctgaagcttgaagatagaacttgcctgtttgtgttggtcagcttttgctgtgatgatgctgtgtaacaaatagccccccaaatcctagcagcttacagtagcagttacttgttgcttacaggtctgtggttaaactactacagatttgctttcagttactggccacacctgggggatagtggtggggaggtgtccttcctaggggagatggtacctgagggtaggtgagagttagccagaaaaragcattccagacacaaggaactgcttgagcaaggctgttgggkgaaacagaggtaacttgactttgtacagtgttaaatgctgtttttccaacctcaagttcatagtaggtgctcagttatcactgaytgaagaaatgaatgagtgagtgaatgcctgaaggatgttcctggaagaactcagagtggggtgttgagagaggttgctggagaygtggcaggagccagatcaggggaaatggatggtcagagcggttaaggccacatagtcagtgggtgtcaaagtgggtatctgggccgtgttgcgtgacaggactctcttgaccttgcagaaacagaacctgggaccagcaccaaggaccccagaggcacctctgcaggcaggaggcccgagcttagacgcgagaggtgagtccaccatggtgccacactcagaagggcacaggctgaagctgaagtagctgaagggaccacccgcatctcgggcagttaggcgggcaaccaaaaccattatggatagagaacctgctgaagtccccccatggtgccctgctgagggataatttaccaaaattggtccagttagccaagatgattaggccccyataaggccagttcatggaatgaacaatatgccttccaattgatggatgtcttcaagtgggccgaggccagcttgctggagttgtctgaatgctgcagtagggcaggactggttcctccccatagctgtaaaccaccatgccaggccyggccacttatgctttgacaggctggctatgcacagggcttgggtctgtatgcacagcatcacttgacgctggccagaacacgtgggcaaggggccaggaggaggcctccggtcccctcttttctcagctccctccagccaggacacagctgggytcactgtggagctgtckgcagcagaaggacctgctgcctgatactctcccctcttaatgagaggggtcttgggaagcagaacaacaggccactgataccagatggcctgagcttaagtgcctgctatacaggggtggtgggcggcagcgatcttgaggggcctcagtccccagggaccattggggctgacccccatcccagctagccaccctgagggcacttctcaatcacacacacactgagaaatcccaccaccttcacagcgcacaagaatctgaagtaagatcagatggataggtagtcatgttaaaagaaaaccagtagacacattaaggctgggcacggtggctcacacctgtaatcccagcactttgggaaactgaagcgggtggatcactagytagaggtcaggagttcgagaccagcctggccaacatggtgaacccgtctctactaaaaataaaaaataagtaaattwaaaaaaaaaagccggcgtggtggcatgtgcctgtartcccagctactcgggaggctraggcasgagaatcacttgaacctcggaggcrgaggttgcagtgagccgagatygtgccaaattaacctctagcaaatttaatgtgtctgaggttttttgttttttgcgggggggggggggtttgagacagaatcttgctctgtcgcccaggtctggagtgcaatggcacaatctcggctcactgcaatccccgtctcccaggttcaagcgattctcatgcctcagtctcttgagtagctgggactacaggcacatgtgaccaggcccggctaatttttgtatttttagtagagacagggttttgccatgttgtccaggatggtctcaaactcctgacttcaggtgttccacctgcctcagcctcccaaagtgctgggattacacgcgtgagccactgcacctggctaacagaggttaactaagcaaagaatgatccgcacatcgggcagtccctgaaccagaatacgtccagagaggctctggtacagccacggggtcaaagattaayagacagaaaaaggaaggtgaaggacagaaaacagaagtgaggtacagaaacagccggattggttacagctcagcgtttgctttattggaacatggtttgaacggttggttgcctttgattggctgaaactcagtgattgacacaggagtaggttgcagtctgtttgagtccaattaggttacagttcactatgtacggggaaaacctttaggccaaacttaaaatatgtaaggaggcagctttgggctaacctcaatttaayagaaggtaggtagacatgtatatgtagatatacaggtatgtagatgaatggataaatggatggatggatagatagataatattcctatttttacagctgaggaaactgaggcacagaggttaagtcagccyactcatccacagataaaacattcaaagagtctttagcatctgaattgtgcataatttatattctgccagttggactgacaaatctgatggtatacagtaggaacaaaacaattgcacgaaagcttaagccaaaataaaaattctgagaacaggctgggcatggtggctcatgcctgtaatcccagcactttgggaggctgaggcaggtggattgcttgagctcaggagtttgagaccaacctgggcaatgcagcaagaccccatctcaaaaaaaaaaaaaaaagaaaattctgagaacagagttccaatggtgggcaagttaagttcatcctgtgaattggcatcagaagaatgggcttgcttgaccctggggtaatagatggcatttagctgggtaccatatgggaagaagggaagtgtgatatctggtcagtattctgttagataaatgaatgaatgaaagagtacagagtgtacccagagctcagtggctgtcagtgggcctgagggttaggcacatacaccccaccattgggagagatactgactttgtcttcatttcctctaaatgacaggtccatcaagtcagtccctgagaaggacbgtaccacttcagaagcccagacagaggttcctctggatgaccctgacagggcaggatggccagcaggaaaggacagcatccaatayggcagggtaaccaccagcttcacccacccctccccacccactgtgccacctccaggggcccaagtcytcccaccaaatgtagcacttggcagtgatactcacctttcttgagcacctactatgtgccagtagcattctagatgttcattttcttaatcctcacaaccaccctaaaaaatagatatgataggtctatttcagacataaagaaactgaattcttttaaaatttattttattttgattttgagaaagtggctcgctcactcacccaggctggaccgcagtgatgtaatcatagctcackgcagcctcgacctcctgggctcaagcaatcctcctacctcagtctctcaagtagctgggactacaggygtgtgccaccatgcccagctaatgtttgtattttcagtagagatgggttttgccatgttgcccaggttggtctggaactcctgggctcaagtgatcctctggcctctgcctcccaaagtgctggggttacaggtgtgagccactgtgcccagccaagaaactgaagtcttaaasagttaagagacttgtttgtgttttcatatctagcctgggacacaacctgggactcaaatctaggccaatctgagtctgaagcttacactgtttctcatcttctatactgctatgtatctccacccacctacttacccattccatcatccacctagatgctcatccacccacccacctatccatcccacccactcatttatccatcccatccattcacctacccactgatttatccatcccacccacccatttatccatcccatccactcatttatccatccatcccaccccctcatttattcatcccacccactcatttagccatcccacccactcatttatccatcccacccactcatttagccatcccacccactcatttatccatcccacccactcatttagccatcccacccacccatttatccatcccacccactcatttagccatcccacccactcatttatccatcccactcatttatgcatcccacctactcatttatccatcccaccctcccatttatccatcccatccacttatttatccatcccacccacccaaccactcatttatccatcccacccactcatttatccatgccacccacccacccattcatttatccatccatcccacctagtcatttatccatccctcccaccaactcatttatccatccccacccactcatttatccatccatcccaggcactcatttatcyrtccatcccayccactcatttatccatctatcccayccactcatttatctgtccaacccatccactcacccacctactcatttatccatcccattcgcttacccatccatctatcccacctaacaatacatccaaccattccctcacctatgcatctgtctgttcagctgttcatccattcattgatctttccatccattcatccactcattcacacacctacctacctacccacccgctcatttattcacccacctaccctctcatccatccagcaaacatgtacacaatacccactatgtgccaggctaagtctggtagagattagacactagtgaggatagacggagagtaaataattatgctaataagtaagctatgtccaataacaataagtgctataaagaaaataagaatgatcaggcgcagtggctcatgcctgtaatcccaacactttcagaggctgaggcaggaggattgcttgaggccaggagttcgaggctgcagtgagctatgatcatgtcactgcaatccagcctgggtgacagagtgagaccctgcctcttaaaagaaagaatgatgaaatagagaccactgagaaaccmtaccatggttggtatggacaggatgctctgagaagtgacatttgagcttccccaaagaatgtgtgaaggaaycartcatacaaagggcaggagaaagagcgctccaggcagagagagcagcaggtgcaatggctccgaggtgggaagtagcttagggtgccagagaaaggggtcccatgaggctggcaggcagtgagtgggggcgagataagaagcttggaatttctttctttctttctttctttyyyttttttttttttttttttttttgagacagagtttcrctcttgtcgcccagagaagagtgtaatggygcaatctcagctcactgcaacctccacctcctggcttcaaacgattctcttgccttagcctctcgagtagctgggactacaggtgcctgccaccacacgtggctaatttttgtatttttagtagagacggggtttcactacgttggtccaggctggtctcaaactcctgagctcaggtgacacacccgccttggcctcccaaagtgcttacaggtatgagccacccctcctggctgggatttcttctaagagcaagagatagccatggacaggccaacgacaagatataattagattaatgttttcaacagtcccgyctggctgcagctgtgcagagaacttcagatttgtaggagcaggaccttaagccagtggctgaacctctctgtgcctcagtttccttatctgtgaaatggaggttgttataaggagagacacatgcctgacctatggtgggtgttcaagaaaacccttctagctgggtgtggtggctcacacctgtaatccaagcactttggaaggccgaggagggaggatcrcttgaggccaggagtctgagactagcctgggcaacacagcgagaytccatctctttaaaactatgaaaattaacaaaacatggtggtacaaacctmtagtcctgactactcgggaggctgaggcggggggattacttgagcctaggagttcaaggctgcagtgagccatgatcatgccagtgtactccagcctgggtgacatgggcgacaaagcaagaccctgtcctcaaaaaaaaaaaaagaaaagaaaaaatattaatactagctccctggggattgtataggagatgggggttctaaggctggctggggcctgtcggggaaatggtgctyctggtgggaggcacagcgggagaaccrgtgaggtctgcgtggtggtcccatctgccatgggcatgttttctgggagcctcgcctggccttgcctcaacccacccctcccactgggggctctctctgcctccctctccctcatgtgtgctacaggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaaggtacgcctcacctgccctcctcatccctctcctcccagctgcaccaaggggtgctcaggactcctttaccccacccctccctgggtcaccctgtccccctggaacagtgtgcaaaacgtctggggtccaggcaaagatctgygtccttaagatgaggctggagggaacgggaaggacagggcacatccctccttttctggaagcttcagaacctctcccagtccctccccactagcggaaggcgtctgcaaggcctgcctgctggtggctttcagtgcctgcccccaaacctccagacagagccagaccctccctaacaaatgcatcaccgctatcactccttcttctcctcstcaaaaatggaaagacttcttcttgaaataattgtagattcacatgcagttctaggaaataaggcagccagctaccttgaacagtctgcccagtttctcccattggtgatattttgcaaactgatagtaaagtatcacacaaaggatcctgacacccatcaatccatggatctcaattatttatttatttatttatttgtttattttattttgagacagagtcttgctctgttgcccgggctggagkgcagtgctgccgtctcggctcactgcaacccccatctccgaggttcaagcagttctcctacctcagcttcctgagtagctggaagctgggattacaagtgtgcagcctggttaatttttgtatttttagtagagatggggtttcaccatgttggccaagctggtctcraactcctgacctcaaatgatctgcccgcctcggcctcccagagtgttgggattacaggtgtgagcccycgcacccggccctatggatctcattgtgatttccccagttttgcttgcacgtgggtgtgcgcatgtttgcctctgtgcagtcgtatccccwgttyagtctctcgcatccatcacgatggttgacagttgagatactgaacaacmccstcaccacgaggcgctctcgtgttgcccttttgcaaccacacccacccttctcctgcctcgcccaccctgtccccaacccctggttcttctccttttaatacgtggcctggctgaagggagtaacaggagtgcacatgtgagtttggcttcttatttatacacacacacacatatatatagactgggtctggctttgtcacccaggctggaatgcagtggcacgaactcrgctcactgcaacctctrcctcctgggctcaagcaatcctcccacctcagcctcccgagtagctgggactacatgcacatgccaccatgctggctaatttttgtttttgatagagacrgtttcgccgtgttgcccagsctggtctcaaactcctgggctcaggcaattcaggcaatcctccgcctcaamctcccaaagtgttgggatcacaggcatgagccaccasgcccggcctggtctcaaactcctgggctcaggcaatcctccgcctcaamctcccaaagtgttgggatcacaggcatgagccaccacgcccggcctggcttcatctttaaaggacagttgcctcgttttcatgttgattcgtcctcattcactgggtgacattggccacatcaccaaaatgctgtgagcctgtgacctcccctgtaaaatagggggcgccaggcctgaacttgaggactcttctagtcctaagaacctgtacacctactcaccacaactgcatgtacagtggaatactcaaggcgaatggttacttaaccaagaggaaattagggattctcagagtcagccgagccctggaattaacccaaatcctcatttgggtggcaaatagccctttcaaaatccttccacttccatccctcatttgatagctaagggcaagtcttactctcccctaaagatggagagatgggagctgagagagagaaattggttatgactctcgaatacaaagaataaaaaattcagctccaggccagatacrgtggctcatgcctgtaatcccagcactttgggaggccgaggcgggtggatcacttgaggtcaggagttcaagatcagcctggcgaacatggtgaaaccccgtctctactaaaaatacaaaaattagccaggcatggtgtcagtgtttgtaatcccagctacttgggaggctgaggaaggagaatcgcttgaacctgggaggtggrgtttgcagtgagcagagattgcaccactgcactccagcctgggtgacagagcaggactccgtctgaaaataaacaaattcagctccaattcaaagtgtttaagcaacaagagaattgattggctcttgggaccagtatccctagatttctggcttcagrtatggctggatgtaggggtccaaacaagaaatcgctttatttccctcctctgtgacagcttcctgtccagcttagctgctscccctggcagtaagatgatattccacrgctccagcttggctacctccaacaaccaagtaccacttttccaaaagttctagtgaagtcccaggtctccctgtcattggcctgacttgggttatgtgttcatccctgaaccaactgcagtggtttggattggccatggrtgaaatttgccccaccccagaggagaagttagccccaccccaggcatacagattagcactgggaggaaggatgtgcatttctctcacagggctactgccaaacaagttgccacaaacttgggagcccagcacaattgaaatttgttctgtcgcagttctgaggcctgaagtctaaaatcaaggtktcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgtttctcctractmagcctcctgagtagctaggactacaggtgcctgccaccacgcccagctaatttttgtatttttagtagagagtagggtttagtagggtttcaccgtgttgctcaggctggtctcgaactcctgacctcaggtgatccacccgccttggcctcccaaagtgctgtgattacaggcatgagccactgtgcccggcccctcgtggaggytctgatggagaatacrccccaggcttctctcctggtttctggtggtcgccggcagtcgctggcattccttggcttgtagatacaccctcccatctgtgtcrccatcttcatatctcctgctgtgtctctgagtatcctctagtattcttatataaatggcagtcactgaatttaggacccatcccaaatgaattttgggggacactcttcaacccattacatcaagaaacaagcagggtacaggcgcagtggctcatgcctgtcatctcagcactttgggaggccaaggcaggcagatcacttgatcccaggagttcgagaccagcctggacagcatagcaagatcccatctctacaaaaataccccaaattagccggcatggtggcgtacacctgtggtcccagctactcggagggtgaggcrggaggatcgcttgagtgcaggaggtcaaggctgcactgagccatcatcatgctactgcacttcaacatgggtgacagagtgagaccctgtctcaaaaaaatataataatcagggtggccaagccataagatgtccaccatggggtagcgggagagacctgcgcagggccccgtgggccgctcctgagggtctccagccctcatgctcttacctcctctccctccccagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcmtctacgctgggtttcaggtacggagaggtcagggaggcttccgggaccggctgaggtcaactcagccagtcccctgtctctggggaagactccatatatgaggtttcacccagctggacatctaggggctgttcctagaattcccagggacagggacactacagtctttctggtatctccactagtgtctgtctctaaatgttcacatcaaagttcttttttttagagagacagaatcttgctctcctgccaaggctgaagtgcaataggtgatcatagctccctgcagccttgaactcctgggttcaggtgatcctcctacctcagcctctcaagtagctgggactacaggcacgtgccaccatgactggctaatttttaaatttatttttgtaggacaagtgtcttcctgtgttgcccaggctggtctcgaattcctggccccaagtgatcctcccaccttggcctcccaaagttctgggattacagggcatgagcccctgtgccccacggcacagttaaatattaagggccagagcctttcacgygtaatgtttttatcctgccgtaatttcttcctctccaattatctggaagccaaaaaggcattgcaaggtctcaaaggctattatatgaagctagattctttcaattgctgggaccagcraccaactaaaattagcttaaccaaaagaatagaatttaatggcttatatttccttgggggcatgggcccagttgtcatcaggacacagtgactctctccatatcttcactcagtgcttctcaaagtgtgaccccaggaccagcagtagtatcacctggggactagttagcaaagtacattcttaggccccagcccaggactactkcctcagatactatgtgggtcggcccatgaatctaggttttaattaaccctccaagtaattctgatgtacacaaatgtttaggaaccactggcttacctctggtctaattttgtacacgctctctttccagggcaggtcttatggccactagctatcatatcatctcaccttagcaactcaacatgcaaaaaacgtttcttcagctcagtagtcatatattaatcccagggaaggttctgattggccctttgtggatcatgtgtccatctctgaactcgtcacagtaactgaatggatagtagattctgatacactaggctgcatcatgtgaccacctctctgatcaggtcccatgattgacagcaccccaacccagccctttcccacaggaaaccagaagtagaaaacatggtagtcagataaaaaccatggctagggctaggcatggtggytcacacatctaatcacagcactttgggaggctgaggtgggcagatcacttgaggtcaggagttcgagaccagcctggtcaacatggtgaaactccgtctactaaaaatacaaaaatttagccagtgtggtggcgcatgcttgtaatcccagcttcttgggaggatgaggcgggaggattgcttgagcccgggaggcagaggttgcagcgagctgagattgcaccacygcactccagcctgggtgacagagagagactccatctcaaaaaacaaacaacaaaacccatggctaccactgtccccgacaattgtcctaggtcttctctaagttcacttgactccgaggatgggctgtttctgtctcaagctttagagtcaagcaaagatgggtttaaatccaggctctatcacttactgtggcactcaggacagctgctgaatcccccgagccttggatgttctcaccactaactgatgaatgacgcgaatgctcactctgcaatgaatgagacactgtgtgaaaagcctggcacatacagttgggtgttcagcaaattcagttcctccctgcctgcctgtctgccagctgcacccaacctgcagctgcaaaccaaataacgaatattttctgcacatcacctggcatgtaacccttgggttacatgagtgaaactgacttggccaactgccttcattgccccttacagttttgttctcccactgaccagccgtaaatgaagtagtcggcctcagtgctgggaagtgagacacttaaactaaattggtggtttctcaaccctggctgtcccttagaatcatctggaaggctatttaaacagcaccaaagtcaaggtgacatttccagagattccgattcagtcattctggggtggggcattagaggtttttgaagctccccaggtgattttcaaaaaaaccatagaactctgattctgcaaggaaatgagaacccagagagggcaagcaactagcccaaggtcacacagtaagctgttaacagatcctggtctggaatcctgtacttggggctctctgtgcttctggaaactacctctctatgtctgtggcttctcctcttccctctcccatccatccttctcagagcctgtatgtggttagctcatgccagctgagacgcttggagtcagccagctactsgtctgtctgctcccacatggctgagaygttccagggcagcacagtggtcyvggcattcygaacccaggccccctttgtggctcagaacaatgctcgcgtagatgaaagccagaggatcagtttcccgygactggtggctgacaggtaggaagagccagggcagagaagaccttgcaattcatccatatccttagagggtgagacctgaggtcatattgtatggtagmgaggtcacccagagagtcagggacatagttgaggctagatcccacaggcagtctatcagttctcaccgtgggcagatggaacatgaccragagattctcaacagcaggtgggcggggggtacaggaagaagcttctgttgccaggcaactggatcaacctcttttgccttggtgataaagcagccatataagcatcctcagccatctttaggtactaagcaagaacaagaacacaagctttaagcacaaatagacacaggttcaaatcccagctctgccacttaccagctggttgatttcaggcaagttacataacctctctgagcctcatttgtcaaactgggatcgtgctcatggagtggatatgaggattaaatacagacactcataggtaagacctgtaacatgcttactgcatgcctggcactgttctgagcaatctatgtagattaatttatttaattctgctaacagcttcaccaggaagaaactgttctatagatgataaatcctaggcacagtgaggtttggaaacttgtccagggtctcacagctaatactggcagagccaggatttgaatccaagcagtctggtaccagagtgtggagagggtcaagtacacactaggtgctcaatacatgtgaagtcctttttcctttcatctcaggtccccagccagctggggctgtgtattagtccatcttcacactgctaaaaagaactacctgagactgagtaatttataaagaaaggaaggtttaattgactcagttccacgtggctggggaggcctcaggaaacttacaatcatggtggaaagggaagcaaggcacgtcttacatggcagcaggagagggagagcatgaggtgggaactgccgcatccttttacgccatatgatcttgtgagaactcactatctcgagaacaatatggggaaaactgcccccatgatccagtcacctcccaccagatccctccctccacatgtggggattacaatttgagatgagatttgggtggggacacagagccaaaccatggaggccatggttcaggccaggggaatggcaggtggacatggcttggcaaattccagggacagaaaagcagccacacagggatgctcttcagaacaccgagtgtaccccagaccctaaagtgggcttagttgagacaggacggtgtcatcttcctctactccctgagcctgggttgcatgtggaggccattgctgggacccctgtgtgtacaaagctggtgtgatgaccagtccttgtgcccagagaagcatctccctgcagatgagagtaaccactcaccctgctgycgcttccctttgcaggtggcttgcggccaatgtggagctcctggggaatggcctggtgtttgcagctgccacgtgtgctgtgctgagcaaagcccacctcagtgctggcctcgtgggcttctctgtctctgctgccctccaggtactccccacatccccaaactgggcttgagggacagacagaggcagagactgtyggacccctgctagtgggacctttgaagaccctgtrtccaaaccmmcatggtgtgtggagtccctccaccaaggagggacacgcagctctacaagagccagactcagctaaggtgaacttgcaaccttgggcaagagtctttccttgtggagtgtcagtgtgctccttggaaagacaggccagaaatcccactacttctgatgttataaagactagttgagacaaagcatatcctgtggaggacatttctagtgcattgttaacttttgttttgttttgaagacagagtctctctcttttactcaggctggagtgcagtggtgcaatctcggctcactgagaactctgcctcctgggttcaagcgattcttatgcctcagcctcccaagttgctggaattacaggcgtgagccactatgcctggctaatttttgttaactattaacagtatgtaatgtcagttcatgacatctaygaaaaaaatatatatatacactcataagcatttgttatggaggaggcattattctaagagctttatatgtttttgttcgttttggtttgttgttgttgctgtttgagacaggatctcattttgttgcctaggcttgagtrcagtggcatgatcttggctcacttcagcctccatctccaggctcaagggattctcccacctcactttcccaattagctgggactacaagcatgcaccaccatgcctggctaattttttttttttttttttttttttttttttggtagaaacagtttcaccatgttgcccaacctggtctcaaactctaggttcaagtggtctgcctgccccagcctcccaaaatgctgagattataggtgtgagccaccatgcccagctgttttgttttgagacaaggtctcactcttttgcccagactggagtgcagtggtgtgatcacagctcactgcagccttcaattcctgggttcaaacaatcttcctgcttagacttccaaaaagctgggattataggcatgagccactgtgcacaagaattttataaatattaactcacttaatactgcccacaaccccatcagagaagcactgttattatcctcattttacagtcaaggctgctaagcttaaggatgaagtaagaggctggagcatgttgggtggcagtgagggaactttcctactgcatccagaaaggcctctctgaggaggtgacttaggaggaagtgaggttaacagcaggaagaaaaggcctgggagttgaaggttcatccctggtgtgttagaggaacagcaagaagaygggtgtggctggaragggtgggtgaaggcaggggtgctgggagacaaggttggggatgggatggcagggctagagctgctaatggctcatagggaggagcttggagtggttytaagtgtcatgggaaattggtggccacccagtcgctgcgagaaagccgtcagaatggaatcagtgggcctgggtcctgctgtgtgtccttgggagggccacacaccctctctgatcctgtctactcacctgcatcaagccagtttgtacaagctgatgtctgagggcttctttttgctctgcatgctctggttctactgaaggaagagagggacctgttggttgtatccaaatcccaatcccctgggcccaggtcctcagactrtcccattcctgcctcccctctttactcccctgggtctggcctcccagaaaaggttgggaaaccaggggggctgttgcaagccctcaagtggccttgccaaacccagccagagaggctttcttgcaccaggtgacccagacactgcagtgggttgttcgcaactggacagacctagagaacagcatcgtgtcagtggagcggatgcaggactatgcctggacgcccaaggaggtgatgggcgggaggtggggagggggtcccagcaaggacatattgtggggggggcaatgggtccctgttgacatctgctacaggctttggagtttataccctcttctcccctcactcaacccccaccactataggtcagagtcacagacagggtggcagcagtggttaggagcataaggtttggagccaggccaaatcttggttcctttgcttctgagcttgaggaaagcaggtcacccatgggagtgcagggaaccacaaggaacagcattgcaacagcaacatagctgcaacatgatagtaacataatggcaacagcaacacaatggcaatattccagaacatgagagtaatgcaacagcaatgtaacagtaatgtaacagcaacataaccacaatattgcagtaccagaatagcaacatagcagtgtaatagtaacataatagagacattatagtaacatgatggcaacattccagcaatacaaccacaacatagcaatgtaatagtaacgtaatagcaacattttagtaacatgatagaaacaaaacagcaacatagcaatgcaatagtaacacaacagcaacatcataacatgacagcaacatcccagcaacacgactgtaacagagtaacagagtagcaacataacaatgtaacagtaacaaaacagcaacattatagtaacatgatggcaacattccagcaaaataactgaaattatagtaacggaatagcaacatggcaatgtaacagtaagaaaacagcaacattatagtaacatgatggcaaaattccagcaacataacagtagcattataaggacagaacagcaacatagcaacgcaacggtaacaaaacagcaacatgatataatgtgttagcaatataacagtaacattacagtaacagaacaaggaagaattaattagttgatgaatagggtagaagaaatkgtgagagatggacagatgaatggatggaatgggatggaagaatgagagatggagggatgggattggagatggatggatggatgcatggatggatggatgggtgggatggggtggataaaggataagagatggatggatgaatggatggatgggattgrgtggaagaaaggataagaacagcagcatagcactaatgtaacagtaacataacagygttgagtttactgggaggatcaaatgagatcctgcaaagaaatgatttaatagagtgcctggtccattgcaaacactcaatacatgtctgctgctcttattagccctatttcccagattggaaaaccaagactcaagggggtagaatgatctgttcaaggtcacgggmacagcaaaggcagtattggtcttcccactgcacagtcatgtcctttcacaaagacaaagagaaatgtctgctcccactatagaaaaagagattattttatmataaacagtggctaataataacaataaaatagactaaaagtagccaccaccatctgtttttagcattgacatagtccatgccctctcttgttgaattcccataacaaccctgtaaaacagcaataaatacgtccattttgcggaagagaaaactgaagctgatagaggtgggccatcttgtgtgaagtcttagaggaaggctcctctgactcagtttcccctcctgctccaggctccctggaggctgcccacatgtgcagctcagcccccctggcctcagggcgggcagatcgagttccnggactttgggctaagataccgacctgagctcccgctggctgtgcagggcgtgtccttcaagatccacrcaggagagaaggtgagtggttctctcacaatgtcttcttcatggagtttaggccaaaggactccagggacaaggccctaaaccctgggcaccagcyacctccacagtgtccccacctcaggtcccctagctttcagacccattaccccctaaaatgaactcctcaccttccccaaacctgcttccatctggtgacttcctcatccaccttggtgtccccagatgaggaagcaactccgtgacttccttcttcctttaacattaacccagcacctaatatgtgctgggcagtgtgttaaatgctccaggtacattttccagtttgcacaaatgggatatttgctttcagctgggagacattgggaaaagcacttcatagctcagtctcagttttcccatctgtaaattgggactggtaatactgatctctgagttgttgtgaagtttgagttaatacatagaacatgcttagctcatagaaagtgctccagaaatgtttactaatgcttttattatttgcgttttcactctcacaacaacccytaagtgaggtgctagtactatcccattttacagatgcctcatcaggccccttcactgaatccctttcctccctccctctgaacctacagaggcttcctccctgtcctctccttgtcccctaaaaagcagtggatcctgtctcaccagctccaatctgctctcctgtgattttttttttttttttttttttgagacagagtctcactctgttgcccaggctggagtgcagtggtgtgaccttagatcactgcaacctccgcctcccagattcaagtgattctcctgcctcagcctcctgagtagctgggattacaggcacctgccaccacacccggctaatttttgtatttttagtagagacagggtttcaccatgttggccaggctgctatsaaacttctgacctcaatcacccccctcggcctcccaaagtgctgggactacaggcatgacccaccatgcccagccatcctgtgacctttatcagcatgaatgacactgcatgtcattcccctgctcaaaaccttctactagttccagcttcccttggggtaaagtgtgaattcctgagcttggcattcaaggctctacccaacccaggccctgccaacctccccctctcattcattgctctgccagggcttagccaacattgtggagcagctgcctctcggccaggggggcacatggtgctgtgagctccatgagcttctagttttggaaacccacttggtgtggtttacctggagtgttccccttccttgaactcctattgatccttcaagcttccatgcaagtatcccttcctccatgaggtcttctcttattacctctgtcaaatcccaggcagcatgagcagcactgccttgcttcccttaattgccagaggtccagaccttgataataaacagcattgttggctgggtgctgtggcttatacctgtaatcccagcactttaggaggccaaggtgggcagatcacttgaggccagaagtttgagaccagcctggccaacatggtgaaatcccgtgtctactaaaaatacaaaaattagccgagcatggtgacaggcacctgcagtcccagctactarggaggctgaggcaggagaattgcttgaacctgggaggtggaggttgcagtgagctgagatcgcaccactgcactccagcctgggcaatagagcaagactttatctcaaaaataaataaataaataaataaataawgcattgttcatcacactgtattacatttactcaattgcactgtttcctagaccggatgatgggcacactggagcaaggactctttaatttctatacttccggtgcctaaacaggtacttggcatacagtggggtgacccacatgtttccatcattaattaaacaaataatgttgaacccacaccatgtgtcagacactgaggatgcaatagtagcaagagagataaggatggagggtggataacagcatgggagatggataacagaatggacacatggataagatggaggatgaatggaaggatggatgagggaaggatggactggatggatggatgggagaaaataaatgaatgaaaggattagtgaattgatggatgaatagggaagaagaaacgagagacggatagacagatgaatggatggatgaatggaatggggtggaagagagatggagggatgggattgaggatggatgatggatggatggatggcaggatggggtggaaaaaaggataagggatggatggacggacagacagatggatgggatggggtagaaaaaaggatgasagatgatggagaggtgtaaatagaaggatgaggaaagatggaggaactaaaggaagggtggggagaaagatgggagagagatatcaggataagggaaagatagagaagaacacagatggaagactggatggattgatgggtggatatatagaaaggtagacagatggaaagagagatggaaggtagacctttacacaatgagggatggatagacagatctcgggtacagcagaaagatctccccaataaatgcccacaaaccctctggtcagagcaggcctttcctcccaaccccgggcaggtgggcatckttggcaggaycrgggcagggaagtcctccctggccagtgggctgctgyrgctccaggaggcagctgagrgtgggatctggatcgacggggtccccattgcccacgtggggctgcacacactgcgctccaggatcagcatcatcccccasgtgaggctggtggagggggtgggcaaagatgggaggcatggtgggaccyggctctgacccaccgcccctccccgccaggaccccatcctgttccctsgctctctgcggatgaacctcracctgctgcaggagcactcggacgaggctatctgggcagccctggagacggtgcagctcaaagccttggtggccagcctgcccggccagctgcagtacaagtgtgctgacygaggcraggacctgaggtatggtcgtcccaccatggctgggacctgcaggtgggagaggaggggatggccatgccctccccaagggccttcaggaaatgcctcccccgataggattatcactctgttacattaataaccacatgtctcttatctgcaattccaagctctgacacagtctctgaataccaaggttttcccccctaaattagcagttagtcttctatatttacttggtggcaaaacccaacctcaactgacacagggctactgatagcctttattgctcttgctcagtatttattttgctatgaaaatattgtttgatatcgggtggtaacctcaccactcactgggactataatataggatttttttttttggtaaatgtcaagtgtggactgggcacagtggctcatgcctgtaatcccagcacttcaggaggctgagagaggaggattgcttgagcccaggagttcgagactagtctgggcaacatagcaagaccctatctctgtggacaacagtattagccaggtatggtggcatgcacctgtagtcctagttacttgggaggctgaggtgggaagaacgcttgagccagggaggcgaaggttgcagtgagccgatattgcaccactgcactccatcctgggcttcgtctcaacaacaaaaagctgtgtggaaagatacacataaaatttactatctcaacctttttttttttttttctttttctttggagacagggtctggctctgtcattcaggctagagtgcagtggtgaggtcaaggctcgctgcaacctccacctcccaggctcaagcattcctcccacctcagcctcccgagtagctggggttacaggtgtgagccaccagggccaggtaatctttttattttttgtagagacagggtttcaccatgttgcccaggctacagtcgaacttgcgtaggcctcccaaagtgctgggattacaggtgtgagcagccacgccgggcccatctcacccatttttcagtgtatagttwctgtagtgttaggtacattcacactgttacacaacagaactacaactctgtacccatgaaaccctaactctccttgtcccctcccccagcgcccagccaccagcattctcctgtctctctgagtgtgactactctagacactgcatagacgcagaatcataggatctgtccttttgtgactggcttatttcacacagcatgatgtcttcaagggtcatccacatcgtagcatgtgtcagattctctacctttttaaggccgaataattttccactacatggatagaccacattttgcttatccgtttatctgccagtagatacccaggctgtttccacctcttggccgttttgaataatgccactatgaacataggtgtataggtatatgcctttagaaaaaccaaagtggctgggcgcggtggctcatgcctgtaatcctagcactatgggaggccgaggcgggtggatcacctgaggtcaggagttcaagaccagcctgaccaatatggtgaagccccgtctctactaaaaatacaaaaattagctgggtgtggcggcaggcgcctgtaatcccagttacgtgggaggctaagacactgagacaggagaatcgcttgaacccgggaggcagaggtttcagtgagccaagattgtgccactgcactccagcctgggtgacagagtaagactccgtctcaaaaaaaammaaaaaaaacctaaggtgttctggatttataaacccctctgaccctgagggtgtccgaagggcttgtggtaggcaataatttccagcactagagaggcagcgttgcttggtgggtaagagtatacacaggtgacagactgcctgggctcaaatccaggccccccaccccacacccccacccccgccccgccctgccacttactagctgtaggatcttaggcaacttatcttgtgtgcctcagtttcctcatctgtaaggtgggaataatagcacctacctaccttgcaaggattgaattatatgcacaaagttgttgaaacagtggcaggcatagagcaaagagtaaatactcattttagtcctgagtcacactcctgataacatcatttcacagagttggaattggaggcctggggcttgcctgacgtcacacagcttaaaagtagtgaggttgggacaagacccaggcactctaacgcctgcatgaccatagtaggttctgatcatgtaaaaggatgctgtttcatggaagggcttactgtgcaagacagccatgctggggccccaggggycagttcccacctgggtcaggggctcmctgggctcacaacctggaatctcaactcctccaccctccacgaagggtgctactccatgccaagggcttattctgtgacaagccyacacactttttttttttttttttttttttttgagacagagtcttgctctgtcgcccaggctggagtgcagtggcgcgatcttggctcacttgcaagctctgcctcccgggttcacaccattcttctgcctcagcctcctgagtacctgggactacaagcgcccgccaccacgcccggctaattttttgtatttttagtacatacagggtttcaccgtgttagccaggatggtctcgatctcctgatctcgtgatccgcccacctcagcctcccaaagtgctgggattacaggtgtgagccgccgtgccccgccacccacacacttttatgtgccatgtcgtcacgattcagygaggacggatccattaggagcacagactctggggtcagaggacttgggttcaaattatggacccaccactagccttgagaccttggtcaagccactgagcttctctgtatctgtgtcctcttctctcaaaagaagagaacaataatatctaccttggtggacattatgaggattgagtgaatatatacaagcacttagaatgtgtttggcacaaggtggaaactagaaatagaactggacatagccataaacaggccaggcacggtggatcacgcctggaatcccacccaggtgttgtacacatctgtatttaaggcccacgtgacaccagccttgaatgtcttargaagactgtagatttgattcttgaagcagcagtsagtcattgtaggtttgtttgcaacggcatgactgaagtgaaagctgtgctttcgctgttgggggaaatataaattagtacagtcactatggaaaatagtatgatgatttctcaaaaaacaaactagaaatagaactaccggggcgcagtggctcacgcctgtaatcccagcactttgggaggctgaggtaggtggatcacctgagagtttcaaacaagtcggacsaacatggtgaaaccccatctctactttaaaaatacaaaagccaggcatggtggcgcatgactgtaattccagctacttgggaggctgaggcaggaaaactgcttgaaccgggaggcagaagttgcagcgagctgagattgtgccattgcacgccagcctgggtggcagagcaagactccgtctcaaaaaaaaaaagaaaaacgaagaagaaaaaaagagccataaacagaaaaaagaaaatagccatttcacaggtggggaaactgaggcacaaagggtttgaatgacctgcctacagtcagcctgctcaaagatggcaggaacaggcttcctatcagttctgcagaccacagaccccagaccccatgtgtggggatgcctgaacacaggcacctcactcctgcactgcttcagggacctgtttctgggcacacccacacatcaccatgtgccgacaaacrcacgtcccagctaattgtcccaatcgttcccagcgtgggccagaaacagctcctgtgtctggcacgtgcccttctccgraagacccagatcctcaycctggacgaggctactgctgccgtggaccctggcacggagctgcagatgcaggccatgctcgggagctggtttgcacagtgcactgtgctgctcattgcccaccgcctgcgctccgtgatggactgtgcccggtaaggctcccgccccggcctgacctcacagcagccctgcagtggtgggggaaggaggcggaggcagtcctgggccactgggcttcgggttagagctggaggggtcctgaatggggccagagcgggaggaatgcccgggaacacatgccaagtgggaaagctgcccaaggacatgcgcccagcacacgcttccaacccagctgtgagggccagggagccgcatggaaagcaggacttctatggagaaaacctcagcgcagrcacactgggctctcacagctgccgagagcctgggctggtgtccaragagcctctctgtctccctctcccccacagggttctggtcatggacaaggggcaggtggcagagagcggcagcccggcccagctgctggcccagaagggcctgttttacagactggcccaggagtcaggcctggtctgagccaggaccctcaaccrtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccrgctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtactcctgtgtgtgtgtgtgtttattttgtcccatgcagttttatyacacatgtaggctcatgaatccacaccagggtgaggatacggaatagccaccaccattttccgaccacacccatcactctcgctcctgcccccagtgaccatgctctgttctccagttgtgtgtgtgtgtgtgtgtgtgtgtgtgtgtgtattttttttttttttttttttgagacagagtctcactctgttgctcaggctgragtgcagtggctcaatctcagctcactgcaacctccacatcctgggttcaagcaattctcctgcctcagcctcccgtgcagctgagattacaggcgtgcgccaccatgcctggctaacttgtgtaatttttattagatacgaggtttcagcatattggccaggctggtcttgaactcctggcctcatgtgatccaccctcctcggcctcccaaagtgttgggataacaggcgtgagctaccgcacctggccgagtttggtgtataattttaaagctcccccataggattccaatgtgcggccaggactgagaactacagccctcgcatctcctgctgctcctcctcccccaccagagatgagctccaaggacacaaaaaccaggtgcccccccatgccaagcatgggtcctctccacgcatgagaaagtcaaatatgcaagtttggtttccaaaacaaacaacagaggagccaagacttcacagccctcaatgggagaatttgcccgaggacttggttcttttttttttttttttttttttgtccgagacaaagtctcactctgtcacccaagccggagtgcaggggtgcaatcttgactcactgcaacctccacctcccgggctcaagcgattctcccacctcagcctctggagcagctgggattacaggcgcccaccaccacgcccagctgatttttgtatttttagtagagacggggtttcaccatgttggccaggctggtctcaaactcctgacctcaggtgatccgctggccttagcttcccaaagtgctgggattacaggcgtgagatactgtggctggcgggttcatttcctatatgtggttgctaaaaaccaaattccagctycctgggggcgccccagcacccgtcggaacacctggagtgtttctgttcacagttccgctccagatgctgctgacagccaaaggctggacccggctgagcgtggagaacttgctgtaaccaagggtggtcaatgcacagcttgttgcattcctcacacatttctttttttgttttttgagacagagtcttactctgtcacctaggctaaagtgcagtggcaagatctcggctcactgcaacctctgcctcccaggttcaagcgattctcctgctacagcctgccgggtagctgggattataggcacccaccaccacacctggctaattatttttgtatttttactagagacggggtttcaccatgttggccaggttggtcttgaactcctgacctcaggtgatctgcccacctcggcctccaaaagtgctgggattacaggcgtgaaccatcatgcccagcctcctcactcctctttctgacagcggtcagtatattaatactggactcaccaaaccagctgcaggcaccggaaaagagggactaagtctaaagtagccaagcctaaggccacacatagatcgctgggaagggcagcgtgagacattagacaactccctagatcctaacattatgtatgctagtcagggagtctcactgacctcgtggcattgccgcaagaatgacataatacatggatatgtgttcgtggaagcacagaaggcaatcccccaggctttctgaaccttattgacacgtggggccagatagttctgtgctgtggggacatgtcctgcacatcgtaggacgttcagcagcgcccctggcctcttcttcactagatgccaataacatcctccttctaccgccaccagacttgtgacactgccattaatcccccagggggtcaaagccacctagttgggccgggtgcagtggctcatgcctgtaatcccagtgctttgggaggcggaggcaggtgaatcacttgaggtcaggagttcgagaccagcctggacaacaaggtgaacccctggctctaccagacatacaaaaattagccgggtgtggtagcaggtgcctataatcccagctactctgaaggctgaggcaggagaatcgcctgaacccaggcagagaaggttgcagtgagccaagatcacaccactgcactccaggctgggtgacagagcaagactgtctgaaaaaacacaaaacaaaaagacccacttggttgagaatccccggtctaacctgccccgctgccatccatcatccacagatacttgagcagtggctttgctggtgtcaggggtggcagggcaagaactccaccttttcttaaggacacagggcctgctccgcccatcaggtcatgggactttctgatggcccatcctcacaggttttgtgatgccccttttggcctggagtaaacttctaactgcagcttctaccaccttcaaagtggggcaggaagtccgcattcttgacctgcccctagtcatgcctgcaaagctgtggacccacaactacctattcctagctccatttcacaggtgaggaaactgaggctcaaggggttgacatgacttgccaagttgacccagtcagtaaggacagagtggggatctgtttctgggtgtaataccaaagtcattgcacaggrcacatttgtcctttagagaaaggaagggcggcagatgcagcctgtcttctctggctggagctgagccacctgccttgcagagtgaccctaggcaggggctgccatgtgggcatttggcaaactcagctggggatgacccagggccaccagactctctttcctaggctgtgtgccagggagcagagggtgggccacaggcggccagcacgtgggaaccggcacctgccagcctgctaacgagactgctgttgggcccacaccacggcagtctggagacgcgccagaggggatgcccaggccattaatacccccgccatgggctgctgccagtagggtctggctggtgggtggaacacgaatttcatccatcaaggctgcagacttcctctctggtcagtgcctgcgcccagtagactctttaaaactcaacagtccacctcgccactgcaaacacgtaactacgtatacctgacactgctttaaatgcccgccacgcacgcattcagtggaccagaggaggaagccacctcactgggccccttactggaacgttttgatgaggaaggtactaccatcaggcccttttgacagatgagaaaacaaacagaatgagtggcatctctgcccaagcagtgtggcttcagagcccgtgtcctcaccatcagtcactcactctgtcacccaggctgragtgcagtggcgtgatcttggctcactgcaacctccacctcccagttcaagcaattcttatgcctcagtctcccaagtagctggaattacaggcactcgccaccacacctggctaatttttgtatttttagtagagacaggatttcaccatgttggccaggctggtctcgaactcctgacctcaggtgatctgcctgcctcggcctcccaaagtgctgggatgacaggcgtgagccaccgtgcccggccagtgcgtgttttcataaggtcactacagccaccaggttgaggacactgatgtgtgtgtggggggctgggggcaaaagcctcgagaccactgtggcagctgttgtagggatgcagggagaaagtggggtggctgggaccagcgtggtggcaatgggaggayggggagtggatagattctgggtgttttgcagaaaatcaaacaaatttgctgtaggacccgatggtgggtgtgaggacagatgaacagttcaacactggaaagcaccagccccctccttacgcctctctggtctggggggatcctttccaatgtggagagttctgcacagtgaggccagggccagcacgtagtaggtacaaaacagagcttccttccacagtacttccactcccctggatgaggagttatgcctcactctgcctcctcttcataaagtggattaaacttgaactcagccccggattccacctgagcatgcagctgccccaccccaagacactggcacagatgcacaccaggtggagctctctgggactgcttaggatctgacctgggattttaagactcagggtcaggctttgagatctaaacacatctcacatccctattaagattcccgctggtagatccaactactactcttttgaaatggagtctcggcttgctctgttgcccaggctggagtgcaatgacttgatttcagcccactgcaacctttatctcccacattcaagcaattctcytgtcagcctccccagtagctgggactacaggcatgtgccaccatgcccaactaatttttgtgtttttagtagagacggggtttcaccatgttgatcaggctggtcttgaactcctgacctcaggcaatccacccgcctcagcctcccaaagtcctgggattacaggcgtcagccactgcacccagcctcaactacttctaatttaacaaaaaaaaagtttttatatagaaagagttccactatgttgcctaggctggttttgaactcttcagctcaagcagtcctcctgtctcagcctctcaaagtgctgggattacaggcatgagccacctcgtctagccaatactgctaattctaatagtcacaacgtyaccagtttttcactgggcaccttcatactctgtggttcctaatgcaagccaatgacatcattcaggcatgagccaccatgcccggctggytgatactacctattctaatggttatgaccttactggcttttcactaggcaccttcacactctgcagtccctaatgcaagccaacagtttcaatggggcatgagtcactgcacccagacactactactcattctaatggtcaccacctcgccggctcttccctgagcacctttgtacaccacagtccctagtgcaagccaacaatttcaatcaggggacaggaaagcttgagggaacaatggcagtgctagaacgttctatctgcacatgtacttggtgcatggttttaggtgtggcagaaatggtgtgctccccaaatacagacattccttactgcccagactcacccagttcgaagttagaaaccgaacacactagtctgactactccgctatccaaaactccagaaccacatcagttaggaaagggagaaatccttctcttccacaggcaccgctccatttcccagctcccgcagtggttgggttggggccatgtgactcattttggccaatgggctgtgagtgggattaactgcgtcagttccggtttcagacacagaagagtgggtgagagtcgtccactctcccttctcccactgtggggacctggaggccaacccttgggaggccatgtcacaaaaccaggacagcctggatcacttgtcacagggaagtcacctaccctggagaggcagctgaccctcaccaagaactgcgtgagcaagaaataaagccttgygatcatttccgaagattttacggcgaatttgttactgcagcgcagcctcgcctctctggactaacataaagggattttcaggccaggtgcctgaaccccagcactttgggaggytcaggcaggaggatccccagagcccaggagtttaagaacaacctgggtaacatagcaagaccctgactctataaaaatttttaaaaattagctgggcacatgcctgtagtcccagctacccaggaggctgaggcaggaagattgcgtaagcccaggagtttgaggctgcagtgagctatgatcgtgccactgcacaccagcctgggcaacagagtg

SEQ ID NO: 13351 - DNA, 88116 bp, Homo sapiens
attgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccrcctcccgggttcaaccgattctcatgcctcagcctcctgagtagctaggattacaggcgcccaccaccatgcctggctaatttttgtgtttttagtagagacgggatattgccatgttggccaggctggtctcraactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccraggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcggrtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgyctgttctttaagacggagtcttgccctgtcgcctaggctagagtgcagtggtgtgatctcggctcactgcaaccgccacctccyggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccscttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgttttttttttkttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattmgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttytgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgaygttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaaygagaacacatggacacaggaaggggaacatcacactctggggactgttgtrgggtggggggaggggrgagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttwttattattattattattattactcttttctttttttgagatggagtcttgctctgtcacccaggctggagtgcagtggcaggatctctgctcactggaacctccacctcccgggttcaagagwttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaargaagagaaagaaggcagtgtggctgggacataagtgaatgagaggtggtagggtaagaaatgtgtagaaaactatgcaggggcctgatcacattggatcttgcacatctttttccaaacctcaggaggagtcattctgctkttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctcygcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcstatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatckctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatstttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttkttttttttttttttttgagtctcgctctgtcrcccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgscttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcrcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccasgcccagctaatttttgtatttttttttagtagagacggagtttcaccatattggccaggctggtctcgaactcctgccctcrtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagcygagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcrcaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcaycaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcytgcctcagcctcccgagtagctaggattacaggcatgcrccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatayattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggscaacatggtgaaaccccgtcactactaaaaatacaaaaattagctgggtgtggtgccgcatgcctgtagtcccagctactcggragactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaacmctgcaatgagggactccagaccccaggcccatgctcatctctggaagggcctgtgsggcagacgtgatctttgaactctttgtgcctctagtgggtggtgctttttgttttkttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgarattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgasctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgkgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcracatagcgagactctgtctctacaaaaaaataaaaayaaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacatygttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcastaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgyaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcrctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtrgctgggattatagacaacrcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgyagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggttttttttttttttgcttgttttttttaagtgtcgtggtctcactctgtggcctgggcgggagtgcagcggcgtgatcatagctyactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctygcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtckgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgygtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggygacagagctagactctgtctcaaaaacaaaacaaaacaaaaaacaacaaaaaaacaaaaaaagcacagatgttttttcttwtatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctyggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattstatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgcctttttttttttttttttttttttttttttttttgagactgggcctcgctccrttgcccagagtagagtgccrtggtgcaattacagctcactggagccttgacctcctggggcaagtgattctcccacctcagcctcctgagtgtctgggactataggcatgtgccactatacctggstaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtygcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctataygtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactygggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcakaaatgccactgaagggccaggcatggtgtccaacacctacaatcccarcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttcyacctgcttaagtgcatcttatgcctggcacaatgcctcatgcctgtaatctcagtaactcaggaggctgaggcgggaggatctcttgagcccaagagtttgagattgcagtgagctgtgattgtaccactgcasttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcrggtaaagagcccatgccccagaaggttaagggacttgkcccactctgtggcatctaggaagtttggggctgggacttgtgcccaggtgtgtctgacccttcgcacctcctggatccgyggtgctggagggatgctgcsgtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagrtggggtttcaccatgttggccaggctggtcttgaactcctgaccccaggygatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtsccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttytttttttttttttttttttttttgagccagaggtctcactctcgcccaggctgaagtggtatgatcatggcttactgcagcctcgacytactggattaatgtgattcttacacctcagcctcccaaagtgctgggattacaggcatragtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctrggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcratccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcayctggctaacttttgtattttaggtggagacrcagtcttgccatgtcgcccaggctggtatcaaattcctggactcaagtgatccgcccacctcggctgatcccawagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtakttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatgraactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcrgcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatstgtgttttttccttaactcgaaaaattaaggagcacttggaaactgccttctcttttggccgggtgctcatacctgtaatcccagtgctttgggaggccaaggtgggagattacttgagctcaggagtctgacaccagcccrggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccytttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggabtrsttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtaygatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagygatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggstgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcrtgacattgtgatccacccacctcggsctctcaaagtgctgggattacaggcgtgagccactgcaaccagcccttttttttctttttaaatctgtagaacctttgagaaactggcactaacttctagcccagactatgttcctgaaaccagccacccgatgggacagtrcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggygatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacrtggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctggggsttacaagcgttagcaatcatgcctggcctttttttttttttggagacagggtctcactctgtcacccaggctaractgcggtggtgtgatctcggctcactgcaacctccgcctcctgggctccagcratccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagcygccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcytcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcacygcagcctccgcctcctaggttcaagcgattctcttatctcagcttcccargtagctgggrctacaggagtgtgccactacacccactaattttgtatttttagtgagaaacggggtttcaccatgttggccatgctggtcttgaactcccggcctcaagtgatcctccygcctcagcctcccagagtgctggaattacaggcctgagccaccgtgcctggcccctgattggtcttgacaggtgtttttaatgtcccaagtctccgtaaatgtgggatggagcttctctcaraggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagatygcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccayggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcratggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaakatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaamaaaaaaacaccttttttttatagagacgggggtctctctcggctaggctggcctccaactcctggcctcaagtgattttcccatctcagcctcccaaagtgctgggattccaggtgtgagccactgtacccagccaccatytgacgttttgtggaaagtgtttgctgactcattggacaagaccttgtgttttmactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtractacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttsaatacaggggtagtaggggtggtggtggtggtggtggttgagacagggtctctgttgcccaggctggagtgcaatgatgcaattatagctcattgcagcctcgaagtcctgggytggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaavttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttkcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggrgctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagygctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacrtgcacactgccacgcctggctaatttttgtatttttagcagagatgggattttgccatgtgacccaggctggtcttgaactcctggcctcaaacgatccacctgtcttagcytctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagragaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtraccaattctttagtcaaaaggaacaactcggctgggcatggtggctcacacctgtaatctcagcactttgggaggctgaggcgggcggatcatgaggtcagsagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggygagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccactycaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagygcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggyatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcrtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcakgccccacgtgcttggctaatttttgtatttttagtacagatggkgttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcaccyggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagttycaccatgttggccaggctggtctcgaactcctgacctcaggtgatcagcccacctcagcctcccaaagtgctgggattacaggcgtgagccacygcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttktggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcwttagatatacatggaattctaaagcgccaagatkagttgagacctctcacctagygctggggagagatgaaaacaactaaggccgtgcagtggtccatgcctgtaatcccagcacgtggggaggctgaggcrggtggatcacaagatcaggagttcaagaccagcctgggcaacatggtgcaaccccrtctctactaaaaatataaaaataggccaaaaatagcttgaactgggaggcagaggttgcagtgagctgagatagtgctactgcactccagcctgggcaacagagcaagactctgcycaaaagagaactaagytgataccctggggcggtctagtggcaagcaggtttcgaggtgagggatcagcagaggagaggaagagggacaaccccmcaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttytgggagagtgatgggtgggggcgaggggaaccagcaactcttcacatacagttttttttttttttttttttttgagaccgagtctcactctgtcacccaggctggactgcaacctctctctcccggttttaagccattcttgtgcctcagcctcctgagtagctggractataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcmcggaggtaggrtgatgaggcagtgggagcttgtgcacrtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaaygattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttktgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacacttyaggtgcttgccctaggccaggaaccagcagggcactttgctgtgtttacgttcagttctcacaacatacctgcactgtaggcatcacasagcttgcttcttacaagccagaactgatgctggaagaggttccctgacttcactatgactcctgctgtccatcacccccctgcaaactgggttcggaactccacacscgcatacctggcctcctgctcgacctgctcctcyagctgtgcaatcttggcctccagcgccgcgatggtggayttgaacttggacttgacggccccctccatctcgtggagcttgctccggagctccttgttctgccgctcragctgctgccgggcactctcattcttctgggccgtgctgcgctctgtggccagctcgttgctgagctgctcggcctggggaggagagtgaaggccatgaggcggactcagggaagcccaagasagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaratcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagargtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcrtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcrgccatggtgggggcctctaccctcccccgccttaaaagatgcccmctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaakccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccrtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccarttcagctttgcacacccaccccttggattttctgcagttgaccacaaagaagttcccattgcacgagcatggctctcagttccaggtggctggtggtgcgctgggagcaccattctgggtgggctccacagamctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttyggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagctkcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctmcccggcagcacrcacctgtctctgcagttgcctcctyttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctrtgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcaytttgttggtccgctcgagttcctctttggcttccaaggcctcttcaagggcccgagccagggacagggccttggtttccttctccctggcttctgcctcagctctgtccctctcatccgcrtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccstcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatctyacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggcyttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcargctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcrtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatasaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagcyagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacattyagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtrggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcatamgcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgartggcccctgtccctggccccacagactctgagaagsgaagaccatgtctcctcgttggagaaacccaatagcaggggaagctgrggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcarctcctgcaaaagggatgcaaagaggtcccagggacctgccccgaggaaggccaccccccaggtcccctggatgatgtggcaggacactcacctgggtgtcctggagctgggaactgagggacgccaygtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaataccsgtgaggtatgggactctgataaaaaaaaaaaaaaacacacacacacacamaaaaaacagaatctgtggcttgaagggaactccrtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcytactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctcygcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgytgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgygttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagaygaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagmtttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgasactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgyggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagc

SEQ ID NO: 13352 - DNA, 32157 bp, Homo sapiens
aggacagtgagaggggaaagagaaaacctgaggagtgtcctggacattggggccttatgtcccccacaacacgggactgcctcttgggggttcttaagagtactcagtggtacagggaggctcctgaatggcttggagaataactgccttggtctgggcatcgtgtagtgcatccccaccccaggctgggcgcgcctccctctcaggtgtcagggaggagagctgtgtgcaggaagcccccttccacctcccccrgcctccctaaggggctcagagagagtggggtgtggatttggctggtgaatgggagtcccccactccatttctcactttgcctggggaggctccagcgttgcagcggtcccacttctgcttgctggagtccctaagtccctggccttgccgagggccttcccctatggaggtctttcccgttttggcattgcgcaaggcctgcagctgcctccctgaccagcctctgggttggacagtagagctgaggctttgggaaagaggaagcagcccctgatacgggatccttctctcttgagccggcagagccctggggagccagctgcaccaggagctcttggccgtccttcctgttctcctctccgcaggtccagcaccgccgcagccacttccttctgtggagcaggtacccctgtccctggtccctgggcccagagggtgagtggagcattaggagcggggctgggctgaaactggctgagcgggataggggcaggggtcgggggggggctccatctgggtgcgagtggtggaccccaaaccaacccaagtccaagacactaatcaaagatggactcaactgaaacccttccaccacccccaaatccttccaacctgcatcccaatcccagtcccgaccatcaccctgctctgaccctacctcagccccagccccagcccctrttccaaccttatctcaccctcacctcacttgcaccccaaccctaaccatttactcrtctcatctaatcccaaccatccatcatcccaaccctaaccacaactccgactctatcatcctcatctcaacccagcctccaccgtatcttaaccatcacctgcacccaactccaaccttcacccttacccccacccatcactcaacctcaatgtccaccccaatcccmgccttaatttgcttccagaattccaacctgatcatcaccctgacctcagccccagcccagcccaacgataatctctccttactctaaccccagcacaattccacttcatccatcaccacttcgtccgtccacaggagggcttctggtgctgtccagcacagtttggagagtgagcactccagccagaagcatttagagccagattaaggaatgaagtgtgaaatttctactgcccatgtcaaagccaataagcattagttatggattctatggctctgagaattaaacatttggcctgtgattggggatttccactattttgaccataatctgctccaggaattgcccatccgtaccctgactccctatctgtgggccagtaacctccagctggccatgtcaccctgtgttcttccttctctagcccaatggggaagttggggagaagccttggtgtcaggaaacagaaactgaatcctacacccgggcctagctgtccatagggaaactgcctctgccctttcttccccagctaaacttggcctctggaatcagaggtcagggacttggggccccagccaaccctccaagacctcctgaggcacttggtctcaaacaggcagcaaacgtgagtgcccactgtgtaccaggccagctcaagccaccctgatgcaacacataccaatagtaggagtggggatttaaaatcctgtcttcagagcacccaagacttggagacccaagtatgaacctcaggaacctcctgtctggggaacaatgatttccaaaagagtcacccaagggagggatggttcagggctgcagagctgcctgctccctgttgctggcacaccgccccctttcccgggacccgcaattccccctcgaccaccagggggcgctgcgtgctcactaggccacagctgcaacccaagttgcggggggcggggggcggggcactgtcccctcaactccaggctttcaaacagggacagagatctcctttctgagcggtccctgctctttctgtytccagaacagttatctgggctgaagctggcctttgtggtgacaggctgagccaataggctggaytccggtggggctgacccctttggggttagggccgggctaagcataggtggcctctacattatgtgatgggagtggtcctggaaagggtcctcccccgcgccctgttccagggtcgctgtgtccagaaccccaccattcttccatcaggttcacgattgcccttttcaggaccccaaatgggaggaacagggragctgggacaagatagctgccctggccatagcagagctgaccctgacatcccctgtggccagggacacatctgacccccagtgtgcccagcaggctgcttttcttcacggtgaggtgtccaggtcccagggccccagctatatcattctccagtggccaagaacctggtgtggaggctgggggtgcatcttcccagaagaggaggaggcctagggcttcctagagaactggagatgagcccttgggcctccataaatggccagatcagtccactccagcagcctgcgagagggctgggtcccctggggagcggtgtccttcctgtcccaatcccgccctgtactgtgccccctgctggggcaccttctgccttctgcagcaggctaagtcccacctggtcagcctgactggccctgggcctcggctcacccccttcccaggtgtgacccctggtagtcattggaatctgctgagcccagcccctgaggcggatgggctgggagctgggaggtcatgagtttcctgtccccacttccagcctcctcgttcacttggccaagtcagcatttaggaccagggaggattgcaaagttggcaacatgggtgtgtatgtggtgaaatatacataatgtaaaatttactgttttaactgtctttaagtgtacaccccatgacattaggtacatttgcaatattgtgtaaccatcaccactatttccagaactttttcattatmtgagagactcagcaatcattaaacattagctccccctccctgcagcccctggttacctctatcctattctactttcagtctctgaatatacgtagtctagatatttcatgtaattggaaccctacaatatttgcccttttgtgtctggctggtttcactgagcataatgttttcaaggttcacatatgttagaattcattcctccttatggccgattgatattccattgtatgtacataccacagtttgtttatccacakccattcactgatggacacttgacctgtttccaccttttagtggaatagtgctgccgtgaacattggtgtactctgttagagtccctgttttcagtacttttgggtatatacctaggagtggaattgctggatcatatggtaatcctatgttgactttttgaggaatgacccaattgttttccacagtgacggaaccattttatattcccaccagcaatacacaagaatttcaacttcgcatcctcaccaatatttattgttttctgtgttgctttgtttgtttgtgaatagccattctaacggatgtgaagtggtatctcactgtggtttggttttgatttgcatttcctaatgcctagtgatgttgagcatcttttcatgtccttatcagccagttatatatcttctttgaagaaatgtttattcaagtgttttgcccatttttggagttggatttcatggtttttttggtggttgttgttgttcattgtaggaattctttatatattctggatattagtcctttatcagataaatgatttacaaatattttctcccattctgtgggttgtcctccttttattcactctctggatagtgtcctttgattcatatcctttttttttttttttttttttgagacagaagagtctcactctgtcaccaggctggagtacagtggcgtgatcctggctcaccgtgacctccgcctcctgggttcaggtgattctcctgcctcagcctcccgagtagctaggactagaggtgcacaccaccacacccagctaattttgtatttttagtagagacggggtttcaccatgttggccaggatggtctcaatctcttgaccttgtgatctgcatgcctcagcctcccaaagtgctgggattacaggcgtgagccaccgcrcccagctgttgtttgttcttttcagacagggtcttgctctgtcacccaggctggagtgcagtggtgcaatcatggctcactgcagcctcgacccctcccctgggctcaagcgatcttcccacctcagcctccagagtagctgggaccacaggcctgttttttaatttttcgtagagacagagtmttgcagtattgcccaggctcgtcttgaactcctgggctaaagtgatcctcctgcctcagccwcccaaagtgttgggttcacaggcatgagccactgtgtctggccaagttttaaattttgatgaagtccaacttacctatttttttttttcgtgcttttaatttcatacttaagaaagcattgcctaatccaaggtcatgaagattttcacctgttttcttctaagagttttatagtttcacttatatgtgtttctggcatctcttccttttgggctcaggtctatggtaccccttagacactccctgaccaggggcactccatggttgagggcctgcctttttggatatggtacactccgcacacattgagctcatatttgyggggyatgtgttccacagcgctctcatgctacctttcaaacctagacttgccttgccacctccccactccaactctgaacctcagctctgaacccctaaagacctcacccctctcttagtcactaaggggtttgctgaatgcctggtaggctccgcactgctatggggcacatatcttcagttctaggtcctgagaaatgggctctcacaagctgtaaaaaacaaggcaaggaaaatagagatagctctggggtagctacaggaacctcaaaggagaagttccagctggaagccaaattcatgctgctccttgaaggttgaataaggtttcagcaggcaaagattatctgtggtggagatagagctgggcagctagggagcccttgagcagacagaactgcccccagagtgggtctgcggagagcagggaatggggacagagctgggggcaggaaatgaggacttttcacatctcacgggcaatggggagccacagaaggtttttgagcaggggagtgactgttaaaggcagcacttcggcaagttcagtaaagccccattatggtctatagttagtaaggcaggtggtaggagacaagcctcaggaagaaaccatcattctagctgggtgtcttggagtgagtaactgggcatctctgggctccagttcctgttggtttgggtggtggggagggggcagggaagwggggaagagggagaaacagctgttcatctgccttagggtggtatccttgaggggctgggaaakcagaacttgggatagggccaagggacacacaggcttttctgaggcaggccaccaagtgagggcattcctgggcacagcctgagctgggaacrtggcctcctggctctctgctggtgtctgactcagaggtctttaagagccctgccctcttattgggttggccagcagaggaggtggggacacaggctcggacttctagcaggtrctggggctaaagtgcccagaggtgtccctggaggcccctgtgagcccagccagcgcagtgcgcaccaccctcttaggcaacaggagcagcacaagaacctgctatgggcttcttgcccaagcttctcctcctggcctcattcttcccagcaggtaagctttgcgggcctagtgcctgtcttccagggtccarccttcataagtscagcccttggcagattagactatgcctgggtcacatgtttggttgctgaggtcaagggagggcccaatcgggcagtggccaggagctgggcaggaagctgccatctgtcttcgagccaccctaccaaacctctgagcagcctcgggcagtggactgacccctggggcactgagaagggctgctctaagtgtgcatttctcggggcagggcagaatttgggagcccagctggggcaccttctctggggcaggtcgcagggctctgtggcaccctgaggcytgtatcaccctcccctctgtccccctgccgttcttcccccaggccaggcytcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacaggtgataagtggggtrgcctggctgccccccgggagggattcccaagctgcttctggaccccttggctctcagccccagcccttgtcctgaatctaaccccagccagtctcagcctctgttccagccccggcgtaggcccaggcctggttctcccttgtattcacccaagtggggctggagtagaaagcgtctttccktcccctaaaagccccctccccagggctctctcctcagctggggtttccagggcgagggatctcaggggtggcaaaagcgggtcctgagcactgctgtctctgtcctcagaggagcccaggstgcccaccattgcctccccggtggagcttctcgagggcacagaggtggacttcaactgctccactccctacgtatgcctgcaggagcaggtcagactgcagtggcaaggccaggaccctgctcgmtctgtcaccttcaacagccagaagtttgagcccaccggygtcggccacctggagaccctccacatggccatgtcctggcaggaccacggccgkatcctgcgctgccagctctccrtggccaatcacagggctcagagcgagattcacctccaagtgaagtgtgagttgtctggggacacacccttgtggctgagcgcatctgttgctcctgacagaaaccagcccctctccagcccacagaaacggaacccttgctcctgatgcaaaaccaggctgctcctgggcctccagggtagggcaagtggagagacactgctgagccccaaggacttcgttaaatggttccctcmacctcctactgcttcgaaggggcttgtccttgaggccaggctgggcagagaaagggagacacaaagggttggggaacaggagctcccatgcagcttcagggttggcagcaagtgccccgggatttaccccrtgctggaggatgctggggaggtgggatttatccctttcctgcctggctctgttttctcagtctatgacgaagrtaacaatagatggttcctgtctcacagatttatgataaaaattaaaggagatgggccgggcgcggtggcttatgcctgtaatcccatcactttgggaggctgaggcgggtggatcacttgaggccagggattcaagaccagcttggccaacatggtgaaacctcgtctctactaaaaatacaaaaattagccgggtgtggtggcatatgcctgtaatcccasttactaaggaggctgaggcacyaggattgcttgaaccccgggggtggagttgtattgagttgtgattgtgccactgcactccagcctgggtgacagagtgagactgtgtctcaaacaaaaaacaacaacaacaacaaaaacaaataaaggagatgacccaggtcaaggatttagaagagtgcctggcacawattaaacacttgaggccggatacagtggctcacacctgtaaccccagtgctttgggaggccaaggcaggagaattgcttgaggcaaggagttcgagaccagcctgggcaacatagtgagaccctgtctctacaaaaaaaattaaaaaacaaaaattagctggatgtggtggcttgcacctgtagtcccagttcctcgggaggctgaggcaggaggatcacttgagcccaggagtttcaggctgcagtgagctatgattgtgcctctgcactccagcttggctgactgagccagatcctstttctaaaaaaataagaataaaacacttgaatacacagagagaggctttggaacaagatttaaggaaatgcagttctttgtgttgttggcctcttgcttacaaactgggtaactattttcagagctagtttgatgctgcctttggccccctcccamtaggtagttggtcccttaccaatagcttccacaggccactaaagctagcagtggggtacccatgaccctgtgtgtggagctcatcccaaatagagcaggagcaatggacagcattgggaagcagaaaactacagctggtggggyaggctggacgctggccaagcgtcacrtgatcagctctcaatgggcataggaatgcatcaggcgcagggggcgggaaagggacggacatgggcagacagagcatgccctgggtgaggattgaaggggactgctgttttatctgggcatacttccttaggactgagcttttaaaggggggcaagaagaagtgtgccatcctctgccctccccaagcaccttacccaataccccctactgtgacttgcagatgcccccargggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcmtggagcgatgctggcgtctacacctgccaagctgagaacggcgtgggctctttggtctcaccccccatcagcctccacatcttcagtgagttcttgggaaggttgcgtattggccagagaatagggaggarctcaggcctcagggacggaggggagacagggcagggcagggccagcaactggcataacccagtgcttcctggatgcaggtgtggagtcccagccctgccttaccatgagacaggtgacaatacccccacgaagggtggggtgtcagggggatcctggtgagcaggacaaagagatgcagagcactccaggaggctcccctgtagcagcaggcgggtggtgtaggatgtgcagagattgaggctgattggctgagacccggggactgtatggggctggggctggaagttggctgggaccccccakcactccctatgctgcccttgcagtggctgaggtccaggtgagcccagcaggtcccatcctggagaaccagacagtgacactagtctgcaacacacccaaygaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccgtaagaggccagggtggggtggcactggacacagtcagagcaggaccagatggtggagccccaaggaagggttggggtcctgggcatgggaacttcaaggccacttacctggaggtggccttgagctcatgtcccagctctgcacacctgggcaatgctttgacctccctagttccctcctattttatatttggaagtttaaacttatgaaaagttgcagagaaagacaaataatgattatatacctttaacctagatttcccatttattaacattttggcacatttgcttaatctttctcgctgtctacacagacacacacacgcacatacatacatataaatgtatggatatagacttgcatatatacaggtgcacttgtgtgtatgcacatccactctatgtggacatgkgcacttatacatatatggacactctatatacatatgcatatgttatttatgtatctacctacatatttatattcctgaagttgcagacatgaggyytctttaccgctaaattcctaagatcattctcttacatatccacaatgcaatgatcatgatcaggaaaattagcattgatagaagacttttttttttttttgagatggagtctcactgtgttgcccaggctggagtgcaatggtgctatcttggctcactgcaatgtccgcctctggggctcaagcgattctcctcctgcctcagcctcctgagtagctgggattacaggcacccaccatcctgcctggctaatttttgtgtttttgtagagacagggtttcaccatgttggccaggatggtcttgaacycctgacctcacgtgatccacctacctcggcctcccaaagtactgggattacaggtatgagccactacacctggctgatagaagactgttatctaagctataatctatattcacattttaccagtggacctaatactgtcttttgtagccattttttttctggtccagaatacaatcacagttcacatattgcattgggtcgttgcgtctcttcattctccgttagtctgagactgttcctcagtctttccttgtcattcttgayrttgaaacttgcagagtgcaggcctgctgttstgaggaggtccctcactccacatttgcctgacttgaatggcctgagaccatgccctctgggtgggaaggccgcggacatgctgctctgccctgtcaggaggcactctgtgtcagcttgtcccattgctgatgatgctcactttggtcacctggctgaggtgctgtccctcaccaggtctctctattagttttctcatctttgaagtggggcttttatccccacttgcagggtggccttgaacactgactgggacaacagagtgacgtacccagcccagccaaggacaaaagtgtattcagcaggcactcaggcactttgggatcacccccttctcrcagggcagtgtgggacaaagcrgtgcagaggtcacgggttgtatcagggtatccagggaatgcccttgtctgagggtgacaggcccacctctcgtctccacrcagacccrcctctcacyccagtcctgacagccttcctggagacccaggcrggacttgtgggcatccttcactgctctgtggtcagtgagcccctggccacactggtgctgtcacatgggggtcatatcctggcctccacctcyggggacagtgatcacagcccacrcttcagtggtacctctggtcccaactccctgcgcctggagatccgagacctggaggaaactgacagtggggagtacaagtgctcagccaccaactcccttggaaatgcaacctcyaccctggacttccatgccaatggtaagatgggcactggcagccagggagagtggagggagcctgaggaggagcctgctccagtctgttccttctagaagtctagtggactcaaccgcaggactgagctaactggctacgccacataaaagacaggggctgtgcagtgacccaacggcagagcttcctggaagtcaagggaaaaagggaaacacaacaggtcacatcattccttttgcacctaccctgaccctaaacttggagagtccctcagaagcattcattgttttttaattatgaaactytgggagcaggctctatgctagcagtcagatgtgggaagccaaatagaaaagtagggtcttctggctgggcgyggtggctcactcctgtaatcccagcactttgggaggcygaggtgggtggatcacgaggtcaagagatcgagaccatcctggccaacatggtgaaatcccatctctactaaaaatacaaaaattagctgggcatggtggtgagttcctgtagtcccagctacctgggaggctaaggcaggagaatcgcttgaacccaggaggtggaagttgtagtgrgccaagatagcgccactgcastccagcctgggtgacaagagtgagactctgtctcaaaaaaaaaaaaaaaaaagaaaaagaaaaaagaaaagtacggtcttccaactttcggtatgtgcactgtccttccctccycctgagkgcatggtagctaattgatcaagccaggtttttctttttgttttttgagatagggtgttgctctgttgcccaggccggagtgcaatggtatgttcatggctcactgcagcctcaaactcctgggctcaagccatcctcccatctcagcctcccaaatagctgagactacggcccatgtcaccacacccagctaattaaaaaaaaaaaattgtggccaggcatggtggctcatgcctgtaattccagcactttgggaggccgaggcaggcagatcacctgaggtcaggagcttgagatcagcctggccaacgtggtgaaaccccrtctccactaaaaatacaaaaattagccgggtgtggtggcgcacacctgtggtcccagctactagggaggctgaggcaggataattgcttgaacctgggaggcagaggttgtagcgagctsagattgcgccactgcactccagcctggctgacggagcaagactccgtctcaaaaaaaaaaaaaaaaaaaaaaaaaaaagctggccacagtggctcacacctgtaatcccagcactttgggaggctgaggcgggtggatcaccagaggtcgggagttcgagatctgcctggctaacatggtgaaaccctatctctactacatgtataacattagctgggtgtggtggcacacctgtaatcccagctacttgggaggctgaggcaggagaatcgcttgaacctgggaggcagaggttgcagtgagccaggatcacrccactgcactccagcctgggagacagagtgagactcagtctcaaaaaaaaaaaattgtttgagatggagtctcactatgttgcctaggctggtctggaactcctggcctcaaacgatccttctgcctcagtctcccaaagtgctaagattacaggcatgagctaccatgcccagccaagccaggtgttggacataagcctgggctctggctctgaatcttcaaccatgctgcagccayctactaccaatagatctgatytggcattaaagggcaaaccctcctgatgcaccacaaagcccagagctacctacagtagtgtggggaaaggagaaccctggaaggctttctatatagggcagcatgtggggttgagaggagggacccttcccagcctcttcctctccccgcagcygcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctgtgagcagccaccacctgttgcagcctcctgccgggacccaccagccaccccacctcctctaggccccccagccctgtcctgccctgccccamggtctatatcgggagggctgggtcacagacctggccacagtgggtctttccaygtggggctgaagtttaggaaatgaggctggggccttctctacctccccatgtctttaccctccaatgccagccctgtgggctcctctgtcccagcctcaagctcagcatgggcaccacatccatgctttgtcctcatgggtgagccctgggacaccacactcctctatttgtgcacatgccccacaggctgtgctgggctcccatagacaccaaggcaaagcccctcagcacagggacagacagcccctctgcatccgccaagcggggaggctccgtgtaagaccaagggcctgattccagaggcttcccctgacacatgtgtgccggagccacgtcccggaactgtcagagggcagctgcctctgcaaagttttctggtgtctgagtgagatcacatgggggccttggctgattgctctcttttggccaactgtctccagaagccttcaggaagaggccattctatgcattcgctagtatcacaggagctggcttggagatcacagataagctgcagggcagatcttgaggggaggctccgtggtaaggcattgggtgcagggtgggagcagacagcatgacccccagggattgctaggtgggcaccctgctcagcagcagatgggacttatgcaaggtggcagccagcccatacagcacctttgtctgagctagaaaatggtgctccttcttctgggaagactcagtaggcatcagggcacagcttagcttgrggagcatgagcctagcttgagttccacccaccctggtctggctgcccttgtgcagtgcacagtctgcacagctgcttggggcagccttcgggatctgcctttgtccagtgtattctgggagcctagccaggcttgtggggccctggagcatccgtgggatgagtgcccatgttctkcctccctgcagacccccctcgacaaccaacattcaccaccaggctggaccttgatgccgctggggccggggctggacggcgaggcctccttttgtgccgtgtggacagcgacccccccgccaggctgcagctgctccacaargaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaaygcctccacctcagccaccttcaatggccagggtgagtcargcagggaatgggtggcctgggggcaggggctggagctctggactgttctgctccgaggaggatctaatcaggcaaaaccactctgtgcagcagtgggggcccttcgctgccctcctccacattcaggaagagcggagctgctccttcccatgatctctgttcaggccggggataggcaacacagctggtctctgaggaaggactccccagctgggacagttgggctgccttgtcctccttccctgtactgcaaccctctctgcccagggcccccacagtccccagggcccacttctcctaggctgccctgtgagctagcttgcttttctccccaaccctgtgggcaccccagggggcctccttcctgctccttccaggctgggcggctggacccctggctcctgggggccgggggtggtcagtaagctgtgccgcctgctctccagccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtmctctgtgggtgactggcatgggcagcctggggacttggagggtggaggggtggtctggggagaagcaggggccgggctggggtttggggaggaaagagcatggcttaggctgtgtgtgtggcaggaggtgggggacatagtgtggcagttgtaatgtggtgagctaggctgggtggcctcagctccctctgttcctgcagatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaargctgaggccaactccctgaagttagaggtccgagaactgggccttggggactctggcagctaccgctgtgaggccacaaatgttcttggatcatccaacacctcactcttcttccaggtccgaggtgagtgtcagtcttctgaagatatggtagactctgatgccctggggactactctggtcagactttgggctgggtgctgtgaattttgtgcagaaatatgtctttttcagtcctggtaagggcagtttcgccagccagcagaaggcctccctttgcctccagctagatattttcacctgtaataactgcagcagccactaggaggcaatggcaattcacaragtggcttgcttggtgggagcactttctgaaataacttgttttgygatcatataattttgttacatagtaaacattctcatacatatgtatatttatattatgcatatatgtttatgtatgagtatatacacatacaaatatacattatgtgtattcttatgcataatatattcatattctttatttatatacacatacgtgtgtgtgtgtgtgtgtgtgtgtgtgtgtktgtgtgtrtatatatatatagtctctataaaaatcctccctcaggccgggcaccatggctcatgcctgtaatcccagcactttgggaggctgaggcgggcrgatcacttgaggtcaggagttcaagaccagcctggccaacactctactaaaaatacaaaaattagctaggtgtggtggtgggcatttgtaatcccagttactcgggaggctaaggcaggcgaatcgtttgaacctgggagatggaggttgcagtgagccaaaattgtacttcactctagcctggatgacagagtgagactctgtcttaaaaaaaaaaattctccctaaacaaataaaccaggaaaaaggaaagataatgcccataatgcgaaggtcaaaggaacatgagtgtttcttccaccacggtgaccgacagcaccaattttgggacatttactttgagccttggttctgtgtatcttttcttacttagcatacctatttcgcaggaagaaattgaaggtttgagttttaggagcttttccccagttgcrtgaccctgctagctgtggtctcaggcatggtctgtgttcttgcttagcattccagctgtccctccatctcactccctgcaacctggggttctcctgcttcacacccaggggccactgaggagctgccctttgcctggtccccaggtcctgtgctcttgtggcctggagtctggatgcagggctggcctggcgagagcgctcaagataacatagctgytaacattcccttccaagccctcggtcacccatgctgagtccagatcctagttaggacaatggcccygggatgatctaaatccctcccttttcagtactttatgggttgaaccaacatttgtcaggagctaacacwtgcaggcacagtgcctggaactggggttacaggtcacacaagtccagtgcccataaggcttacgctttggtaggcgagatatgactgacacagtaaaaccatcccaccaggtggtgggaggtaaatgccaggatggagcctgtgcaggagagtggggagcaggaggggccaaggcatagggctgagtgggccctggcggtggtctggaaggggctgcggctccagcacatggggttgggttgtgtagtcctaggtggacacgcacatggtcccagactgtgagaggtgtggtggagagccctcacctgctcttggttttcccctgcaggagcctgggtccaggtgtcaccatcacctgagctccaagagggccaggctgtggtcctgagctgccaggtacmcacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgyacccatcagcctccacgtgtcctgtaaggacttttgtcccatccagrtgtgggggaaggaatgcagtcccccagtcctgggctgtgtcacatgacagagccctggatgagggacccccctggctgggtcctgaccactccccaccctgtgtagatgccccacgccacgtcacactcactaccctgatggacacaggycctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaaggtcagtgtgtgtgtgtgtgtgtgtgtgtgtgtgtgtgtgtgtgtgtcctttaaaagaggagaggaggtgggacagggttctagaagcctgggggcacgggaatagtccccattcccacccttcctaacgatggtggactccagacttgagtttcttaggagaaccttttataaacaccaaattttacaagtatgcccagtggataaaactaaacagggaatttcaggagaaagtgcagcaggggaggggaggtctgtggtctccccayttgcccccagccagggtcagggaggggctcagggctttccaggactctgtggaactctacttgggaccactcaggagccagtgggctattcccaagcttgasttctaagccacatttataggtgggccacccaaggctcccaaaggccaaggggctccccagcagtaggagtagctcacccacatggagacaggtggcctgctgtacacagcctcaagaccctcactggtgtcctgtgccctccctctccccagctgtgaatgtgcaggtgtggcccggggctaccgtgcrggaggggcagctggtgaacctgacctgccttgtgtggaccactcacccggcccagctcacctacacatggtaccaggatgggcagcagcgcctggatgcccactccatccccctgcccaacgtcacagtcagggatgcyacctcctaccgctgcggtgtgggcccccctggtcgggcaccccgcctctccagacctatcaccttggacgtcctctgtgagtctggctggatgcagggtgggactsacaggaatgacagaagcccacagggatcacggcatggccggaacccgacaggtgtccagtggggaactcggtacccagtagctagtggagcactgggcaaggagcattaagagtagggrgcgctggggtgagtcctgtctgggcagaggagcagtgcctcagactgggtggttgggagccataggggtggggagccagggccctcctgagtttgaatgccacctgcaaactggcctcctgcaggctgcygcctgtgactccgtgtaagcctctcatgccctgcagacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtaaggcagggcctaggccaagcccactgggatggaagcccactgtggtgtccggctgggcccrgctgatcctggcctccttggcacaggtgtgcgggtgatcctggctccggaggctgccgtgcctgaaggtgcccccatcacagtgacctgtgcggaccctgctgcccaygcacccacactctatacttggtaccacaacggtcgttggctgcaggagggtccagctgcctcactctcattcctggtggccacgcgggctcatgcaggcgcytactcttgccaggcccaggatgcccagggcacccgcagctmccgtcctgctgccctgcaagtcctctgtgagcagagggtccttggccagggctgcccaggaggagggtggtggagggtgcttctgggctctggtgggagtgggcaaaggactgcagtgggcccaggaatgggcagttggggaaagaggacataggtgctagagaaagagacagtcctataagccctgcctggagcactctgcccacaggactcctgggaaggtgtcacttctaggaagtggccattggtccagaggcctcagcctgaccaaccccaggcagctaggcaatgagcagtacagggtgcctaagcaaggtccccatctgtgccctgcctgcccacagatgcccctcaggaygctgtcctgtcctccttccgggactccagggccagatccatggctrtgatacagtgcactgtggacagtgagccacctgctgagctggcyctatctcatgatggcaaggtgctggccacgagcagcggggtccacagcttggcatcagggacaggccatgtccaggtggcccgaaacgccctacggctrcaggtgcaagatgtgcctgcaggtgatgacacctatgtttgcacagcccaaaacttgctgggctcaatcagcaccatcgggcggttgcaggtagaaggtgagtggaagagaggggaggaggaggggctctgatgctctcargtccaagtccacgagaggggctggagctcccactagagcgggctgtctggtctgagaaagctctgccttgagaagcctaatctggtggagggggcmcagctcccactggagggggcatggttccaccttggaaagccctataccaagtcagactgagaccttcccacaatgtgcagaggcccctcagaggtcccacccagaggctccagcccccaargcctacagatccccaatcatctctctatcctccgcccgcaggtgcacgcgtggtggcagagcctggcctggacgtgcctgagggcgctgccctgaacctcagctgccgcctcctgggtggccctgggcctgtgggcaactccacctttgcatggttctggaatgaycggyggctgcacgcggagcctgtgcccactctcgccttcacccacgtggctcgtgctcaagctgggatgtaccactgcctggctgagctccccactgggsctgctgcctctgctccagtcatgctccgtgtgctctgtgagtgtgaaccccctcctccgccttagtctccccacatctcacacgcccacctcagttcttcctcctcttctgtctgccaagagtgaaggcttyacggatattgagtcctgggttggaatcctggctctcccgctgtctggttgggtgaccttgtaaaatggggaatacatcattcgcctcatcytgcaagttgtataagaaataaatggctggtgcaggggcttatgcctgtaatcccagcactttgagaggctgaggtgggcggatcacttgaggtcaggagttcaagactagcctggtcartatggcgaaactccgtctctactaaaaatacaagaattagcacggcatgaaggcacacacctgtaatcccagctattcaggaggctgaggcaggagactcacttgagcctgggaggtggaggttgcagtgagccaagatcaccacaacgcactccagcctgggtgacagactgagactctgtctcaaaaaaaaaaaaaaaaraaaagaaaagaagagaaaaaaccaaaagaaataaagcgtgctgagtgtgtctggcacacgataagccctcatcagtcttggtctcccactccagccttcaccaaggcctacactgtatcagtcagctattgctattgaccacaacaaaacttactgcttcaaacaaaagtcatgttatctgctcaattctgtgggctgggctcagctggggagttcttctgttgttcacacctcatgtggctgcagttgcccagtggtctcagatgactgcacgctcctggctgccagttgggccacatgtgcccagcargctggcctgggcttcccacattgttgtgttccaacaagtagagcagaagctacaargcctcttgaggtctggctctgaagttgcacaacatcacttctttcttcaattggtcaaactgagtcacagattcaaggagtgaggaaataggttctgcctcttaatgggaggagcagcaaagtcaytgtgcatgggtacagggagggagaaatttgtggtcattktctgcaatcaccacactcccttcctccccacagaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctrggctctgcctctacctccacctactttggggtcagaggtgaggggagggggctccatctcccaggccactctgcacaaaagcccagctcttaggcccaaaggcttccttccctgtatccctcctgctgcagcawgatttgcctgtcgactctaaactgattgctcggggcacccttgtgtggagagcttcagcgataaagcaaaagttagaaggtgtcatcttgggtgggtccccttggaaggaagcactgggggcctgcagctgtggctgctctgagtcccgctctgtgttccagccctgcaccgcctgcatcagttccagcagctgctctgggtcctgggactgctggtgggcctcctgctcctgctgttgggcctgggggcctgctacacctggaggtgggtctggagctgggagtgggccagaagattggggtaaggcagcccacctcgtcttctccccaaattcccccaggtcctttaggacctcctattaagttcacaggctgcctacttcccagactgcccctccaaattggaaatcccttctagaattgtccctaaatcctccttgctgtagtttcyttctttcctcctctctgccctggctgtgctaaagcaagggctagggaggaagacagaggaagcacccactctccatgaggttcccacgctcttgtggtctggagccagcctgtggggagcgggagaggaatgggggcaggaggtggggaggggagaggctctctgagtccactccgggccttgcagaaggaggcgtgtttgtaagcagagcatgggcgagaattcggtggagatggcttttcagaaagagaccacgcaggtatccattcaacacacacgggcagatataatacccagctaacccacagtgccaactggcatctggagactgctgtcatttagaggatggtgcctgggaccaaggggaggttggggagagtgtgcagggaaccaggagcccctcaggagataggagagccctgttctgctcggggcagagggaatccctgtgtcagctggcggctggcttagaggactaggggagactttctggacttggcagcatcccctccatttccaagacacgtatgttctgactcccccacctttgttctgaggcctcttccccactcccaagcctgcccgtcacctgggcagaagtgaaagtcagtttctcctcccctgtggtgtgtcccttctgcagctgattcacctggtaggccagggctccaagtcacacttccagccatgcacactcccaccaatcctcttgggaccccacctgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagamtctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcmcttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctcyaggatttgggttgaaaaacagagagagaagtgggragttgccacaggagctaacacgctgggaggcagttgggggccgggtgaactttgtgtagccgaggccgcaccctccctcattccaggctcattcattttcatgctccattgccagactcttgctgggagcccgtccagaatgtcctcccaataaaactccatcctatgacgcaactggagtgagtctctttcttgcaacccaaacagctgggctagaacagaggagtcacatgttagtggggtttattcttagacaccatctgtaggagggggccaggggctgcaagttacatgacatttatcacaaattaccttacgctgaagtgatttgtgtccctttctgctccttgaggcttcgtgtgttgctcacatttgccacccacaatgaccagccccgtgcatggcacgcagtaggtgggcacgtgaactaagcgtttgtcttgtctacattgctgacagtggggagggtggagaacatggactaaatccagaggtgggacagggagagagcaagtcaaatgcagccagatgtttgggggctgtctggggaagagagggtgtagggaggaccataagcagctgctgaagctgcrgctactggggggatttgggaatatccggcttaggagtcttcacctgcttctgcatacttccaaggggacatatgtccatcttggattggaggctctcagaggggttagttgtgtccrcttccagtggtctgaggcctcctgagactttttgtacattcaattaaagtgtaacatacagaaaagttcacacattataaatgcaactcaaggacttttccaaaagcgaacacacccagatcaagaaayagaccatcctayagtccccscttacactctgtaccagttgcagcccccacaagggtaactactgtcttgacttcraacaccatagatttgatttgcctgtttttaaactttacwtaagtagaatcacagagtgtgtacaatgactttggaaaactgtttgacaatatctattaaagctaaaatacccttgccctatgaacctgaaattccacccaccttgccaagggacaaaaagttcccctctaaatgcaccaggctgtcagggawgaagcgttggctttggggcccccattcacacacatgacyttttcyggggcayccaagcatcagcctgtcgtcaccaggtgccaccctggcgatctctgaargctggagtcggagtgcctccctcagacatcctgttctgcgtcactccttgggagaagtcgtgtttacagatggtgggtgtcacccatgccaagcactyctaagggttaatgctcactggtttgcctggttcccaggacatttcctgatgcccctctggagggtgacgccaacaagccagtggagaagccatctttcccaggtgctgtcaggcgcccccggagctgctmggtgcatcctaggatccctcttcctcagctttggtttgatggcctcatctcctcccctgcaacctcaaaatgtaaataaaccctttctcagagacttcggyagaaaattcctctgacctgcacttggacacagctcatctgggtttgggaggtgtcaactgtgtaargatgactctgatccccatgtggcttttcgactgtgtcccctctacagtcagttattagcactgactgtgctaggaagtgagcaacacacatattcccagaccacatggagctcargagcttggggagagagacagggaagtggacgactacagggccttctgaaacgtgttgcagggagaagtgtcagtcaggggatgctaacctggctttgggtaagggacagcctctgaatgacaggacattaaagccatggcctgcagtttaagtaggagttggccagttcgaggtaagaataccagtaagcaagaacgccagagtagctcctcgagctgccttctgtacctgacatccacactgaagccagcccctctgtgttcagccttgctttactgaagaggtgtcgctgaggggctgctctggggygctgctctgctttcctgtccccaacttgttctgagctcgagccacctccatactggtgctcctggttctcaggcctttgaactcaaaytgaatcacaccactggctttcctcgttctccagcttgcagatggcagattcgggaactttttggcctccataatcacgtgagccaattgctataataaatatctctctccctctttcttcctctctctctctctgtgcaaatatagttccaattataagagcccctaactggaaaataaccctatggtgcactggtgagtagagaaactgtggttccctcaaaccaccgaacactattcagcaatacgaaggaacaaactattgatatgcaaaatagtgtaaatgaatctcaaaaacatcggaaagagggaaggaagccagacacagaagagtgcatgccgcatgattccatttatatgaaattctagaacaggcaaaacttatctatagacagagaacaacagatcagtggctgtctggggttgggagtgggsaagtttggctggaarggcacagggctctttctgtgagtgagggaatgtgtctgcattatagtgatgcttatgtagttatatacacttatcgaaactcatcttactggccacttaaaataagtgcattttattgtgtgtaaattataccttaatgaagttgatttgaaaatccaaagtagtaataataagtaataatctcgtagctggacagctgtggtgactcactcctgtaattccagcgatttgagaagctgaggcaggaggatcacttaagatcaggagttctttttatttttatttttattttttgagacggagtttcgctcttgttgcccaggctggagtgcaatggcatgatctcggctcrctgcaacctccaccttctgagttcaagcgattttcctgcctcagcctcccaagtagctggaactacaggcrctcaccaccatgcccggctaatttttgtatttttagtagagatggggtttcaccatgttggccagactggtcttgaactcctgacctccagtgatctgcccgcctcggcctcccaaagtgctgggattacaggcatgagacactgcgcctggccaagaccaggagtttgagaccagcctgggaaacaaagtgagaccccctgtctacagaaaaattaaaaattttagctgggcctggtgccgtgtgcctgtagttccagctactcaggaggctgaggtgggaggataccttgagcccaggatttcaaggctgcaatgaggcatgatcaggccactgtcctctagcgtgggtgacagagtgagaccctgtctctaaataataatcataagaacaacaaggaccctctaaacgcactgatatctaaggtgtattaagcgaccaaaaaaaaaaagaaaatcaaagtgcagaaaaacgttaataagagaaaaaaatatgtctgtattgtcttgagtgtgaaaaaataatctaaaagcctatgaaagaaactaatcatattggtttcctgttggtgaggagggctaagagcacggagacttttccctatgctttctgtactttttgattttgagatatgtgaatgtaggtttctctcactgctcgaactttcactaaccaaattactacattccaaattctcaaaaacaaatagatttacttaaaagtaggctgggtgcggtgtctcacgcctgtaattccagcgctttgggaggccgaggcgggcagatcacctgaggtcgggagttcgagaccagcctgaccaacatggagaaaccccatctctactaaaaatacaaaattagccaggcgtggtggcgaatgcctgtaatsccagctactcgggaggctgaggcagaagaatcacttgaatctgggaggcagaggttgcagtgagcccagatcatgccattgcactccagtctgggtaacaagagagaaactctgtctcaaaaaaaaaaaaaaaaaaaaaagatttgcttaaaagttaacatctccggccgggcgcggtggctcatgcctgtaatcccagcgctttgagaggccgaggcgggtggatcacgagatcaggagattgagaccatcctggccaaaatggtgaaacctcgtctctgctaaaaatacaaaagttagctgggggtggtagcgcgcgcctgtagtcccagctactcgggaggctgaggcaggagaatmgcttgaaccagggagtcggaggttgcagtgagccaagatcgcgccgctgcactccagcctggcgacagagggagactccatctcaaaaaaaaaaaaaaaaaaaaaagttaacatctcatccaaatttgcaccgagtaggaaaacaaaagtttaaaacatgaaacagatgttactgaggccgaaagggtctcccaggcctgggagtctgcagcttttatgcaattctgccctctggccaccgccagggaagaaaggttgtctccgtctgctgcatcgcctttgcccagcaatgaagcccccaagacagcggcagccggttgcctgaaccttcctatccttgggggcacccagtgcaggtggatgacccgactcaacctccgccagggcaccctcggggcaggacgggtagcaaggaggggacagagatcggccccaggagaccacggaagatcgcgctcctggggccaacttcagcagcgagaggcggcctttgcccaccgcctcatcccaccacgccgcggtcctccaagaaccttcccagcggttctctcctcctctcaggagtagaggccctctgagaccgacggggwgggacggctcgggccggtcatccgaggggccgcacggattccctcctccgcccagctccaccccctcgaggggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggcygcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggtgaggacgcgggcggggtgcgccctgaggggcaggctaggcgcggtggtggtggcggggatgggttctgctcagagctcgggtcagcgcgcggagggtctcacggccccggcaccatacggccagtaggtcagggcgtggggactctttgggggggtctccgtgggacctgcccagggacgctcaagtgtgcttgggctggccccgggcccggacttgcccacactgcccggctgccactccgctggcaaagcagagggcatggctccctccccctcggggrcarcccagcccccagcccccagcccatagccgtagccccctctkcctggattctcgctctcacaaccagcttccatccgcaggccaccgtgtgacccgctcctgctcctccaccccttaggactcagcggggctccrtcctctaggaagcccccatgcccaagagtcccccagagtccctgctttgctctcaggctgcagaactagctgtggcctccaccctgctcacccctcgtccctcctcccagggcagcagggcagtgtgtatgttgtttatattgttgccttgtttggtgagatagagaagggcctctccagatagaaggtgtctgtttagcagtgctctggraagactgcagctgtctcctcggggtaacccctccaaacaaagatgttaagatggggctggaacaacctctgcaagcgggtgggaggattasccagtcctgcacagcaagtgcctggccgggaacagggagggcaaccagggagggggcatgcggggctgggctgtgctatgcagactgggcggtggcttccacagcactgtgtggggaccaaacaggtacaggggcctggtctgttctggccccaggggagggccccaggcggtccactgctccctcccctctgagccctatcctggggtcaggggagg

SEQ ID NO: 13353 - DNA, 26096 bp, Homo sapiens
aaattactgtttcagaagtaattactgttggaagatgcaacatggttttcctagaaagctggtcttaactcctaacgtgaacgagtggtgactaagatgtatttgagggctcctatacagggagagctgcagcttactccatggagaggtacttttgtcaaatttctcacctagatgaagtattgccttttttatgctgttgcaatcagagcctctgacagtagcttgtttccccgtttatctggtcaagtactcgtaggaaggagtgcaacccccactaatccagttggagggcccatccctcatctcaggccctttctggagggtaaggaggtagaggctgtccgacccaactgtttgttctgcctctcttttcagggggacccgcagccctgacacaccatgggaaagatgagagtggtggcccctaaccagctcccagggtttctctaggcttttctaagccccaggcctgcctgatctcccagtttccagcaacccctccagctgtgtttttctcctccctcccttattagcatatcttccattgtatctttctttcctttcttttttttttttttcctttggagaggaggtctcactctgtcactgcagcctcgaccttccaggctcaagctatcctccacctcagcctcccaagtagcagggaccacaggcgacgccaccatgcccggctaatttttgtatttttgagatttcaccatgtcgctcacrctggtcgtgaactcctgagctcaaaccatccacccgccttggcctttcaaagtgctgggattacaagcatgagccaccttgcatcccaattgtctctttctacccccttggaactctcctccttcagccttctaattccaaagttccctcttcctttcttcagtgctctccccagagtccttatctgctacacacctacacaccttttttccagcatagttccagggctctttgggccgcagctcaccttcgggtctctaacactctccacacctccgtcctattcatcttccttcttttagttctgaatccctttcttgtggttttcctaagtgccaggctttcctgtagtccctaccagacttttcaaatgcttcctcaggagaactgaagactggttaacttttttttctttyttttaagatagcagtggggaggggaagttctggggcagaagttggataaccagggcctgagaaataaagataagagggtatattcctcccccaggagacaaaagagaaggtggatggagaaggggaaactgggcctcagccagcaccgggatgatgcgaccagctttgtcagcacgcttggggagcatacacaccgcttgccttggctggaccggagactgtgatcaccacccttccaacccatcccccaacacgcaggctggcatggccacgcccacagtgccccaagtgctgcctgccttgcagtgactcacttcctctgtatgggctgctgaactgtcccaaggagaggacaggccatctccaggccttcagccccragtttagatatctgggcaggctttgtggatgggcaagcatacagggagcccaaatgtggaaggtaggttttttcaggtcaggtggaactgttaacactgaagcctatttgggtaagaagcagagcctagctagtacctaatggagattcaggggccaggagtatcggggaggaaacatttcctaacagagaggtaaaatagccaagaggagtttctatgtattctgaaatcaggcaatggaaagtatttgcagaaaagcaatgtagggaccaggcgtggtggcttatgcctgtaatcccaacactttgggaggccgaggtgggtggatcacctgcggtcaggagttcaagaccagcctgcccaacatggtgaaacctcatctctactaaaaatacaaaagttagctaggcatggtggcacatgcctgtagttccagctactttggaggctgaggcaggagaattgcttgaacctaggagggtgaggttgcagtgagccragatcatgccactgccctccagcytggcaacagagtgagactccatctcaaaaataaataaaaggctgggtgcagtgattcatgcctataattccagcactttgggaggccgaggtgggcggataacctgaggtcaagagtttgggaccagcctggccaacatggtgaaaccctgtctctactaaaaatacaaaaattagctgggtgtggtggtgggccctgtaatcccagctactcgrgaggctgaggaaggagaatcacttgaacctgggaggcagaggttacagtgagctgagatcacaccactgcactccagcctgggtgacagagtaagactcggtctcaayaaataaataaataaaagcaatgtgggacttggaggctgaagaggtggacatgcatgaacagtggaggcggtgtatgtggctgcctttcccctgtattccactgagagggagcccaaatctgcctcgcctgcattgagggatgaagaaaacactgagaggcagctgagaaacatggatgctagttccaactccatggcctcgggaagtcactcagactccttgagtcagtaatgaaaaggtagtagattagaggctgggcgcagtggctcatgcctgtaatcccaacactttgggaggccgaggtgggcggatcacaaggtcaggagttcaagaccagcctggccaacatggtgaaacactgtctctactaaaaatacaaaaattagctgggcatggtggtgcatgcctgtaatcccagctactcaggaggttgaggcaggagaattgcttgaaccagggagtcggaggttgcaatgagccgagatcgcgccattgcactctaacctgggcaacagagtgagactctgtctcaaaaaaaagaaamgaaaaggtggtagattagatcctcyctaagatttcctccaactctgcaattctaaaatgtacaacatggggaaggaaggtgatcagtacaactgtaaacaactgcaatccggccctgaagttgaacaaaacaaaacctagggagaggaatgagtttgtagcaggtttcaatgcagcgattgtgaacgcatcacacacacactcctcacaggcaaggacttcgcttctgccatgtgactgagactctgttggacttctccaaattcagagttcagcctggcatgccggccaggagccccttggagagattcggcstgaggaaacaggaggcctcacgcttccttcggttctccctaaatctgctgggcaggtagccagaagaaactctgaagggtacagaaagccragggccagggggaccccggctgcggagctgcagtaccgtgtttacccagcctaactgcggtcacccagtctcctgcatgtgtctgaggtcagcctcgggggctcccctgagtaggtatctacctgaggctcttcccctgatgctacctgcataccaattccacccaggaacctggcgtcctcaggaggctgcacttcccaagtgggctgagacagccccttaatatgtggggctggagccagagacctcaaggggccactagggggctcgagactctcagtggctgctgacgccctcttgtggccattttggggattggccagaaaagtttcagaagcgagccaagatcggaattcttaaggaggtaagtaataacaacagtaacagttaccatataacaatacttatcgttatatatttgataacattgtgacatttctacttaacagcgctgtgcccagaactcttctaagtgctttatatgcactgtagttatttaattctcacaacaacctataacataaacactattacttgtctgttgatgatgaggaaactgagcacagaatagttgcccaaggtcacacagaagaccagaatcccgactctgagaagtctggctccagaagctttgcttttagccaccacgctgagactgagttccattttggggttgtcaggtgaaatacaggacacactgttaaactataatttcagataaacaaaaaataataattacaggcggtggctcacgcctgtaatcccagcactttgggagtccaaggcaggtggatcacgaggtcaggagttcgagacyagcctggccaacatggtgaaaccctatctctactaagaatacaaaaaattagccaggcatgatggcaggcgcctataatcccagctactcgggaggcggaggcaggagaatcgcttgaacccgggaggtggagcttgcagtgagccaacataatgccactgcaykccagcctgggcaacagagagagactccgcctcaaaaaaaaaaatgttagtatatttaatgaaatatttgggtcatacktgtaccaacaaatgattcctcatttacgtgaaattctgattaagctgcatgtcctgtatatttatttatttaatctaatacccctactttacagggcacttttctctgccacatgcaattacacagattactttttttttttttttttttttttgagacggagtctcactctgtcgcccaggctgtggagtgcagtggcgccatctcagctcactgcaacctctgcctcccaggttcaagtgattctcctgcctcagcctcccgagtagctgggattacaggcatgcgccgccatgcccggctaattttttgtatttttagtagagacggggtttcactgtgtaagccaaggctggtctcgatctcctgcctcatgatccacccgcctcggcctcacaaagtgctgggattacaggcatgagccaccgtgcctggccacattaccttatttatttatttatttatttatttatttttatgagttcaatagtttttggggacaaggtggtgtttggttacatggataagttcttyagtggacacattacttcatttaatcatcccaggaaacctgtcctcggaggccccagcatgtcccacagcctccgtctctctcaatcctcccatttagagagctgaaaggactagcgaagcttacagaacataggtggcagagctggatattgaaccctcattctccagttctgacacaggtgcatgttttccttttaacaggagagaaaagtgaggagcagtgattaccgccacagaaatatcctttcatggcgtgtcctccggcatggtctactcagtgtggtggagccactgcaggtccctcctccagggatgtaggaatgccagtgaaggccttcctgagttgggagagaggcagaggagtgagtggaggcagggctgtagcttctgtgccccgcccctacccaggctctccagggaggcaggaaagaggctgtgtttagacctgagggagccagctgtgaggctggagcagttgctgcatggcggggcgggggctccacagggctgttcacctgctgctctgtgcagagrcagcctcaagtccagctgctggggttgcatcacctgcagctaaaacagccacagggcccaggctgccaaaaggcaacagaagcaatctaagaaaccaggcaagggagcctcccccatctccctgttgccttttgggagcatagagcttccctctgaaggtaacaccctttgcatttttctctcttgactctgttcatcaacttccactcccaaatacttgtgcccttccttctccacagatatacacaatccctgggcactctccacctaggtcakctggctctagtaaggcagcagtcaagggagtttctgggctgggaccccctctggggtgcaggctggggtgccctgctggtatgtgccccaacaggtttttccctatcagccttgaaatcagcctgcagcctgtctgacctgccccccagggagctggagccagaggcagagccaggtcagaagctggggcagagccaggtcagaagctggactttgagactaggtctctgtggtcccacctggacccacagggaaggcagtgcataaaagyctcctgtgtttgaggctgagccgctgagaggctgagtggagttcactcacatggattgaggcccagttcctgggagaagagatgctgggcaggaaggtgtctgcatgtgggactctgtacagcccggtcctctcccacrtctgggaggggccagagtcagacaactgctgggttcgtccctaagagaggtcatctgackkgctgttcagcctaggctgcacacacccccactttcctytaccaggccacaccggaggcagtgctcacacaggcaagctaccaggccacaacaaygacacccacctcacctytggcacctytgagtaagtactgggcccacggccccatgccaggagggcttgttgattgcttgggggagggaaaaatgagttttccttttccaacatgagagtgcctcctttctgtccaggcatccacgtacttgcaagaactcttgctcacatcagctaagagattgcacctgctgacctagagattccggcctgtgctcctgtgctgctgagcaggtaggcagctgtacaggcaggaattgagggttgcttgtcagctggggctgccggtgggggaagatgctatttcgagttgtcttccactctgcgtggwtaatcctgccacctcacctcagctcccctgcactgcccaggagaccccagccaggcccaggaaggagggccatagacctcagaagggaggcatctaccgcggaccaaggcctgaggagctttggtgctgaccctggcatcagggagggttggcgcctggtccaggagcattccgcatcaatccccacttcctaaaggagtggggagaggtggggaaggtgggggctcccctcttacctcaccatttcagctccatttctggctccaagcctaagcaggttgatctttttttctgcagcaaggaaaggaacaggtgactggaacccagggtccagggtctcgggggggtcataaggagtccctgaagggccaggaaattcagctctgtgggctcctgtttccttccccagggcaaccagtagcaccrtgtctgtgactggcgggaagatggcaccgtccctcacccaggagatcctcagccacctgggcctggccagcaaggtaggggctgttgggattttagagatcacttttagtatctcagctcrggctgtgagaggatgggaggcaggaaagtggaggacaggccctgaggttatgctgaggaggtgtaggcagcctggccctggcccttgccaactaccctgtgctcccacagactgcagcgtgggggaccctgggcaccctcaggaccttcttgaacttcagcgtggacaaggatgcgcagaggctactgagggccattactggccaaggtgagcccctttcccccggcacttgagactgccttttagagccaatctgtagaccaaggaggagccaggaaggaggaactagtgatgttggagaaatgtttgtggaatgccttcattcttgtatgtcaggcgccacagtaggtgtgtcaaacccattctcacaacacccctgtgaggcaaggcttattatttccattttccagatgaggaaactgggrctcagggagattaagaggcttgcccaaggtcactcagctcatgacggaggtggtattctcatctaggtcagccgatccccccaagtcgtatttttttttaaccaccacaccaggccacctttgccttggtctgggtcagatttgcatgctgttttgacattttatttgcaacttcttttgagataaaatggaagtgggggtgatatagcccctgctcctttccttcccagccctctcctggagcgccttccctcctccaaggagtaggaacatcccactatgtaaagaccctgctcacagcacagccctcatctcggttcaggcgtggaccgcagtgccattgtggacgtgctgaccaaccggagcagagagcaaaggcagctcatctcacgaaacttccaggagcgcacccaacaggtgaggccatgctgacctcccacagcagtggactggggtgagaaaccccctggaggactcgagagacagcaacagccgctgaggccagcccctgcttcctggctaaacagggcctgagatgaaaaccagccaaatcttcccaaacctccccacacttctggggcccttcccctcacccccgtccctctgctgtgaggaccatttattgtaggacctgatgaagtctctacaggcagcactttccggcaacctggagaggattgtgatggctctgctgcagcccrcagcccagtttgacrcccaggaattgaggacagctctgaaggtagcaggaggggagacttgctggggtgtctggggaagggagaaggctgtcagccttgcttttgcaagacgagagtycccctctcgtcgtcccatattgtttcttagaaggagaagcagccagcgtctgcccctctgtctgccatcctaatgacacggccagtctgagagtagactcccaatttcttgtaggcctcagattctgctgtggacgtggccattgaaattcttgccactcgaaccccaccccagctgcaggagtgcctggcagtctacaaacacagtaagaatatagagggaggggtcccagatgctggagaaggggctgtaggacaggccactcctctcctgtactccccataggtgagctatctggcaacctggctgcctaagttctattccctyggggtctttcctcttgcccccaccagtgcctcagtctctcaggggagagacccagatgtgatcattaaaaaaagagaagcaggccaggtacggtgactcatgcctgtcaccccaacactttgggaggctgaggtgggcaggtcacttgagcccaggagttcaagaccagtcacaggcaataaaggaaaacctcatctgtgctaaaaattcaaaaaaaccagctggtcatggtggtgtgcgcctgtggtcccagctactcaggagtttgaggtgggaggatcaccccagcttgggaagttgaggctgcagtgagctgagatcgtgccactgccactgcacaccagcctgggtgacaggagtgagagcatgtctctctctckctckctctctctcwcwcacacacacacacacacacacacacaaataaagagagagaagcaatgattaaccatcttaatctggagctccaaggcagattccaaagtgacagtcccaaaggtactcatgtcaccttcccagccccttgccatccctgccatcacaccacattccaagctgaacccagccatgctgcagcctgaggaaaaggtgggaatctgccctctgagtcatgggtgtcacctttcatgtccctgatggctggccttgcttggctacaagtgtctcacccactaatttgtggctttttcccatcctcatcttaccaccccttccccccacccctacctctttttcttgctttccccaattttcctttgatgtctaatcttggcctatgttcttcttttgagacaaggtcttgccctgtagcctaggctgtgcagtgatgtcatcatggctcactgcagccttgaccctyctgggctcaatcagtcctcccacctcagcctcctaagtagctgggactacaggtgtgccaccaccatgcccagctaaattttgtattttttgtagagatggggtttcgctgtgttgtccaggctggtctcgaacttctgggctcaagccatctcctgcctcagcctctgaaagtgctgggattacaagcatgagccaccgccctggccgtggcctatgttcttaatccctctcctaccttccttccttcttgcatctgtttcccttttctctttctttttctccctttcctgctcttttccttcctcatatcccacctctcatatcatttttccttacctccaatgagggtgccaggtcctaaccatcttgtgttataatacgggtttccctagctcttcttcactgcctggccccaactctaataatggttgcctcctgcccagcaggttggtgcttggtgatgaagccactgcacacctcacaacttagagatgtttttagagtggccgtgatggtacttgtgccttacatcctgggaattagcagccatcaagctactccaagcaggggctagcagggctggcagggtatagcgggtcaggcatttggcaggtcctggggatatctacactaggaaaactcaggaggattcagagagctcctcaccccaccccagatttccaggtggaggctgtggatgrcatcacatctgagaccagtggcatcttgcaggacctgctgttggccctggccaaggtgaggaggactgacctgcaaggaagggagtcacgttcaccaggcaaggagacacgctggagcagggagcattgctgtcctgtaayggacaagagagggctttaggggagaccagccttcgcttgttggtctgaagataaaaaggtgcccttcaaagagccctctaagaacagtttctcctcctaggggggccgtgacagctactctggaatcattgactataatctggcagaacaagatgtccaggtgagcagggggtttaggagtgtgcacagccgccatgcacataagatgccttcctccaccatatcttagagccggtgacctacgtgcccatttttcccgcaaacccatccctgccttggagagggagttctcagttatgtggtaggggcaggaggtgtcaggtagcgtcatagctgaagccttttcactcatctagcctctgactcctgagctcatcaactgacatattctcctctcatgagcgtttgggggcagaaagcctcctcagaccttttggggattatttaatcctcgggtaccaggatttttccaaatcagtgaatagagctgtgaggctgtaagggcagagccctctcttagccctatttctttcttaaaaaataaaaaacataagataaaaaaacataaataaaaacaactagtaggccaggcatggtggcttatacctgtaatcccagcactttgggaggctgaaacaagaggatcacttgagcccaggagtccaagaccagcctaggcaacatagtgagactctatctccacaaaatatttttaaaaattagctgcacctgtagttccagctagctaggaggctgaggtgggaggatcgcttgagcctgrgaagttgaggctgaggtaagccctggtcatgccactgcactccagcctgggtgacagagagagaccccatctctctcgctctctctctctctctctctwcwcacacacacacacacacrcrcacacacacaaacctagtttacgggttaaaataaactttctggctggtcgtggtggctcacacctataatcccaacaatttgggaggccgagacaggtggatcacttgaggtcaggagttcgaaaccagcctagccaacatggtgaaaccccgtctctactaaaaatacaaaaattagccaggcatgatggtgagtgcctgtaatcccagctactcaggaggctgagcctggagaatcacttgaacctgggaggcagaggttgtggtgagctgggatcacaccattgcactccagcctgggtgacagaatgagagtccttctcaaaaaaaaaaaaaaaaatccttttccaccctcaatcccatttccatcatgatgatgatagattctggaacgtcatacccatggctccctaggccccaaccaatgatcctgattgactcctccctgactcattcctccctcctaggcmctgcagcgggcagaaggacctagcagagaggaaacatgggtcccagtcttcacccagcgaaatcctgaacacctcatccraggtacacacaagccttcttgtccccctagcttgctctaatgatcagtttgggctgaggaaggtggggagggcccatcctttccagagataattaatcccccatccatctttctaactgcctcctacacacacaagtgtttgatcagtaccagcggagcactgggcaagagctggaggaggctgtccagaaccgtttccatggagatgctcaggtggctctgctcggcctaggtaggggcctgctcaggatttgtgaagtaagtctctcttgggatgggagattgtggtcctagttgtgaacctccatccttccatctttgtttccagcttcggtgatcaagaacacaccgctgtactttgctgacaaacttcatcaagccctccaggtgagaggggcactcctttccctccccagaacagaaactggggaggagagaggaagtctcagcttgctgcttatgtaaccatcctatatacaccgtctaaacctcaagccrctctccttcccagggcttacacaccagggcttacacaggggtggaggaatgagctgtggtgagaactaacttagttggctcccaggggccctgaaactaacattttggccttgttaatgtctaggtggccaaatagagatatgaatctgctctgtaagacagtgccttgtgcaggcttagttgttgccagagtgatggtgataacactagcaagaataatgacaagggctggcattttgcaggtgctgattgtgtgccacagcctatcctgagcagggcacacatatttcaattaatcctcacaaccatatccatccgtatcttayagatgaaaaaactgaagcccagagaagttaagtaccttgcttgaggtcacgtagctagtaagttatacagtctccctacacaacacttcacgatgtaagatattgaccatccttgtcagctatacgataagtgctcttagcacccaaggccccctttctccacgctggtcagattttgttccacattatccatacttttttttttttttttgagatggagtttcactcttgttgcccaggctggaggctggagtgcagtggcacaatctcggctcatggcaacctccrcctcctggattcaagcgattttcctgcctcagcctcccaaatagctgggattacaggcgcccgccaccacattatcctaattttttgtatttttagcagatgcggtttcaccatgttggtcaggctggtctcaaactcctgacctcaggtcatcaacctgtctcggcctcccgaagtgctaggattacaggcgtgagccactgcgcccagcccatattatccgtacttaaactgctgactgtggcttgagtgcttccaccaatagaatccagttattctgttgaktgaattaggtctcctattagtagaactgtcccccaaaatctrtaaataaaaagttcaggaagggcgcagtggctcacgcctataatcccagcactttgggaggccaaggtggatggatcacttgaggtcaggagttcgagaccagcctggccaacgtggtgaaaccctgtctctactaaaaatacaaaaattagccaggcatggtggcaggcacctgtaattccagctacttgggagtctgaggcaggagaattgcttgaacctgggaggcggaggttgtagtgaaccaagatcaygccactgcactccagcctgggtgacacagtcagactaaaaaagtagttatcattttggcagatggaatagctttctgtagactggttgagaagccatcatgccatgttgatgattgcccaaaagttagtaaatataagcaattgttctgtcatctagagatttctatcttgacagtagattattatacttgcccaataaagcctgtatgattataatgagtcaacactaagattcatttgaagagttgtacttatctgtccaaattcctgtcataaatacaaactatcccagcagtagatgattttgtagtgtatttggattacaagacccacactcttgagtgtagataaaagatttatcttagaagtagtagtcaggggccaagcatggtggctcacacctgtaatcctagcactttgggaagctaaggtgggaggatcgcttgaggtcaggagttcaagaccaacttaggcgacatagcaagaactcgtctctacaaaaataagaagaaaatttgccaggcatggtggcacctgcctctagtcccaactactcaggaggatgtggtgggaggattgcttgagcccatgaattagaagttacagtgagctgtgattactccactgcacttcagcctgggtaacagagcaagaccctgtctcaaaaaaagaaaaaaagaagtggtagtcagaaaataacataggcccatttttctgaaaaaaaaaattttttttttgagatagagtctggctctgttgcctaggctggagtgcagtggcgtgatctcagctcactgcarccttcaccttctgggttcaagtgatyctctggcctctgtgtcttaagtagctgggattacaggcgtaggccaccatatctggctaattctgaattgtttctaaaaaggaaaaactcgggctgggcrctgtggcgcatgcctgtaatcccaggactttggtaggctgaggcgggtggattatttgaggccaggagttcaagaccagcctggccaacatggtgaaaccccatctctactaaaaatacaaaaattagccagggggtagtggtgagcgcctgtaatctcagctacttgggaggctgaagcaggagaatctcgagcctgggaagcagaggttgcggtcagccgaggtgaygccactgygctccagtctgggtgacaaagtgagacctgcctcaaaaaaaataaataaacaggccaggcgcggtggctcatgcctgtaatctcagcactttgggaggccaaggcgggcggatcacgaggtcaggagatcgagaccatcctggctaacaaggtattatccctgtctctactgaaaatacagaaattagccaggcgtggtagcgggcgcctgtagtcccagctactctggaggctaaggcaggagaatggcttgaacccaggaggcggagcttgcagtgagccgagatcgcgccactgcactccagcctgggcaacagagtgatgctccatctctaaaaaaaaaataataataataaataaataaacaaatataaaataaataaataaggaaaaaatcatgatacatctgtattattctttttatttatttttatttttatttttttagatcgagtctcactctgtcgaccaggctggagtgcagtggcgcgatctcggctcattgcaacctccgcctcccgagttcaagcgattcttctgcctcagcctcccgagtagctgggattacaggcgctcaccaccatgcctggctaatttttgtgtttttagtagagacggagtttcaccatgttggtcaggctggtccttaactcctgatctcgtgatccacacgcctcagcctcccaaagtgctgggattacaggcctgagccaaggtgcccggccttcttcttcttctttttttttcctttgagatggagtctcactctgtcgctaggctggagtgcagtggcacgatcttggctcactgcaacctccacctcctgggttcaagcaattctcctgcctcaccctcccaagtagctggaactatagttgcccgccaccacatccggctaatttttttgtttttagtagaaacagggtttcaccacgttggccacgctggtggcaaacttttttttttttcttttttaagatggaggcttgctctgtcacccaggctggagtgcaatggcgcgatcttggctcactgcaacctctgcctcctgggttccagcaattctcctgcctcagcctcctgagtagctgagattacaggcgcccgccaccacgcccggctaatttttgtatttttagtagagacagggtttcaccatgttgaccaggctggtctcaaactcctggcctcaggtgatccaccagcctcagtcttccaaagtgctgggattacaggcgtgagccaccgtgtccagcctgtattattcttttatgagagatatgtagatatatgaaaacataaattgtgaagaatatttattcagaaaaacaaccttcagaaaatcagcaatggctgattcaggacaaatttccaccaatctgtagtaaaaattaatgttcctggtgaagatcctagggccatatgcaatgccaggtatacgattaagtattataattaggccaggcatggtggctcatgcctgtaatcccagcactttgggaggccaaggcaggtgaatcacccgaggtcaggagttcgagaccagactgaccaacatggtgaaaccccgtctctactaaatatacaaaattagctaggtgtggtggtgtgcacctgtatttccagctacttgggaggctgagataggagaattgcttgaacctgggaggcagaggttacagtgacctgagatcgcaccactgcaccccagcctgggtaacagagtgagactccatctaaacaaacaaaccatatatatatatgctgaagcgagcagatcacttgaggtcaggagtttgagaccagcctggccaacatggtaaaaccccacctgtactaaaaataaaaaaattagctgggcgtttggcacatgctatagtcccagctgcttgggaggctgaggcaggagacttgcttgaacctgggaggcggaggttgcagtgagctgaattcaygccactgcattccactctgggtgacagagcaagaaaaaagaatacttgtacaacaatgagagtattcagttaatgagtgactcttgcccaattctgtaactttagagtaacaagcgttggaagaagagaagaatggatactggggagcaattggcaatctttatgacaatacaaaactaatgatgcataaaagttaaaatgaagtagacattaggtccactgacaattaggtaatgagtctaaatgaattggagcatcctgttttacttcattttcttttgttttgtcaaaggagtttatgatctattgggatgccctaagtatgtgttgtaggcagttctgggaagagtcttgtgagtaaagtgactcaggaaactctgaaaatgaggatattaggaattgatgacaacactggtgcacagaaaaaaaaaaacacaggaattttacaattaaaagtttttatttaaaaatctctcataacaacacattacttagtataatcaattataattcaggattttgatgacttgtacctgtgttatttcttttcytttctttttttttgagacggagtcttgctctgtcccaggctggagtgcagtggtgtgatctcagctyactgcaacgtccgcctcccaggttcaagcaattctcctacctcaccctcctcagtagctgggattataggcgcctaccaccacacctggstaatttttgtagtyttaatagagacgggggtttcaccatgttggccaggctggtctcgaactcctgaccataaatgatctgcttgccttggcctcccaaaattctgggattacaggcatgagccaccacacctggcctgttatttcttttttctttctttcttttttttttttttttttgagacggagttttgctcttcttgcccaggttggagtgcagtggcgcgatctcagctcactgcaacctccrcctcctgggttcaagcaattctcctgcctcagccttccaagtagctgggattgcaggcacccaccaccatgcctggcttatttttgtatttttagtagagacrgggtttcaccattttggtcaggctggtctcgaactcctacctcagatgatccacgygcctcatcctcccaaagtgctgggattacaggcatgarccactgtgcctggcctgttatttctaaactgaacctttcattactttctttagccaaaaaacaggcctgctgcatgtacaggaggaagatagcaatgtttcagcctaagggtccaaccggagaaactaatatgcagagatggggctgtgagatggccctattgggttggaatcagaactagaagtcacacaaccttgaaccctatcagagcctcatcagctcagtttagggatagggcaggtatatcctccttggatattcactaacttgaaagttaaaagcagttttcctggttttcatgctggcagtctttatatgcaccaaatcttttctagccttcctggtgtacctatctttggagctgctcaccaccaaattctggaggtacacagctctaagctaatggtaggggcaggaaagacatgtggaaagaaataaatactcaagctgcccccacagagactgatctttcctgctgtgtcatcttccttgaggatggacaaacataacttttgtcccgagataatgtataatgtacactcttatcccttgactcccaccttgcctccccttcctacaataaccctccaagccattcaacccctactctcagtgagactctcactaactaccccccatctctttcttcccctactaggaaactgagcccaattaccaagtcctgattcgcatccttatctctcgatgtgagactgaccttctgagtatcagagctgagttcaggaagaaatttgggaagtccctctactcttctctccaggtgaaacttggctacttcttagcctggagcctcaggccttcactcctcacctccaccctcactccctgcacacagctgagcatattcttgccccatagaaaacccagtagttagccaggcacagtggctcacgcctgtaatcccagcactttgagaggctgaggtgggcggatcaygaggtcaggagttcaagaccaccctgaccaacatggtgaaaccccgtctctactaaaaatacaaaaattagccaggcatggtggcgtgcacctgtaatcccagctactcaggaggctgaggcaggagagtcgcttgaacccagaaggcagaggttgcagtgagccaagatcgtgccactgcactcccacctgggtgacagggcaagactccatcttaaaaaagaaaacccaggagtctttggttaatgtagtgcaggactctgagctcccgggaggacccttccctcccagatgaactgtgatggaccagcccaaaggaggggagagagcacttgggccatagtggtggtggatctttctaacactgaattcccttgtctgcaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaacttcgctgttgtttgtgttccctgattgaaggttgggtggagcaggacatggaccgggaagaggcactggagttggargtgcctttgatgtgcacttggctattccgcaggaatcctgttttgccttagtgctacagtaatccacacccaggtctcccactccaggtctcccctcaccctcattctccaggaaacttcaggcaaaataattgagaaacaggcattagaacaaggtgagaaatagagggagcaaaggaccatctgtatgaactgggaagcaagcggagggccaagctaccctccccagcatgggaattcttgggttagtggagagcacaaccctcaaattcatgtgtccaagcagagatttggaaacccacctcccaggagagcactatttcccatagaaaacaaaaacaaaaacagaaacaaaaacaaaaagtcaggctttggttccccctgcaggctatattagaaatgacaggtagctgggcgcagtggctcacgcctgtaattccagcacttcgggaggccaaggcaggcggattacttgaggtcaggaattcaagactagcctgaccaaagtggcgaaaccgtctctactaaaaatacaaaaattagctgggcgcagtggcgcatgcctgtagtcccagctactcaggaggctgaggtaggagaatcgcttgaatccgggaggcggaggttgcagtgagctcagattgcmccmctgcactccagcctgggcaayacagcgaggctccatctcaaaaaaaaaaaaaaaagaaaaaaagaaatgacaggtaaccaccttcctgcctctgacccacctccygctttttgcattcttcaattgggtcaaatacttaaccctattgcttcagggtaaggcaaacaacagatctcaggaaagaaggttttttttttttttagacagttttgctcttgtcgcccaggctggagtgcaatggtgcgatctcggctcactgcaactttcacctcccaggttcaagtgattctcctgcctcagcctcccgagtagctgggattacaggcgcccaccatgacgcccagctaatttcttgtatttttagtagagacggggtttcacctttttgggcaggctggtctcgaactcctaacctcaggtgatccgcccaccttggcctctcaaattgttgagattacaggagtgagccaccgtgcccggccagaagttttatttccaaaccccaggaaggcattacaaataagagatagaaacccaaattaagctctgaaacaactggagacaggcctgcctaggtgatcaggagcatccaggcagcagggatgggaagcagaagagatgcattctggatagggacctcaccccagagcctcagtctgtacatacgtgtgactattcagggaccgggagttgagaaccagaaacccaccaatcctagtgttgccctggrtgggaggcagagaaggcagcagcaygtgaggtcaaggacattaccaagtctgaccttggcatttgttgcctgctctcatccccaacagtccataaataagttatccagcacatctcaggggtggaggcgggggagcaagccaactagccatagcctctggaagaaggggcaggccagcctggcactggggcagagctacagcagaatgcagtctgactcgtgcttcggcctctgccgacgctccccggctgggcgtccagatgtggctcctctcccctgtatcggatttaacaattggtcactgaacttccttggaagagcacaagaagagattctagaagaaggggtgtcaggattgggacagagagtagggagaggaagacaggaaggggctccaggggagagggacaggcaggggaaggacyctgagagaagaaaccttgaagagaccagtgcaggaataacaggtgttctggacccggcaaagcatgaggtggaaaccgggagtgtgggcgcccaggcagcagcccacctgcagtgacaggacccgcgtccgcatccgcactggctgcgctgcctgctgctgttgatactcctcttgctgaagctgctgggccagctccaagtcrgtaagccccagcgggcctcgtggctgttgctgctgcagggacagagcaatcaggtagtcctggggagaacaagagttgtgcagtgggctgaggcccagagccgtggctattcaggcaaggtttccaaatcagttttcccacatccctcaaattctctagctctttctccccacagagcagcacacacagccaaatgcattatctgtggtgccagagaatacacaccaagtgaggagacggtctgaggtaacccagagagagaggcatgggttcacatggcctctagcagttaaaatgtatgcagtaaaaagctctctgaggcacatgtgctctctgcacttttcctaagtgccctacacacctggtctacctgcagctgcktttctggggagccactcccaccttctgctccaggccccttgcccagggaatgactcaggtgaaagtcagagtcacaaaagcagctgtctccatccacattgtgcaggctctcccatacgacttgctcctcctgtagaaagccctggtcagtgaccagtaggtataagtgactctacaaagaaaagaacagagctcattggggggacagttgatacggaggcagttcactgccagaaatctcggtatgagcatgtggacwttttttttcttggagatggagtctcgctctgtcatccaggctggagtgcagtggcacaatctctgctcaccgcaagctcygcctcccaggttcacaccattctcctgcctcagcctcccaagtagctgggactacaggcacccgccaccatgcctggmtaatgtttggtatttttttagtagagacggggtttcaccgtgttagccaggatggcctcgatctcctgacctcatgatctgcccgcctcggcctcccaaagtgctgggattacaggcatgagccaccgcacccggaccctgagcatgcggaccttttacaaatatgtgtggccttggggggaagaaagggatgtctgagtgtatgtccagttgggtgtgagcacggtggtcattctggctaagcgtggcatggagtcgttggggctgagatgccacataagaccctgctccccccatttcccattgttctctgggcttgcctgatggctcttaggataaatcctttgagaaccagagacccctccctctgctgctcaaatcctagagagctttggcagtttctaacttttgaagaccagcattgtttaaaaattccactgccccctcctaggggaggatcatactttcctgtcccatcgacggcaggcttatcccttatggcttgctctggccagaagatgtgagcagaaatgacatgtgtcatttccaaacagaagctctaagcatgagtgcacagtgcccctctctctctctgttcccacatatattccagataaaggatcttttgtcagctgggtcccagagtgaagatggtgtgggacagaaccgtagccagtccacagtggacacgcaccaggagcgggaaatgaacctttgttgtggtaaaccacagggatttgaggggtcacttgctaccacggcttaatctagctgatcccagctggacccacgagaaaaaggcaccaggaaatgacagcaccgcagcacgccacccccaaactcgcattaccttatgcttagtcatggtgctaaagtggttgtttcggaaaaagacgctaagttcaccctccttagcagctgctgtcagctcacacagtccgtggtaggtcagctgggccgcggtggwctccaggaactgctctgcaatcaggcctgccagaaagggacgagtcgggggaaacttggcttaaattcaaggtccacaacaggaaggaccatccagagagcccctgtcaaaagccccggggggtcagtcccaccttctgacgtccctttcttgaaacctggctgtattcattcacttaacaaatacttataatagagcagctaccttgtgccaggcactggggatacctcaatgaactaaacagaaattccccaagctccttcttgtgaagcttatatctagtgggatgtggtaggagatgacacccaataaaaaataagcctaagtagctgtcattccctccacatactatccatgagaaggggaggaatgtcaccttctgtcacgaggttggtgtcactggagtgtttgcaggtgatgrtcctctccaccagctggttgtaactcagtttcccaactgcacgcacagcctcaggactctgcttgggtagtgggatgtgggataccaaaaaaattgggatttttttttcttttttaaggaaggaaatgaacaaagctcacaaggactacaaccctrkgatgaatggttcctaaacactttttttttttggtctctcaaaaaagaaaaaaatttcaggaaccattcatcatagggttgctatgttgcccagactggcctcgaactcctcccaagtagctgggaatacaggcatgtgccaccaaacccatctgcttcctgaatttttgatgtctaaagaactgacctatttgcatgtagtttgcttgtatttgcatgttacccccaaaatagattaaaattcaaggaattctgtactgggtccagtctctaaacactatttccctcccaagccaatctaacccctaactccctaacctctacccgacaaaaatttgcctctctcatgtcagcttgagctggataaggtcccagtgggccctcccaccctcacctgtggatcaacaagccagccatggtacagaggtatgcctagcaggtcaaagacactgcactcgggtgtatactcaaaatcagagacgcctgtgaatcgcacattgacatccagacctgtggccagtttaggcagcactgtcattgcatcatccacattctgggggtagaaaaaaaaatgatggagattctagccttctctcccaccactccactcccacctgcagaaattaaaaattaaccttgctgctcttcttccctgattctcttacaagccactccatttctcccttgcctcaacccttctctatcttatataaatgaacattgtttttctttgagagtctaagtctaattctttcatccaggctggagtgcagtggtgtgatcctagctcactgcagcctcaaactcttggtttcaagtgaccctcccacctcagcctcctgagtagctgggactacaggcacgcaccgccatacctggctaattcttgaaaaaaaaaatggttttttttagagacaggggtattattatgttgcccaggctggcctcgaactcctggcctcaagtgatcctcccrctttggcatctcaaagtgctgggattacaggtgtgagcacccggccaatgaacatattttctaggacaaagataaactctcctctgactcctgcagaatgaaatcatggttcaaggaaacctctgaagaagcaacaaaagcttatcttagtattacaagatgtccccttacaaacctgcaaacccctatgcctgcagaccttttgcctcacctgctgaaaattaagctgaagtccctctgacttctcctggggcttgatggacaggaggcagtttcctacaagacagggccccttatcagcttaccccaccaatcatcccaaaagctaagtttcctcttctcctggagaatgcgggtaatgtcacagaacacagattttcagagctggaaaatacttagagtctaatccagactcttcatttctcagaggaggcgrcagcctcataaaggtgaacggcccacccagggtcagatacaaaagctaagggcagaattggtgttacaacccaggactcccgacgcctttgcttttcattctccagccttgcagagaagccccatagaccyttaccctccctgctgtatcagaacccccaaatggagatccctgaatagtctggatttctggctgagtggatagctctggarccccttgggtaattcctcttcaacgcccagtcactcaccaagatgggccatgagctcatccgatgtgatcacttccttctgcggggggagcttcacctggaggcagaaggggtgatcacgtgtgtgctttcctccaaagagcactgaargaagaacccatggaaaggcaagggggagctccagtagtagggtggggtaggaaaaaaggcttgcaactggcacaagggaatgaatgtgaaatcttgcaaggcatgtgcatttgctagggagtaggagatacaggggtaggacagatcttcctcttttttttttttctttgtttttaggaacatcttatctcatttgctcaagctggagaaatagggagaacaatctgaaaagttttgactagtttgaggacatcaggatgatcaaggaagtaagtcagggaagagtactccctgatattttttgcacccctaactg

SEQ ID NO: 13354 - DNA, 47444 bp, Homo sapiens
  misc_feature (1)...(47444): n = A,T,C or G, or insertion/deletion polymorphism (see Tables 1-2)
gttgcctaatcaccacgtttatgctctgtactgagtgtagatttatagacctcgtcagacagagaaacaatgactggaaaaatacatggtcccttgtaaaagcagttgtctaccatttaatcttgatggaaagaaatttgttcctatgctaatttctcattaaggaaattgaactgtctatttctatggatagaaatacatatagaggtatcaaggctaaaagcaaaaaacatcaggtatgagatcagatgtgtaaagaaggatagagaaggcaacctgaaattattgagagctccacaatagctttcttcttgagtttcctgtattcgcagcctgagaaaagcaccttccccattctagcttctgacactccacccttgtttttccaaactcaacacggctgtggatgtcaatactaggttcatctatccgggtactacagtttatttaaaatgtgcaggaagcagccaggcgcagtggcttgcgcctgtaatctcagcactttgggaggccaaggcgggcggatcatctgaggtcaggggtttgaaaccagcctggccaacgtggcgaaaccctgtctctactaaaaatacaaaattagcctggcgtggtggcgcatgcctgtaatcccagctacttgggaggctgaggcaggagaatcgcttgaacccgggaggcggaggttgcagtgagccgagatcatgccattgcactccatcctggacaacaagagtgaaactccatctcaaaaaaaaaaaaaaaaagtgcmggaaactcaaagaacctatgaaaggccagaaagtcggtgaggtttgtttattgtgtaaccacaaacatcaccaaaaccacagagaggactgctcaacctatgatgccactgagcagacacaatatttgacataaacactacagtttgaacaggtgacactggggaccagatrttagaatatctgctgctgctcctgctcctgctggtgctgctgctgctgggagacatctctactgccattctcaccaaaaggaggattttacatacttctggttcctcacttacccacttgcaaaatgatgttctatacaggtgtgcctgactggcaaaggctaggtctcatgtctgtgccttaactgcactggatccttgaaaatggagctttggcttcaacttggagaagcaaaatttataacgtgggaaattctccaaacatgggaatattgttcaaaagatgctaggtggccataaaaataaatgaacactgtatatactactgtggagttatcagaatttaattgctaaagtatagtttctaaaaagctgagagcaaatatacaacgaacgcatcgaagtttaactcattaattaataagggatcagtaagattaaagtcagttcaaataagaatttgaggccgggcatggtggctcatgcctgtaatcccagcactctgggaagccgaggtgggtggatcacctgaggtcaggagttcgagaccggcctggccaacacggtgaaaccctgtatctactaaaaatgcaaaaattagctgggtgtggtggtgtgcatttgtaatctcagctactggggaggctgaggcaggagaatcgcttaaatccgggaggcggaggttagagtgagctgagatcgcaccactgcactccagcgtgggcgatgaagtaaggccgtgtctcaaaaaaaaaaaaaaaagaattcgactgacagagatctacattctctrtttctctattcagtgaaatctacaatacaaaatttatttgcattgccatgtatagggatcatttgcatagttatcagttttttacaacttaactctaaaaagaatcaaacaattcctgtaaaggtccactaaataatacccagcacatcactgaaaggacacctgctaatgtctttcgcctgaataatttttcttaataaaatgttaagtgattgactaaaacaaaaaaaatgctaagtgaaaaaaacaagatagagaaaaatatgtgtaatatgttagtgttcacttaagatgaaagaatattaatatataggcatatttgcatatttctaaaaataggaagataaaccataaattttttaaatgattaccaattaaggaaaaaaggaaatcgtgtaaaacagacaaaagtagaggctagagttctttgaatatacctcattgtgatgatttcactttggatccacataaatgttttacataattataaaatgaaattacataagtgtaaaaagcaagccctaaaaggaagaagtgaaatgaaacaaataaacctgtgtatggaggtggagcataaccatacagggaactattccaggtgacttcaaaacacagtaattgacttacatcgttagcgacatttggcttaatggagaaaaacctgtccccctccactttaaaacctctaatttgttttcattaacaatcttattggcgtaggcttgttgttgttattctgcaattttacaggataaattaaacaagtacttgagttgatattttagagaacccagattttttaagcatgtttgaaaagaagtgcagatataagattgatggggtgagtaaaccctatagtcttgaatttgaatttgaagtatcagtgtcagcttgtgatttatttaatttttttaaaaaagatatttcttagctctagctactgaaaaggcttagcaacaatggtcaatctgctatcccaaacactgctagttcctagattatggtatttaaacattgtttccactaaaaggaaccagagctccttggagaaatggctgattccaggtctggggcaggaattgttcaagacaaacctgcaatagcctgtcatattagaaagaaaggaagcttttaaagagtactaatattatgccaaatatacaaactctgtctgcaccaaagagccagtttgaataaattcctacagaccaaaaatgagacaatatgagtatcaataaggataaaactggaatggattgaaacacatcaaatatgtttaaatccatgaattcataatgatataaacataactcaatggtttcacaatatatggagcttatttaaatctcaattcaaacaaactattaaaaaatgtataagacagtccagaaaatgtgaacattgataggatgtctgatgacattaagaaattattgtcttaatttcttatgacaataaagtggctcacacctgtaawcccagtacttagggaggctgaggtgggcagattacctatggtcaggagttcgagacaagcctggccaatgtggtgaaaccccatctctactaaaaatacaaaaattagctgggtgtgatggcacatgcctgtaatcccagccacttgggaggctgaggcaggagaatcgcttgaactcggcaggcagagattgcagtgagctgggatcacaccactgcactccagcctgggcaagtgagtgagactctgtctcagaaaaaaaaaaaaaagaaaattattgttcatttattttagatgtgatgatggtattgtggtattatatttgtttaatagtctctgtcttttaaagacacacacagggacatttacgtatgaaatgacagaatgtctagaatttatttaatataattcaggtagtgagagtgggaatataaataaaataagattggccatgtactgatcattgttgaaacaagacaatggtttcacggcagctcattttactactatttttacttttacatgtgttttaaattttccataagcagtatctttttaaaaaaaactgtatggctacaaacacaaacatgtctactacagctgagatgaatcaacattataatgatgttacttctccctaaatttatgcatatattcaaataaaaactctaatagccagatgtgggggctcatgcctgtaatcccagcacttcaggaggccaaggtgggcagattgcttgagcccaggagtttgaggccagcctgggcaacatggtgaaaccccttatctacaaaaaacaaaaaacaaaatcagccaggcatggtggtgtgcacctgtagtcccagccactccagaggctgaggygggaggatcacttgagcccaggaggtcaaggctgcagtgagccatgattgcatcactgcactccagcctgggtgacagaatgaaaccctgtctccaaaagaaaaaagcaaaaaactccaacagagtttttcagggaacttgataaactgattcaaaaaattcatataaagaagagttaacaagtacaaaatacaaagacaatgtttaaaaagaagaacaaagatagggtggcctagatgacttgccttaccatacgtggagacatattacaaagctgttttaattaaaactgtgtgatactgaagtagcaaaagataaaaagaacagcttcatgagctcagaaactgacctatctatgtatgagaatttggtgtacaatagaggtagaatcaaaattggaaaacaaagaaaataagctccctacgtcataccatacacaaaactaaattccaggtgaattaaacacctaaaagcagtagccatagaaaagataaataaaacactctctgaaagtataaaaataagatgagtgtatctttattacatttggatgaggaaaattttcttatacaaaaacagtatagattgattatacggaaaagctgaataaaatgttctacctcaacataaaaaaawttcatatagaaaaactcactataaacaagactaaaggacaagtggaatttcataggcttatgcaaaggaagaaaaaataaaataaaagacaagtggaagactaagggaggatgtttttaagggtatataactgtcaaagattagaagccagaatatatttttaaaacacatacaccttggccgggcacggtggctcacacctgtaatcccagcactttgggaggctgaggcgggtggatcacgaggtgaagagttcaagaccagcctggccaagatggtgaaaccctgtctctactaaaaatacaaaaattagctggacatgctggcaggtgcctgtaatcccagctacttgggagtctgaggcagagaatcgcttgaacctgggaggtggatgttgcagtgagccaagatcgcaccaatgcactccagcatgggagacaaagcacgactccgtctcggaaaacacacaacacacacacacacacacacctcccacaaatcactaagaaaatgcaacaatacaatagaaaaatgagcaaaaaagatgaacaggaaattcacagaaaattcaaacggtcaataaatgtgtgaaaagatcctcaacctcattagtaattaggaaaatgcaaatttaaaagatgatagttcrtcttgctcccaccccacccaggtaatcattctcaattrgatatatttgagtgtatccttttttccatgaatatactaacacatacacacacacacacacacacacacgcatattactaaactatacatatagtatatattaataaagacattttgagtttgatgaacgaaggaatggctgagtgagaaccagacaatatcagatcatgaatgagttgtgttaaaagcagtaagacaggttttcctaggaaatcatacaaggagctgggatttggggagctttatctaaatctctttataactaaatgttttccrtgtaaaagttggtgtttttaaaattcaatttaattttttttttgagatagggtcttgatatgtcatccaggctgaaacacagtggcataatcatggctcactgcagccttgtcctcctagactcaagcaattctcccacctcaccctccccctcagctgggactacaagcatgcaccacyatgcccagctaattaaaaaaawtttttttgcagagacagggtctcactatattgcctaggctggtcttgaactcctggcctcaagtgatcctcccgcctcagcctcccaaagtgctgggattataggcatgagccactgggctcagacaagggctcttcttgatggcttactgtatccactttgtccccaagaccatagggaaatgactagaggtgactgtactagctagattttaaatgaaactgaaatgaaagttcacttcctcattttgagtacctcatgtgacaagttccaatttcttttcaagtcaattgaactgaaatctccttgttgctttgaaatcttagaagagagcccactaattcaaggactcttacygtrggagcaactgctggttctatcacgtatgtactctttgttctttttctcccatttggtcttcaaacactctgtgtttgtaacttgttctgcctgctaggttttaaatctttggtttcaggaagtaaactaaaaaatcgtgtcgttcaatttgcctcttctctatttttaaaaagttaatgtctgcttgagcatctaagcatctaagttgagactgaaacatggctttctttggaatataatttaaaggcttacatgtttaaaattccagatgttttcaattaaaaagaaatggaaaagaaagtagaatccagtttgagggagctagtcgctgaatttctgttgatgtctcttgaattaaatacagaagtggcattttaaagagtagttaattgcctcatttgaaacagatgtctgatcattraaaaaaaaaaaacgtaaaaaggaaaattacctacctaaagatgtgaaagcaatagatgagaattgtcttttaactatctgtaaagactgtggatatttaaacaggtcagttaagaagagcccatgtattcaaaaattcaggagataaactgatttttcagaggtttgtctctcttaaggatgatttttttttttttttgagagagagagaaagagatttcctttgattagatttgttggcaaatcctggaaagtccctgttttctaaccctctagatgtgtttggtttaccagatattgggaaattcctggaaatcactttttaaagtgctactaagcattggaagtagtatttctgacataaatctgcagctgttccctgtgactatatatcccaggaattttcctgtataattctgtttataatagtctgtccctttgatagactttgcattgttattttctcttatgaaaacatgtggtcacaacatatgcagctaatagcaacacttcctatgttacctttccttacacagaatgaaacggctggtttgtgtgctcttggtgtgctcctctgcagtggcacagttgcataaagatcctaccctggatcaccactggcatctctggaagaaaacctatggcaaacaatacaaggaaaaggtagattggattgccactcgagcgatatgcttttaaaggagtactgttttctacctcttaaaattgtgttcttacaggcagtgttttcagtaaatatttaagctgggtgtggtggctcgcgcctgtaatcctagccctttggaaggccaaggtgagcggatcacctgaggtcaggagttcgagaccagcctagccaacatggcgaaaccccatctctactaaaaatacaaaaattagctggatgtggtggtgggcgcctgtaatcccagctactcgggaggctgaggcaagagaatcacttgagccgggaaggcggaggttgcagtgagccaagattgtgccattgcattccagcctgggtgacagagtgagactccatctcaaaaataaataaataaatattatgtacttgtttcttgccagatactgttcttggtaccatacagcaggaatcaaaacaaaattcctgttatggagcttatattatagtgagagagacaggaaataagaaaataaacaagcagatatgtagtatgctagatggtgataagtgttgtagataaaaataacagaaggcwtggagagtaggaagggccctgggtggtggtggtggtaagaagtctatctatatgacaggagggttagggaaggcctcacggataagggtgccatttgagcagagaattgatggaagccagggagcaagcaaaatacataatagagtgaaggtctcaggccaagggcaaatcagcacaagctcctgaggaagggccacatttgggatggctgaggagcgaaaaggcgttaatacccacatagtgtggccagatattgtttcttgactatcacttcccattttgtacttttgtttttatttcaaagcacacttgctgatgttaagaccttaaccctactgctttaaataactaagtcctgtaactatgtaatatttctgtttgtaagctagcatcatatatttatttatttgacatattattttgtataaaaatgacactcttaggtcatacactctaagttttatttttatttatttataattaaataataattgtgtctatttatggagtacaatgtgatgttatgatacaaatatacattgcagaatgattaaattaggctaattaacctattcagcacctcacatacttatcctttcattgtgataagaacatttaaaatctaccctttcagtaattttgacatataaaatacattattattattatctgtagtcaccatgctatgcaatagattgctagaatgtagtcttcttgtcaaatgaaactctgtactctttgcctaacatctcccctttccctgtctaccctccgcccagcctctgctaaccaccattctactctctacttttatgagttcaactgttttagattccacatgtaaatgagattatgcagtacttgtctttctgtgcctggcttatttcacttagcataacgttctctagacccatccatgttgttgaaaatgacagaatttcctttttttttttttaaggctaaatagtattccattatgtatggaatacaatatgtaccacacttttttatccattcgtcttttaatggacactttataaggttgattccgtatcttggctattgtgaataatgytacaatgaacatggaagtgcagctatctcattgacatactgattgcgcttccttgggacatatacccagaagtgagattgctggatgatatggtaattatatttttagttttttgaggaacctccatactgttttcccaaatggctgtactaatttacattcctactaaaagtgtatgagggttcccttttctccacatcctcaccaacacttatctttcatcgttttgataatagccattctaacagatgtgaggtgatatctcattgtggttttactttacatttccctgatgactggtgatgttaagcattttttcatatatctgttggccatttgtatgtgtcttgttttgagaaatgtctattcaggtcttctgcccatttttaaacagggttgttttcttgatagttactttgagttccttctatatttgggatattagccccttatcaaatgtatgatttgcaaatattttctcccaatctatgagttatcttttcactctgttaattgtttcctttattgtacgaaagctttttagtttgatggagtcccgttcgtctatttttgctattgttgcctgttctttaggggtcatattcaaaaaaccgttgcccggaccaatgttgtggagttttcccctatattttcttatagtggttgtatatagtttcaggccttatgtttgtgctttaattcattttgagttgattattgtatatggggtgacataagggttcaatttcatttttctgcatttggatagccagttttcccaatactatttattaaacagactatcytttccccattgtgtgttcttggcacctttgctgaaaattgattgaccataaagttgcaggttatttctgggctctatatcctattccattggtaaatgtgtctgtttctatgccagtactatgctgtttaaattactatagttttgtaatatattttgaaaccaggcattttgtaatgcctccagctttgttcctcttgctaaagattactttgactayttaaggacttttgtagttccgcatgaatttgaggattgttttttctatttctgtgaagaataacattagaattttgatagaaattgcactgaatttctagtttgctttggatagtatgaacattttagcaatattaattcttccaatccataagcatggaatatcttcccatttatttattttatcttaaatttctttctttcttttttctttttttcttgtttttttgagatggaattttgctcttgttgcccaggctggggtgcagtggcgtgacctctgctcaccacaacctctgcttctggggttcaagcaattctcctgcctcagcctcctgagtagctgggattacaggcrtgtgccaccacgcccgggtaattttgtatttttagtagagtcggggtttttccatgttggtcaggctggtctcaaactcccgacctcaggtgatctgcctgcttcggcctcccatagtgctgggattacaggtgtgagccaccacgcccggcctattttgtcttcagtttcttttatcaatgttttacagttttcagcatataacttttcaactccttggttaaattaactcctaaatatgttttaaatgctgttgtaaatagaattgttttcctaatttctttttcaaatagttgttagtgtataaaaatactactgacttttgtatgttgactttgtgtcttacaactttactgaattcatgtatcagttctaatagttttttgatggagtctttcttctctcttttttttttttttttttgaggcggattcatgctctgtcgcccaggctggagtgcagtggcgcaatctcggctcactgcaacctccgcctcccaggttcaagcaattctcctgcctcagcctcctgagtagctgggattaccggcacacgccaccacacctagctaatttttgtgtttttagtagagatggggtttcaccatgttggtcaggctggtctcgaacttctgacctcatgatcaacccatcttggcctcccagagtgctgggattacaagcataagccgccttgcccaaccttctttttttttttttttgagatgagatcttgctctgtcacccaggttggagtgaagtggtgtgatcatagcttactgcagcctcaaactccagctcaagtgattctcttgcctcagccttccaagtaactgggactgtaggcacatgccaccacacctggctaatttctatttttgttttttgtagagaaggggtcttgccatgttgtccaggctggtgttgaactcctagattcacacaatcctcccacctcaacctcccaaagtacaggcatgagccaccacacctggccaagactttctatatgatcatgttatcaacaaacaaacgcaatttcacttcttccttctcttatttggagatcttgtatttatttttcttgcctaattgctctggctaggattttcagcactatattgactagaaatggtgagagtgggtacccttgtctttttctgatcttagcagaatggcctttaaattttcacccaattgagtatggtgttagctgtagtcttgccatatatggcctatttgtgttgaggaacattccttctatatgtaatttgttgagaatgtttgttatgaaaggatgttgaattctgtcaaatgcttttcctgcatctatttaaatgatcatacggtttcgttggtggtgatgaatttcaccctcacccacaccctttatgaacaggttcctcatttcaagattgactggacttagatgtgcaattagcaccactatctggttaaatgaatgctatccctctgtttaataattccagtccctcaggatgaatgaacctgacttttgattcgtatcctacctttataattgatctcaaagtgcacttctttttttttttttcctttcttgcacttagttagatttgtttgcctttayaccattgcttctcatcttgtggtttggaagtaagcccatcatgcatgcccattatgtccattactggggtaacagtaaaaccttgctccaagggaaagaaacctgcatccagacttgctacccagtgcctctgggactgggctcacccgctcaatgaaatgaggcagaacacagttgttgctgactgctccctggggttccagcttattggaaactctggcttcagctactgtaggaggcaccatccaccttgccttctacatcattgtattctatgtaaatgaatctcctgaaggacaagaaaatcgtcggtcagcatgtaaattcactctgaataaaattaaaataatagaatcaaaaatgaattttcaaaagactatatataaaggaataatatgcacactaatggacaagaaataaattagaaatcttgaaaataaaaaatattgtcattgcgataaaaatcaaaaggatttccagactggaaagagctggatagaatcagtaatctgaaagatagtactgaggaattcacccagaatgcagcacctagaaataaaaagaaaaatatatgaaaacgcaagtaagagagatgaaagagagtttgaggctccaaaatacttcggataggagtttctgaagaagagaattaggtggaatggtggagaagcaatatatgtggagacactgattgagaattttccagatatgagaaaaggtcctgagtcctccaatcaaaagcacacagccgaaggtaaataaagaaacctacacccagatacatgtaacgaagttgtaaaacatcaaaaagaaagagcaaatcatggctgggtgtatggttcatgcctgtartcccagcactttgggaggccaagggggaaggatcctttaaggccaggaatttgagaccagcctaggcaacatagggagaccctgtctctacaaaaaaaaaaaataataataaaataaaaataaaaataagctggttgtggtggtgcaggcttgcagtcctagctactcgggcagctgagatgggaggatagtttgagcccaagagtttgaggctgtagtgagctatgatcataccactgcactccagyctgggcaaaagagcaagaccctgtctaaaaaaaaaaaaaaaaaatgctgggcgcggtggcttacaccaataatcgcaggactttgggaggctgataggggaggattgcttgagcccaggaattcaatatgagcctgcaacatagggagacccagtctctaccaaaacaaacaaacaaacaaacagaaaaactggctgcagtggcacacaccagtcatcccagctatgcaggaggctgaggtgtgaagattgctgggtcccaggaggtcaaggctatggtgagcagtaatcaggccacttcactgcactccatccagccgagtgacagagcaagactctgtcaaaataataataataataataataaatgttaaaaagagaaggaaattcatgtttatcataaaataatattaaaccatcaaagcagttaagagcaagaattaagattaatatgtgaagttagcagttatattggatatatttatgtatttgcatgctctcgggcagatccacatttggtagaatgcttcaaaaatgctatttttgggcgggtgcagtggctcacacctgtaatcccagtactttgggaggctgaggcaggcagatcccctgaggtcaacagtttgagaccagcctggccaacatgacgaaaccccgtctctactaaaaatacaaaaattagctaggcgtggtggcacatgcctgtaatcccagatactcggaaggttgaagcaggagaatcacttgaacctgagaatcggaggttgaagtaagctgagatcgtgccattggactccagcttgggtgacagagtgagactccatctcaaaaaaaaaaaaaattgccattttcatcatcaaacacttatttgtccaggatgcagtatgactatgttcttcttcattatgttttagaatgaagaagcagtacgacgtctcatctgggaaaagaatctaaagtttgtgatgcttcacaacctggagcattcaatgggaatgcactcatacgatctgggcatgaaccacctgggagacatggtaggtacattacaagaaatcccactttcacgtctgggtaaatatcatttccttyctgtctccccaaaagcaatttgaaggtaaacaacaataacaaaggaatgtatagtacaaagttggaaaacagtagaattgaaggacgtaagaacktgtacagaaatttcttacttagttctattttgactgctttctttctttaacaaatcacttctttagaggaaattttaaactcagagactaccattgttttttttttaataaattctagaaagtattacctaaagactattgacaggtttttatagcaagttgccatacttatttaagtctagattgacaatttagtatgayccatctgctttcttaatgggagaatgtgggtatttaatatcacaaataatcccctattggttttcagattctgttctgtcctgcaaaactttaccactgttgccaaagtgaagaagggaacgccctaggtagactgaattccttcttaaatgcaggaatctcctttgtaattatttctcacatgggaaaycagtttagtccactttttagacagcccttttataaaattctgccttgctttgaaacaaaaatctgcctccctgtaacttctagtttttaccattctctttttctccttccccatgagggtgcctagctgggatgctagtgccaagtgtgaaactaaacaaacccagataattcgccccaccagatcctaatggaacctgtgttggtcacaactattactgttttttctcagtttttttattccatggcagtttttaaatatattcacagttacagttattaggatattagaaagtaggataggctgggcacagtggctcacacctgtaatcccagcactttgggaggccaaggtgggcagatcacctgaggtcgggagtttgagactagcctgaccaacatagagaaatcctgtctctactaaaaatacaaaattagctgggcgtggtggcacatgcctgtaatctcagctatttgggaggctgaggcaagagaattgcttgaacccgggaggcagagattgcagtgagccgaggtcatgccattgcactccagcctgggcaaaaagagtgaaactccgtctcaaaagagaaaaaaaaaaaaaaaaaagaaagaaagaaaagaaagaaggatgtaagtgaaagagatatatagtcatgtgtcatatgcattttggccactgatggaccacatataccatggtggtcctttaagattatgatggagctgaaaagttcctcttgcctagctagtgatgttgtagccaccataacaatgtagcacaacacactactcacttgtctgtggtgatgctgctgtaaacaaacctactgctctgccagtggtatgaaagtatagcacataaaattttgcacagtacaaaatgcttaataataataaatgactatgttactggtttatgtatttactatactatacttttaattgttattttagagtgtactcctacttatacttttaaaaagttaactgtaaaacagcctcaggcaggtccttcaggaggcatccagtagaaaacattgttatcagaggagatgacagctccatacgtgttgttgcccctgaagaccttccagtgggacaagaggtggagacgraatgcagtgatactgatgatcctgaccttgtataggcctaggctaatgtgtgtgtgtgtttgtattttagtttttaacaaaaaagtgtaaaaacttttaaaaaattaaaaatagaaaaagcttatagaagaaggtgataaagaagaaaatattttcgtacagctgtacaatgtgtttgtattttaaggggttaccatagaagacaaaacatttaaaaaattaaaagtttattaagtaaaaaagttgcattaaactaaggttaatttattattgaagaaagaaaaatgttttaacaaatttagtgtagccaaagtgcaccgtgtttataaagtctacagtaatgtcctgggccttcacattcactctccactcactcactgactcacccagagcaactccaggcctttcatagtaaatgacctatatagaagtaccatttttactttttttttttttctttgagatggagtctcactctgtcgcccaggctggagtgcactggcgcgatctcagctcactgcaacctccgcctcccaggctcaagtgattctcctgcctcagcctcccaaatagctgggattacaggcatgcaccaccatgcccagctaatttttgtatttttagtagagatggggtttcaccatgttggccaggctggtcttgaactcctgacctcaggtgatttgcccggctcggcctcccaaagtgctgggattgcaggcgtgagccaccatgcccagctcccatttttactttttatactgtattttcactctaccttttctatgtttagatatatttagatacacaagtacttcatattgttctacaattgcctacaaccttcagtacagtaccatgccgtgcaggtttgtagtttaggagcaatgggccctaccatacagcctaggtatgtaggagccaatacgctctaggtttgtgtaagtacacactatggtgttttcacaatgacaaaatcacctaacgatgcatttctcagaacatattccagtcattaaacaatgcctgactgtatatttgctttgtagaccagtgaagaagtgatgtctttgaygagttccctgagagttcccagccagtggcagagaaatatcacatataagtcaaaccctaatyggatattgcctgattctgtggactggagagagaaagggtgtgttactgaagtgaaatatcaagtgagtattaccatcccaagcctctgaaccctaggtagagctctttaaatgcttagtctagctacagaatttgacagtgaatyttacagtcccacgtgttactttctagttatttttgttattcttgtcttcccaactaaattataarttccttaagggcaaggatcacatattatattttatttatacagttggccctccatatccacagcttccacatctgcagattccaccaaccgtggatcaaaaatatccagaaaaaaatgaaaataaaaaataggccaggcactcacgcctataataccattactttgggaggctgaggcaggcgcatcacctgaggccaggagttccagatcagcctggccaacatgatgaaaccccgtctctactaaaaatacaaaaattaactgggcctggtggcacatgcctataatcccagttactcaggagagtgaggcaggagaatcacttgaacctgggaggcagaggttgcagtgagctgagatcacaccatggcactccagcctgagctaaagagcgagactccatctcaaaaaaaaaaaaaaaggtaaagtataagggagggccgggcgtagtggctcatgcctgtaatcccagcacttttccaggtcaagggaggcagatcacttgaggtcaggagttcgagaccagcttggccaacatggtgaagtcccgtctctactgaaaatacaaaaattagcctggcgtggtggtgggcgcctgtaatcccagctactcgggagggtgaggcaggagaatcacttgaacctgggaggcagaggttgcagtgagcysagatcttgccactgcastccagcctgggcgatagagtgagaccctgtcttaaaaaaaaaaaaaaaaaaaagtgtataggaggatgtgtaggttatatgcgaatactcagtaatttatataaggaacttgaaaattcttgactttggtatgctcagaggtcctggaaccaatcccttgtggatactgagggacaactggattctccacagtggtttttgttttgttttgttttgttttgtttgagacagggtctccctctgttgcccaggctggactgcagtggtgcgatctgggctcactgcaacctctgcctcttgggctcaagtgatcctcccatctcagcctacacggtgactacaggcacacaccaccactttttttttctttgtatttttagcagagatgggttttgccatgttrcccaagctgatctcaagctcctgagctcaagtgatcctcctacctccacctcccaaagtcctgggattataggcatgagccctcgtgttcagcccccacagtgcttttctaagtgatcatagagccacctacttagacaaacactgaactaagcaaataggtgtttaacacagacttttattgctcacrctatgcattgactgcactggactctccaataagccaattgcttgagaagcagtgttgtgtgagagagccctggtgatcaggaagtttctccatttcacttgtgagtttcaaagttgaaggagaagaaagaactagagatagagtgttctataaattgagccactcaagttaattcatggctagtcttgcatcgttagaatatgaaatatgtgccttgtaaaattattgttcctatgctgttgtattttcctttagtttgcttgttttaaaaaaattgcaaaaatcctaaattagttagaggtaaaacacatgtatcaccatagaggtcagggtaagtgagaggaatcaaagcattctgagcagctaccccaggttgtgatcaatgaagaaagtaaaaatttattaggaagtaaatggtggccaggcacagtggctcacatctgtgattccagcactttgggaggcagaggcagaaggatcgcttgagcccaggagttagaaaccaacctaggcaatatagtgaggccctgactctacaaaaaataaaaataaaaattagccaggcatggtgcgctcctgtagtcccagctacttgaggggctgagatgggaggatcgcttgagcctgggaggttgaggctacagtgagccatgatcacaccactgcacttcagtctgagtgacagaaggaaaccctgtctcaaaacaaacaaamaaaaagaagtaaatggtactgctaatctcttattcttttccacctacatatttttctttcaattagttttggatttcttacccgaggttctctaaaataacagcttttagaagacccaataaaccacatatttagatgttaactctgagtaagttaatgagctcctttctctgggtgcttgcattttaatgaacaattttgcttcaatcaaaagcaatgtcagtttgcttccttttggtggagagcaaggtgggaggagggaaggagagagaaagagaacaattatgatggggctctggacactctgccccttttaaaactaaagcagctttgcctttttttgtttgtttatgcctccttgtaaaatattttttaatcaaaaaaattctgaagataacaaaggtttgaaaaatgccaacctaggattaaacttcttatgtttcaggcatcatatgacaggagaaagggtattttaggtcaaggaaatcatcctagctctctcaaaatctcattactgtaggcaactatctcccttacttatgggtgaaaataggtgcaatttggtacatgctcagtgagtattgtttctaagtatatttgaatatggccattatgttctgagcttggctgattgcaaatctctatcaaggttggaccttgcctagataacaattgagttaaatttagtcttcattcccattgttaaagacagaaggaaactgtagtgggggagctctttctgggaactagggacagaactgatgtagctgagcgttgtccagtttgggttatggaagtcattccgaatgattttctgtgatttgcgtttgtgaccttgtatctgttttagggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggtgcgtctwaagcaaactttttgtgctgccccatgatctcatgttatccactgactgactgtgctgggcttgccaccatgccaattgcttgagaagcagtattgtgtgtgagagagaaccctgaagaggaattcttaaattctcaagagttctgtttctgatgaagtactcttcttaatatatcagtagtacaaataaggaagtagcattcatgcttaaaaacagattttaatgactgggcgtagtggctcatacctrtaatctcagcactttggaaggccgaggtgggtggatcacctgaggtcaggagtttgagaccagcctggccaacgtggtgaaaccctgtctctaccaaaaatacaaaaattagccaggcatggtggtgcatgcctgtggtcccagctactcgggaggctgaagcaggagaatcgcttgaactcaggaggtggaggtgcagtgagccgagatcacgccactgtactccagcctcggcaacggagcaagactccrtcccaaaattaaacagattttaagcaaactatccttaaaattatttctctgtatttaaactttttcttctgcagcctcccatgctcaaccttattctcagatcattaaccacatcattcttccacccactgagaagctaaataacactctcctcttcctcagaaattcattatacattttgatataacgataacctaaggattgtgtccatgttacagaagattttaaaaatataaaaatatcactcaaaaaccttctaccttaaccactattgttttggtttatttctttcaagttattttcttgttaagcacttaaaaaacatagttggccaagtgtggtggctcacacctgtaatgtcagcactttgggaggtcgaggtgggaggattgcttgagctcaagagtttgagaccagcctgtgcaacatagtgagacctcacctctactaaaaatcaaaaaaattagccaggcatggtggtgcacacctgagtagcagttccagctactcaggaagctgaggtgggagaatcacttggcccaggagttggaggctgcagtgagccatgattatgctactgcactccagcctggacaatggagtgagagcctatctcaaaaaaataaataatataaataaatacaaaatagttgtatatacaacaaacatgaatttgtaactttccttttcccacttgaaatacttgtgtttcccatattatatggtctttatataccatcattttagctgcagatcatcttgcaggcatcaaaaagattttaaagctctcatctagagtttattatctctatgtaatatttccctacagtccacctgaaagtctgaggggccattgtcctggcaagttttgcatgtatgaggatgttcacaatttgaaagaayagaatagttctgtatttcctccattattgctgaaacccgggactgttaggatttggaagatttgcaaaggaaggagccttagacacatgaaaaagttaaagaaaggaagggagacatttaaaatccaggcttaggatacaggtgatttatacaggagttgaagtatacttcatcatatttatacttctttttgcaggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtaaaaaataaaataaacaataattagaatttaaagaaagaaagaaaggatattggctgagcacggtggttcatgcctgtaattctagctttggaggctgaggtgggaggattgcttgagcctgggagtttgacaccagcctgagcaacatcgcgagacccttatctctacgaaaaataaaaataaaaattagccggatatggtgacactcacttgtagtctcagctacttgggagggtgaggcaggaggactccttgaacccaggaatttgaggttacagtgagctatgatcataccactgcactccaacctgggcaacagagtgaaaacctgtctctaaaaaacaaggaagaaagaaagagaaagaaggaagaaagaggggcagggcagggcagggcagggcaaggtggggcggggcggggcggggcggggtgaggcggggcggggtgaggcgaggcaattttaaacctcatgaaccaacatctgctggcttcaaacttttcttctgtagcttcctcgcctctctcagccttcttacaatagaagagagttagggtcttgttctggattaggttttggcgtaaaggcatgctgggctggcttactcttgtatctagaccactcacattttctctgtatcagcaataaggctgtttcactttcttgtcatttgtgtgttcagcagagcagcatttttaatttccttcaagcacttttcctttacattcacagcatgcctgactgttcggtacaagtggcctaggctaggttctggcctgtcttggctttcaacatgcctttcccgctaagcttaatcacatctagcttttgacttaaagtgagagatatgcaacttttctttttacttgaacacttagaagctatcatagggttatcatgtggcataatttcaatatcattgtgtctcagggaacagggaggcctgaggagagagatgggggtgtggccagtccgtggatcagtcagaacacacacaacatttgtgggttaagtctgctatcttatataggtgtggtttgtagctcaccctcaaaattatgaagtaacatcaaagatcattgatcacagatgaccataacagatataataatgatgagaaagtttgaaatattgtgagaattaccaaaatgtggtacaaggacacaatgtgagcacatgcttttgggaaaatggtaccaatagacttgctgaatgtagagttgccacaaaccttcaatttgtaaaaaatgcaatatctagctgggtgcagtggctcatgcctataattccagcgctttgggaggcmaaatcaggaggatgactggagcctaggagattgaggttrcarttagctatgatcrtaccacctgtattacagcctagacaacagagcaaaacactgttccttaaaaaaaaaaaaaagctaatatctgcaaagcacaataaagcaaagcacaataaaatgagatatgcctgtatacacagagaattaaaataactgattgtatgcaagtttaaaaatacttagaaaaaaacaaaaaagaaaaaaacttagaaaaaggtggtgtgcttatcaaagaaggtttctgggggaactatgactggagtgatgctaagcttggcaagaacactgacaaatacagcattggtggcaaataattatgagccctagtttatgcatgacagtatatgtccttgacttttttttttttttttaagatggagtcttgctctgttgccaggctggagtgaggtggcacgatctcagctcactgcaacctctgcctcctgggttcaagcaattctcctgcctcagcctcctgagtagctgggactacaggtgcgtgccaccatgccyagctaatttttgtatttttagtagagatggggtgtcaccatgttggccaggatggtctcgatctcttgaccttgtgacccgcccgccttggcctcccaaacttctgggattacaggcatgagccaccatgcctggacatgtccttaactttttaaattaaccttgctatgtatccaaagcaggctaataaaaagtaataccgttttaaaatgccctttattatcctatagtattcactcttttttcccacccatatttgattctcaggtgtctactatgaaccatcctgtactcagaatgtgaatcatggtgtacttgtggttggctatggtgatcttaatgggaaagaatactggcttgtkaaaaacaggtaatatatttacactttatatttaattggaatcaggaatttgagggagtttcrgcaaatactctcatgattttgatgatgatcattatgatcacgatattgacaatgatgaactttatagcttcttacaaagtgacattctaaattactcagtgcccccatcttttcacttaccattctgccttcatcactttgttttcctggtttatcttctgtactacttctgtgattattccttctcagcctctctcatgaacctattcctctcctctatttagcccaaaaatgttagttttccccagggctctatcatctgcccattcctcttcttattttattttttcttgggtgctataattccactcttaggactctagctataacctttatatgccaatagcttttgaatctctagctctagttctgacatcttcccagaacttcagacttatctggacacactcacttacatatatcttagtctttccaaactcaatacatccaaataattcagtactctctcccccatactgttcctccttcagaatttcccatatcagtaaagggccacacaacacaatcacccaataagatatgatggattcatctgagacctccccaagtccaaccaagcaaccaattagtcaaaccaattttaccttatctatgtccttgattctgttccttctctgtttcttctattacggctctagttcaggcatctctagtgtggactattgctrtacccttctaactggtctcctttactctctattttcttcccctttaccctcaaatccatctttcatactgctgccaaacttatttgtctaaaatatgaacgagtctgggcttataactcttctactgagtttcattcggtgtaaaattaatgttccctgacagaagacaaatcctataggctgtgctccctgccttgccagcctcacctcctggcatttgttgcctcctattttcactctggttatactgcactatccacagttgtagttcccatacattccactttatctgtaataccttccttcatatcttggtttgtgttccctctgcctagaacatcctgtcttctcttttggtttacttctccttttcttcagaagtagctcaggcacaatctattccagaaaagtctttcctgaatccttgggctgaggaacatgtcttttttctatgctgccaaaatgtcctatgcatactggatcacaggattttaggcattatatttaaattgtatatttacctgtctgtcactccagtgttctgtacgtgcctttggggagagattatgtctggtcttcatatccgcagcacagactaagtgggtggcacctaaaggcccctcaatatatgtattgaactgacatctatatcactcataaacaaaaggaacataacttctagagggaaaaaatggaggaaatatgaagagttgagactttggggcatacctggagtttctctttgtgttagtttgctatggctaccatgacaaagtgccacgaactgagcagcttaaatgacagaaatttatgtctcccagttctggaggctggaagtctaagatcaaggtgttacttccttctcacgctgtgaggaagaaaatattcgtggacacaggaaaaaaaaactgtatgatcttacttatatgtgggatctaaaaaagtcaaacttacagaaacagacagtagaatgatagctgccagggactggaggctgggtaatgaggagatgctgatcaaagagtgtaaactttcaggtrtaagatgaacagattctgggaatcaaaggtacagcacgggtggagatggatgtgttatttcatttgattatgtcaatcattgcacaatgtgcacatacatcaagtcatcacactgtataccttgagtttatacaatctgtcaattaaatatgttcttttaattaaaaaaaaaagtttgatgcctctcccctagcttctgaaagtttgctggtgatctttgactttcctcagcctttaggacaatcaccctgacctctgccttcattttcacatgacattctccctgtatgcatttctgtctctattcataattttactttcttcccctttttgagacagggtctcactctgtcacccaggctggagtgcagtggggtgatcaatgttcaccgcaacctcaaactcctgggctcaagcaatcctcccacatcagccaccaaagtagctggcactactggcatgcaccaccacaccagaccaattttaatttctatttgtagagacaggatctctctatgtttcccaggctggtctcaaactcctgggatcaagtgatcctcctgctttggtctcccagagcactgggattacaggtgtgagccactgcgcctggccaattttcccttttcatgagcatcattcatgttggattaggacccaccctaatgacctcatcttaatttaattaattatgtctacatcaaccctatctctaaataagttcacattctgaggtactggaggttaggattccaacatgaattttgtggggacacaatgcaacccataacaccccttaaatctttacttgaagtacatagtctacaaatcaaacaaaaggtgctttcctacccttttcccactgtggcacacatagaagatgatgatattcgtatggcccatggggaaagtagctgaggggatcaatatcttggttcactgataacctattcacagcactgatcagcttgggtgtagaccagtgatagctttttaaaatgaaactatttccctcatatcttattgactctctaaggaactccctacggcaggtgttctaaattcccttctctactgaagttgctcttgaagatcatctatatcttttagtgttgaaattcaaatctgcttctcttcactcattcattcaacaagcacttactaggcatctacaatgtgactggcattatctaggccctggagatacaaaaaatagtaagaaaccatcctgtcctaaaggcactcacaatctaacatgaaaaaatatatataatatatattatatatacatacataatatacaatacatattatgtatgcatacataatatacaatacatattatgtatgcatacataatctataatatacataatatataatataatayataatatacatatataatatataatatattatgtatacataatatacatatataatatataatatattatgtatacataatatacatataatatataatatattatgtatacataatatacatataawatataatatattatgtatacataatatacatataatatataattattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatataatatataatatattatgtatacataatatacatatataatatattatgtatacatacatataaatctctctatatataaatataaatatatttataaatatatatatatatatatatatctcccagcctcccaaagtgttgggattacaggcgtgagccaccaccgcacccagcctagatgtatttttaaacgatacaacaaacacatcgtggtataatgatacatgtctaaatggctatgggactgttgaagaggaaatgcctaacagcctaaacctccacagagaagacactatttgaatcaagtttycagatgtatggaattgttcatgtattggaggaggaaagtgtgttagaggttggaaagttgctctcaatgacccaaaaaacatatgcaatggcacatttctcactatcttgattcattttgctacatcaactttagcctcatatcttacgttattttatccacctgcctgttacatgagtttgctatatcaaagcaaactcatctatatcaaagcaaactcacctgctccttcagtttcaactattgccattatgtagatgatccccagttcataatctctgaaaatgacctcctaagtgacacacttccttgtccaacttccaatttggcagctctccttgaaaaatccaaactccccacctacatcaccctactaccaacatatacacactctcatactcaataagtttacaatgttcttctcttcctttcttccctcatccctgaaaaggattttcaaacaagctcaagggaaaactattccttattttgggtaatatattaccatcttcagattattaaagcctaagcatcatcttggccttttccttttcccccctcaacccacccagccctatccatttggcctgtgaatcatattttatatgtattttctctttgccattcccaatggccctgctgtaattcagattccattctacccagctatagcggtatctttttaaaatatagatcatgtcaactcctgctcaaaaattctgaatagttcaccattgtctaaaaatgaagtccaaactcctggccaggcattccaggtactccattatctagcttttaacataaccttagacatttcttccactatattttcatatacccacagtcatactctggccacagtgaactacttattcatcattccctaagtttacagatacatccctacctctgtttctttatatatgctgtatctttctgaaatgcctgtgaagtccaatgctgtctatagaaatcccacctgtcttggtgaaatgggcattcttatacagtttgatgggaaagtaagctgtatttattctttttttttttgagatggagtctcactctgtcaccaggctagagtgcagtggcatgatctcagctcaccgcaacctcygcctttaaggttcaagcaattcttctgcctcagcctcccgagtagatgggactacaggcatgtgccaccatgcccagccaatttttgtatttttagtagagatggagtttcaccatgttggatggagtttcaccatgttggccaggatgatctcgatctcttgacctcgtgatctgcccacctcggtctccccaagtgctgggattacaggcatgagccaccctaccctgcctattctctttcttggaagcaatttgacaatatgataaagaactttttaaatgttcatattcttcccccccccttttttttttgagacagagtctcgctctgtctcccaagctggagtgcagtggcacaatctcggctcactgcaacctccgtctcccaggttcaagtgattctcctgcctcagtctcccaagtagctgagattacaggtgcccaccaaaacacctggctaatttttgtatttttagtagagatggggtttcaccatgttggccaggctggtctaccaactcctgatcttgggtgatctgcctgtcttggcctcccaaagtgccaggattacaggcgcaagccactgcgcacagccagtgtcccattacttttatttcttggaatctatatgaagaaaataatcctaaatatgggaaaactttcatacacaacttatgtgaattgtagcattattatttaatagtaaaaactagtaagtagccaaaaatgcctaacaataggtatatgattaaataaactatgacataatcaactccatgcattagatttattcagactattattaataacctaataaaatacttgggatatatatttaaatgaaaaaagatacacataaatacaaaatttatatgtagtataaatattagctgaatgtggtaagctcatgcttataactctagagctttgggaggccaaggcaggaggatcacttgaggccaggagtttaagaccagaaacatagggagacccagtctctataaacaaatttaaaaaattagctgggcatggtggcatgtgcctgtaatatcaactactcaagaggctgaggtaggaggattttttgagctgaggagtttgaggctacagtgagccatgatcacaccactgccctctggcctaggtgacagagcaggaccctatgtcaaaaaaaaatttaagttaaacatagtatgtccaaccaggcttagtggctcatgcttgtaatcccagcactttgggaggctgaactgggaggatcgcttgagcccaggggttcaagaccagcatggggaacatagtgagaccccatctctatacaaaaataagccaggcatggtgacacacacttgtggtcccagctacttgggagactgaggtgggaatatcacttgagcccaggaagttgaggccgctgtgagtgagccatgatcacatcactcaactctagcttcagtgacagaatgagaccctatctcgaaaaaaaaaggaaggaggccgggcacagtggctcatgcctgtaatcccagcactttgggaggccaaggcaggtggatcactaggtcaggagatcaagaccatcctggctaacacggtgaaaccctgtctctactaaaaatacaaaaaaaattagccaggcgtggtggcgcatgcctgtagtcccagctactcgggaggctgaggcaggaggatggcatgaacctgggaggcggagcttgcagtgagccaagatcacaccactgcgctccacactccagccggggtgacagagcgagactctgtctcaaaaaaggaaggaaaaaaaagaaaggtattaattttaaaatgaaaaaaaagtcattacaaatcctattcattttttaaatcctgcctcaaatactatctccttcrtaccccattcacttagaattgtttctctaattcctaagctttggcaatgctttatgaattctattatagtattttacacatatcccttgtgttatagctatttgtgcaaaccatgccccattcactaaaatgtaaacttcttcaaggtaggatagtctcttgttcatttttgcatcttcatttggacactgattcaacaaacatgtattgagtacctaccatgtgccaagctaggaactagcgattggaaatgaaaaatgcagctcttctaccgtccctcaaggtactcatagtctaatggagtgaaggaaacaggcaggtgcatgtgtagtccattgcaactcaatgtgataaatgctaaaatcgaggtggcataggttgcactggaggcatagaagaacttcggcaggttatttaacttctttaattttagtttcatcagccttcttacaatggaagagagttagggccttgctctggattaggttttcgcttaagggcatgttgtggctagtttgctcttttatctaggccactcaaatcatatcagcaataaggctgtttcactttttttctttacttttttcttctttctttcttkttgttgttgttgttgttgttgttgttgttgagacaggtctcactttgtcacccaggctggagtgcagtggcacaatctcagctcactgcaacctccgcctccctccaagtagctgagactacaggcatgtgccaccaggcacgggtaatttctgtatttttagcttgttgcccaggctggtcttgaactcctgagctcaagtcatctacccgcctgagcttcccaaagtgctggaattacaggcatgagccactgcacctggcctgttgtttwgctttcattcatgtgttcactggagtagcattttaatttcctccaagagctttccctttgcattcacaacatggctaactggttcaagaagtctagctttcagcctaccttggctttcacaaagcataatcatttctagctttgatgtaaaatgagagatgtataactcttcctttcacttgaacacttagaagccactgtaaggttgttttttgtttttgktttttgagacagtctccctctgttgcccaggctggagtacagtggtgcaatcttggctcactgaaacctctgcctcccaggttctaagcaattctcctgcctcagcctccggagtaactgggattacaggcacgcaccaccacaccctgctaattttgtatttttagtacagacggggtttcgccatgttggccaggctggtctcgaactcttgtcctcaggtgatccacctgccttggcctcccaaagtgctaggattacaagcgtgagccaccgcacctggcccattgtaaggttattaattggcctaatttcaatatcattgtgtctcagggaaaagggaggccagaggagagagagagagatgggggaagtgtcagttagtggagcagtcagaacacacaccacttatcagttaagttcaccatcttatatgcacgtggctcatggcaccccaagacaattacaatagtaatattaaagatcactgatcccagcttgggcaacatagcaagactctgtctctacagatagtttttttttttaattaccctggcatgctggtgcatatttgtggtcccagctacttgggaggctgaggcaggagcgtgagacctggaggctgaggctgcagtgagctgcgattgtgccactgcacaacaacctggatgacagagtgagatcctatctcaaaaaaaaaaaaaaaatcactgatcacagatcaccataacagatttgctaataatgaaaacagttgaaatattatgagaaatgccaaaatgtgacacagggacacaaagtgagcacaggctgttggaaacattgtgccgatagacttgctccatgcagggttgccacaaaccttcaatttgtaaaatatgcaaaatttgcaatgcacaataaagcaaagcacaataaaacaagatttgcttgcacttctcaatacctctgctgttaccattagagttcaagccaccatccatctcctggtctattgcaataatctcataactggtagctgcttccctcttgtttgcttggaatcaatcctctacacagtaaccagaattatctttttaaagcataaagtagattatgttacccttctaccccaaaccctctaatggctttccttcccactcagaataaaacccatgacctgtaaagcatgacattatctggccttagcctgcctctccaactacctctccaactactctcccctctctcactcagctcccagcacattagccttttggctatttcttgacacatcatgcttatttctagccctttatccaggtctttgcctcacttgcatctttgcgcaaacatccactcagcgaagcttttcccgaccattccacctaaaattgagccctgtctcttaacactctgtatcccttatcctgctttatttttctttattgtactaatcatatatatcatcaagtatttcttcgtttatcatatgtttctcctctagaacctaggctttagaaagactttgtctctgtaatcctaatgcctagaagagtgtctggcacagcctaagaagcccaggacttcagtctattacaaaggaaactggcattgattttagaaggaataataagttagtagccttataatatgcaaggagaaggtagggtgatcaactttcccactttgctaagggctacgaggctttctgggacataggactttctttttaaaaacaggacagtcccaggcaaactgggactggtgatcaccctagaagaacgctatacatttttttaaaagtagacggactcagcccggctcagtggctcacgcctgtaatcccagcactttgggaggccgaggtgggaggatcacctgaggttgggagttcgagaccagcctgsccaacatggagacactccatctctactaaaaatacaaaattatccgggcatgatggcgcacrcctgtaatcccagctactcaggaggctgaggcaggagaatcacttgaacctgggaggtggaggttgcagtgaggcgaggttgtgccattgcactccagcctgggcaacaagagtgaaactccgtctcaaaaaaaaaaaagtagatggactctacttgagtccaatctgatgtactcatacctggataataataaaaatagctaccttcacttagtaagcattggctatataccaaatattgtgtgagtactttaaatacattctctcatttaatttttaaagtactcttatgagataggcatttagttaacaaactcacctaaagttgaacagtttgagtgaaagagctatagaattaataaaaatatacaacttggtaagtaccgaaatgaacatttggagcagatcttgtataattctgaaggcaagactttgtcctcagatactttatttagcttaagattttttttttttatcagtttcattgtttaagggaagttagcaggactcagtcaaaaagaggtctgggatcttttgcaaaactgggggcaattgatcttggtcggtaaaactgagaaaagtaaattgtttagwtgttgaatggggtctgggattccttggtctcactgactgaattcatactgctagtaactagaccctcaattcaattttcatactagaactcaggtccaaattcagttcacctaaaatgatttattttacctattatttaatgcagtgaccatagtaggatataaattacatgagatcctagatgtactggtctgaatttcattccccatatgacttcactcacagagataactgtagggataggcatagataaaagttagagtgggctttggaataaaataatcctagatttgacctctggcttcacaatttactatctatgtgacttttggcaagctactttaccactctgcccttctgtttttttctttagtaaaagaagataatattcacctcacaggatgatgattaaattagataatttatgttaatctgtttggcagagtaagtgctaaataagtggtgtctattaatattaataatagcctggccggattcttgttattgcttttgcttatcaaactggatattaaaagagcattgctacagcctgggcaacatagtgagacctcttctttactaaaataaaaaattgggccaggcgcagtggctcacgcctgtaatcccagcactttgggaggctgaggcgggcagatcacaaggtcaggagatcgagaccatcctggctaacacggtaaaaccccatctctactaaaaaatacaaaaaaattagccaggcgtggtggtgggcgcctgtaattccagctactgaggaggctgaggcaggagaatggcgtgaacccgggaggcggagcttgcagtgagccgagattgtgccactacactccagcctgggccacagagcaagactccatcacaaaaaaaaaaaaaaaaaaattggccaagcatggtggtatgcacatgtggtcctagctacttgtaaggctgaggcaggaggattgcttgagcacaggaggtcgaagctgcagtgagctgtgattgcaccaccacactccaaccagggcaacacggtgagactctgtcaaaaacaaacaaacaaacaaaaaaacccactacagccagtggtttattagaggtgacgatggagtttgaattttattgtaaaggcatggagagccattgacaatttctaagcagtggagtggcaattaagtgaaaggaagtaaagaaaggagctcatgaaaatgtttgagaaggactgaccagagagagataagaaaatcagaacatagtagtgtcttgaagccaagagaccagtaaggtgggagtagacaagtgtgttaaatggtacagagagaaaaaaataggacctgcaaaatgtccaatgagggctgatacatagaatatttaaggcctcttaaagcacagtccttttaaatggtgtcatttgtcttccaacaataaaccagcatttcttaggttctccactgcatgcaaaaacacaaactttgagtccctgagccaaaatttcwaacagcttccctttgcctttgtaattgaagtacatgttcytccacctgctgttctaagctgttcacaacatggccccaaaccagctttctatcctctttttccactattctactaaagatatccagttttcctttcaactaaatttcttactgctctccagacacactaggcattttctcaatttcacacttttatttgtatcctagagcacttaatgaattttgccttgtatgatatttatatacctaccactataaaatctcagaatgataaagagcttcagaaatcattcctcttacaaggattttctaagttttttcatcagtcttggtaaagtaagaaaaataagaatattttggtgactttttcattaatataaatttatttactcaaaagactatccttaaaatagagattatgtctttggattttttgcttttggtgttaaaatgtattttcttttacaacataatggtgacagtaagtagtatggtttttatttattttctttttttgagacagtctcactctgttgcccaggctggagtgcacaggcgcaatctcggcttactgcaacctctgccttgcctcccaggttcaagcgattctcctacctcagcctctcgagtagctgggactacaggctcatgctaccatgcccagctagtttttgtatttttagtagagacggggtttcaccatgttgatcaggctggtctcgaactcctgacctcaaatgatctgcccgtctctgcctcccaaagtgctgggattacaggcttgagccaccgtgcccgaccaatagtatgctttttaaaaaagataccaacagcggggtggtggctcacacctgtaatcccaactctttgggagcctgaggcgggtagatcacttgaggtcaggagttggagaccagcctgaccaacatggagaaaccccatctctactaaaaatacaaaattagccgtcgtggtggcacatgcctgcagtcctagctacttgggaggctgaggcaggagaatcacttgaacccaggagatggaggctgcggtgagctgagattgcaccattgcactccagtctgggcaacaagagcgaaacttcacctccaaaaaaaaaaaaaagatgtccatacatgctaattttaaaattgataactgtatatctatctgtaaaaactttttgaactcctctaagtccattaaatcaaaaagtgaaacactgatctactcgaaccctaatccgacccatgatttttctctgcaacatctctaacaagtagcctctgctgcagagtaggtaaggaatacaggtgcatgccaccatgcctggctaattaaaaaaaaattttttttgtagaatcagggacttgctattttgcccaggctgctctcaaactctggcctcaaacaatcctcccacttcagcctctcaaagcacttggattacaagtgtgagccaccatgcctggctcatttttcaatagctttaattatgagaaagtcagctccacttctagatcaaaaagctctttcagagctgcatttttgttgtttgctttagaattccctgccctatacctttttcatagtagtcactcaaaaatatttcttaattgacattctctagaggaatttaagtttgatagaaaatcattacacatgatactgttatcaaaaaatttagagataaaggcttataaaggatactaatactctttctttagagaaggcatatttgcaaagtaggaggattaaaggactgggatggatcttactatagttttccttaggtattaagtctattcatcaatatagcactaaagctttccaaaccattattttgagttacctgaaatccctggagaaattattaycttatttcattctaattttgttttacggcctttcatatgtaatcacttataggagaaaaacaatgagataaaaagttgataacatggtttgattgtacgcatttgtaattttgtattatttctttttctaaagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcackgtggctcacgcctgtaatcccagtacttgggaggccaaggcaggcatatcaacttgaggccaggagttaaagagcagcctggctaacatggtgaarccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagsccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaattcataaattccctgaattctatccaaggagactttgagagttgtggctctcaagtaaagaatgcctgaactgctctccctccccctccccctccccctccccctccctctccccacggtctccctctcatgcggagccgaagctggactgtactgctgccatctcggctcactgcaacctccctgcctgattctcctgcctcagcctgaccagtgcctgcgattgcagcctcgcgccaccacgcctgactggttttggtggagacggggtttcgctgtgttggccgggcgggtctccagcccctaaccacgagtgatccgccaacctcggcctcccaaggtgcggggattgcagacggagtctcgttcactcagtgctcaatggtgcccaggctggagtgcagtggcgtgatctcggctcactacaacctacacctcccagccgcctgccttggcctcccaaagtgctgagattgcagcctctgcccggctgccaccctgtctgggaagtgaggagtgtctctgcctggccgcccatcgtatgggatgtgaggagcccctctgcctggctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcccatactgggaagtgaggagcccctcagcccggccagcccccccgtccgggagggagatgtgggggtcagcccccccacccggccagccgccccatccgggagggaggtgggggggtcagccccccgcctggccagccgccccgtaccgggagggaggtgggggggtgagccctccgcccggccagccgccccgtctgggaggtgaggggcgcctctgcccggccgcccctactgggaagtgaggagcccctctgcccggccaccaccccgtctgggaggtgttcccaacagctcattgagaacgggccaggatgacaatggcggctttgtggaatagaaaggcgggaaaggtggggaaaagattgagaaatcggatagttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtamtcagggacacaaacactgcggaaggccgcagggtcctctgcctaggaaaaccagagtcctttgttcacttgtttatctgctgaccttccctccactattgtcccatgaccctgccaaatccccctctgtgagaaacacccaagaattatcaataaaaaaataaattaaaaaaaaaaaaaaaaagaatgcctgaactaagcaagtasaataatgaaatactttttaaaaacttcactgtatgcccaatataaagggaaattattaacaataagtaatttcaaacttatagagataaaaaattatctaaaaatataaatttaaaacaaaaacatttagaatttattctggaacaatttctagacagtagtatgcaagatgacttgaagaaaatttttttaaaagccaggtgcagtggctcacacctgtaatcccagcactgtgggaggctgaggtgggaggatcgcttgagccagaagttcaagaggctggtctcaaactcctgggcgcaagtgatcctcctgcctcttgttatgagcacataaaaagatctccatctctacaaaaaataaaaaagttagccaggtgtggtggtatgtgcctatagtcccagctaccaggggaaaggctgaggtgggaggatcacttgagcccaggagattgaggctgcagtgagccatgatagcgccattgcactccagcctgggtgaccttgtttcaaaataaataaattggcaaataataaaataaataaaattttaaaatgagacaacctaggccgggcgtggtggcttacgcctgtaatcccagcactttgggaggccgaggcaggcagatcacttgaggtcaggagttggagaccagcctggccaacacagtgaaaccccgcctctactaaaaatacaaaaattagctgggcatggtggtgggtgcctgtaatcccagctacttgagaggctgagacaggagaattgcttgaactcaggaggtggaggttgcagtgagccgagatcrtgccattgcactccagcctgggcaacaagaacgaaactctgtctcaagaaaaaaaaagagacaatctaaaagatattctagtagtctatatgtgtggtgataaagccctaaactaaatacatcatttctgaaaacagcaaaaaaataaaaaataaagcaaatctgggagccatcacagagtaaaagttgacagaattttaaactgtataataaaagtaaagaaacggtgcttgctttggcagcacatatactcaaatttgaatgatacagagaagattagccaaaaaatttgaaaaattatattaaaaaaagaaacaagaagatttaaatattccagaactaggcatccatgagacaatgccattaaaacatataacataaatgtgmcagatacttagtatttcctttctcttttcttttttcctttcttatctttttttttttttttttgagacagggtctcactctgtcactcaggctggagtgcagtgatgccatcactgctcactgcagccttgaactcctgaacttaagctattttctcacctcacacaccttccccacccctccagtagctgggactagaggtgcaagccaccatttctggcttatttgtgtgtgtgtgtgtgtgtgtgtgtgtgtgtgtgtgtagagatgggagtctcattatgttgcccaggctggtctccaactcttggcctcaagtgatcctcccactttggtctcccaaagtactgggattacaggcataagacttactatttctttgaatcaaattattattttttgactcttctcttctagatgagaatcttgatgatgcttcaagtatgcatactctaagttaccagaaagactataaatcagaacatgtaataaagggggccgggcgyggtggctcatgcctgtaatcccagcactttgggaggccaaggcaagccgatcacctgaggtcaggagttcgaggctagcctggccaacatggcaaaatgccacctttactaaaaatacaaaaattagcctggcgtggtggtggacgcctgtaaccccagttacttcagaggctgaggcaggagaattgcttgaacccaggaaggggaggttgcagtgagtcgagatcacgccactgcattccagtctgggtgacagagcaagactctgtctcaaaaaaaatgaaaaaaaatgaaaataggcctggcatartagttcatgcctgaaacactttgggaggctaaggcaggagtattacttgaggccagtagttcaagatcagtctacacaacatagcaagaccctgactctacaaaaaaattaaaaagtagccragagttgtggcacacacctgcggtcctagttgttacagaggctgaggagggaggattgcttgagccaggagtttgaggctgcagtgaggtatgattgcatcactgcactccagcctgggagactgaaagagaccttgcctctaaagaaaaaaaagtggctgggcacagtggctcatgcctgtaatcccagcattttgggagtccaaggtgggcaaatcacctgaggtcaggagttcaagaccagtctggccaacatggtgaaaccccatctctactaaaaatacaaaaattagttggatgtggtggtgcgtgcctgtgatcccagctactggggaggctgaggcaggagaatcccttgaacccaggaggtggaggttgcagtgagccaagattatgccactgcactccagcttgggcaaaagagtgagactccgtctcaaaaaacaacaacaacaacaacaacaammaaaaacacacaaaacagtgacttaattataattcaaaataattattagaccaagattttcactatttttaaycctaataacaaggttctagtcttcatttctctcctagttgaatgactttgggcaaatcttttcatatctagtggctgttttctcctttgtaatgaagatatgtcaaagtttatgagtacaggcttatcttgttttattgtgctttgctttattgtgctttgcagatattgcattttttttacaaattgcaggtttgtagcaacccagaatcaagtaagtctgtcagtgccgtttcccaacagcatatgcttacttcatgtctttgtgtcacattttggtaattcttgcaatattttaaactttttcattattattattatctactatggtgatctgtgatcagtgatctttgatgttactatgataattgtcataggatgtcaaaagccgcacccatgtaaaatggcaaatataatcaataaatgtgtgtgttctaactgctccatttactggctgtgtccccatctctctccctctccttgggcctccctattttctaagacacagcaatatttaaattaggtcaattcataaccctacaatgttgtctatgtgttcaagtgaaagaaagagttgcatgcctctcacttaaacgctgaaaatgattaagcttagtgaggaaggcatgccaaaagccaagataggctgaaaggcctcttgtgccaaatagttcaccaagttgtgaatgtaaagggaaagttcttggaggaaattacaagtgctactccagtgaaca

SEQ ID NO: 13355 - DNA, 21130 bp, Homo sapiens
  misc_feature (1)...(21130): n = A,T,C or G, or insertion/deletion polymorphism (see Tables 1-2)
aactcagtttagcccagaaagcacaacctgagaaaagggcttgtgtgcatgcagtccctgtagaggtggggaggcaagggcaagtaagtttaggaaacaggagggggtaactaggaaggaagagacagaggaggaagcaaatacaatggtgcattatccttcaagtcaggattgttgtcatctccattttacatatgaggaggctgaggctcagggatgatccatggcttccctgaagccacaaagtaaggatrcagcagtcagaatgccagaattcaaatgtggattacgtggctctccaccactagctcccagggtattaagtrcagggaacaggaagacccccagcctytatgcttagacattgtgccactttagaatagtgtccaactctaatcctttcaacaatcttgtccaattatgtatttagagagattgtctaggcctttccaatcaacatttcatgaatatacaagcctaccatcaaccaattacgagtgtgtccagttctcagggtgacctgagagccacatggaacaagaaagctttccagccagtgtttccagcagcaagcatcctaacccaggcctcggaatctgaagatacagtgctcaaatatcagtgcttctgagctactaaccrttgtaattgcccaagtagatggccaatgaattgcaataattcataattcagtttttggttattaataagatttattgtatcttacacaaaagagcattataaaatgataaatattgtaggatagaggctgagatataaccaaatattgctcttgatctttagcaaaaatcactttcaaaggacaattgattttcagcctctgattaaatccctgctagtggaagtgtagggaggtgaccagctcctatctcaatcagccaatcaataattataagccgggtggggaaaaaaagcagtagtgaaatagtttaaaatatcttattccatggtctcaagtgccgcctgctgactaaaactgtccacttccaattccagcacttattaaactagagataatatgttaatattaatttgctttaattaataaaatattcctagaatatgattttaaattcacatgacattcggaagtcacttatatttgcagtattcaagaattacatgaagtatgtgctcattaagagcgattttaaattttatcttttgtcaccacctggtggtagaacattttctcacttttcttttttcattttaagccttacgttgttgctaaggaaaatttctaaaccagggaaaccagttaaccagtattgattgtcaagtattaatgtatactaaacatactgtatgtacttaatatctattgaataaatgaatgagtttttaatctgttttagtggattgcaaatgtactyaatcttttcatttgaatgacaagaagttctcaaatgtaatgaataaaagcggtccacagtattattttgtcagaggcagttttctttctttaaagtttaattggatttttgtttatggtaatacaaacacataattaaaaagtagttgatttaaaaamgcattttattatgccctcaagaataaattcatttaacattgtaatatttttaaaatattttccataatactaggaggtaggagaatatttaattagaatttattaaayatgattgagaagatgtgaaacttttgcaaattcttaacttgaactattaagaataaaaaaggaaaggaaagaaaaaaaaaaaaaaaacaccaagtcgcacatcatttgttgtaraccatcgccaccttgtgtttggagaaagatgtactaaagtctgagaatcttttaaggtggaaattttttattgctggaaaattcctatttataattaaaacaaaactttactggaaacaacatcattccaaagtctgacaayataattayctcctacacaattagataggttaaaatgtcaaaacagttgattaaaagttatgagtcaragtcatttctaagcccccagtttgactctcgctatgacatcttgggaaaactacttaacccttttgagtctcatttctgcatcagttacacaaagggagtcgatctggcaratcatactcctctgagttctgygagkgcatgatgtggagggaatatcaattttgagtctaaatgcaagctacaataatttttctgtctccaatatttgcaatacttctgggtatataacctgtttaaactagaagttttctaactactttctcatttgtgatcaattaaaatatccatttgtccaatattactttagaccatatgttcccaaaagtaggactaataccaaacagcttccctatttctaattagtcaatcttatggtactaaaatgtgaataaaaagcatttcccggttatgaaatatgcacattagttgtttctctagacaatgtttacattaaaacaattctaatagctcatgtatattaccagatttcctcatttcatggctacttgttgaatacttactttggtatagacgtcgtgaaaattgtgaatagaatattgtgtctataacatatgaatcwgtgaaacaaataagaacacataaggtgtaaatagaaattgacaccttgatgcttatctctcactttaaaatgcagacaacttgttytttttttcagacagtccctctgttcatagaggacaataatgtgtttaataggtcaaactgttaattgttccaataattttatgtcaaatgttttgagttttgttctgttatctctagaaataaaaattagcttacatatgtaaattagaacatgttgagattaatgtttatataagcccatatgtattctataaaaataaaacccaaaatatggggagtagggattaggatagcatgtgttattttgggtgcccattcaaatcaaggagcaaaaattggattatgaaactcactacaagaaccccatattacatgtcacttttactagtgccttgtacaaatttactcctrtggtcttgtttctacattcaaatgtttttccaattcacattttgcttataaatatacatatatgtcctatgtatatatttgcatattaccacaaatgcctgatgagtgctaatctttaaawaaaagagaaaaagtaagtggattaaatgttcttctgagcatagatggagtttttcagcttagtagttggcaactccaacatccatgtctctgttgaagcgattaaaaaagaatcatttcccagaactacaggtgcacaacagattggagtcattatgcaaaagaacagaaatctggatagaaacccagagaataaaaaagccatgttcccggccatccttttgcctttaactcactgttttttcaaccctacttgtatctgcaacatgaaatatgaaacaattataatggatttgtagtaacccattcaagatcagaaatgtatgcttttaaacaaacctccaataagaataccctgcaggtagaaacacactaaaggtcaaacttacgttaacatatttttaaaagctaaagtttatgtagagaagttgatagactgaaayacattacatatgtctttaaagatacagattttctgctgtttttgtccctttttgccccaatttaagggaatcacatctaccttcactcatcttcattcagcctctgggccacctctccttgagatggagattatgagtgtccaaaatctccatctcaaatctccatctcaaagccactctgaggctgtaactgttgtcaccatatattatcttctgagcccttttctaagcaagaggttgaaaatgtacggatggctttgccttcaagcttttgtgatcccgcggtcaatatcttgaaagtctaacatgactttcctcatatgttctctcaagtatcttgccttttttctagctagaaagaaccagtaaaatgaaatgaaatcatagaaaatggaccgtcaaaaaattactgtaatagaagataacaatgttaaaaaaaaaagtctgaaaaccaaactgggaagtaggaatgatcagatgtttgggaaaagacgcttgggaaacagagaaacaggaaggaataatcctcgtagttcgaagtcgaagagaaggaggtaggctggacaatgcttgacaatgcagaaaggaatcacacactcaggtgtgcggatgtcaatgttgagtttgaaggagaaatgcaacggcgggagggggggagagacagcgagggctgcaaaggagagactcagtgaaaagaggtaggcagaaacactatcagaatgttaatcgagcgctgtcaaaatatatctaaggccttggttgattattcaacgttcaacgatgagggtgattttaggaaaccaaaattaaatctacgaaaccacccactcctaaatgtgtagggactagaggtcgttacyaagcccttcagaagtaagctgagttgcttctctctgccattcttgctcatttgatttttcctgatgagtggaaagcaatgtttttgtttttgtttttcaagtaagcaatctcgctaggwaaaaagaagttggaaagcatccggaaaagaaagcttgtaagagggacgtgtggragaactagaagggacgcttctggctggggccaactgaagtggggaagayctggggaggagcgaggaaaggacccagatctacttggagccaaccaagagaccggacgggagtggggcggaaaggcggagaccagttcgagcactaacgcgggggcgcgcgagtgtgagggttgcgggtccgcccggggctagggcggtcgctctcgccattgtccccgcggctttccgcctgtgaaacacgtccttcctctgggtccttgagcccctcccactttttggagagaagagccactcagttttttttcctaaggacctgttggtggacctctcctcgctttcgtaacgcggatatagccttttcccttcctggtaggaagaggaaggaggggtccgggaaggaagccgatttccttctttccccctctgcacgcttgctagccccagcgatcgctgctggcccccgggtaggaaagtggggttcctggccgtttctgcgacgctggcctagggcttgcagctgctgttgagtgaaagcacgcagactggcgggagccgatcatttctcgaatgaagaagaaaaagcgcaattccctccttatgctctagggaattgagccgcgtcccagatcacccattccagaaatgtgaaaccgggccctcacaaagtcgtctctggkgaagaggtggcgtgcggggtgggggttggtggagggtgaaggcataagcaaacatattttaaaatccagatcgtargaagtgtcacctggcccctcacccaggcatgctttctgggggaagcgcagggccaagctttccctagaaaagctggggcgaagagagagcaggcggcggctaaggagctcctggcaggctgggaaggtggagaagtggggtgaggtatttttctagaaagtgtagccctagctcatctcctagattggggaagagggaactgagggaggagggaaggagacccagggcagctccaggatagggaaatgttgaagaagggactgcgttctccaaycgaaccctccctcctgggaaccgcagcccagcgcggtaactgagttaccgcaaccgggcggtggggaggaagggtggtccaggaaaccggcgagggagaaaagcggtggaagggagagtcttctccctggagcggccccagcagtacaaagtgctggtcacagcgccccttccgcccctagattgasgagcagtggcgtggagccagcgcggaggctgccccctccccctcccgagcccgcagcgcggagcgcggtttagcaccaacggagccgggggcggcgtctttgggatggaaaagggccaaaggggaggagtggggtgggggtgggggtttcactggtccactataaaaggaccgctcggctgcccggttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctcctyttagtgactccgggagcttcggctgtagccggctctgcgcgcccttccaacgaataatagaaattgttaattttaacaatccagagcaggccaacgaggctttgctctcccgacccgaactaaagstccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccmgtacccacgctgctgctgctcgccgcggcgctactggccgtgtcggacgcactcgggcgcccctccgaggaggacgaggagctagtggtgccggagctggagcgcgccccgggacacgrgaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtmggcggcacgtgcggggtsgtggacgacgagccccggccgactgggaaagcggagaccgaagacgaggacgaagggactgagggcgaggacgaagggsctcagtggtcgccgcaggacccggcactgcaaggcgtaggacagcccacaggtagaagaattgctctcgtttgtctgtccattcatcctcctctcctcactttatctatcccacgcgacttcagggtagactcctgctggcaggcaggakcataagtccgcggacagaacggaggcctggagtggaggaatgtggtttgaggtttggattggtgaactcagctagaaaacatacttgcatttgcccgaataatgaataaccaagaaaaaaactgacaaacgattttctgcaaactraagcaaagcatttaggccggggagggagagtttgtaacctgactccttccacctttagsgagttggagcttgtgmgagttctttccactctgtgtatttctttttaatgattttgtgtgcgccttttgtgcgggttgcaacgttgcgctgagttttgtaaccgctgcctgtgcgtgcatcctgcgctcacgggagggcggatgtggagagggcagaggagcaatggtgacctrggaaggyaccctgagcggctacgctagkatctctgttctgcagacttctgtcccctttcccccttataaggctgacccrggcgggctgaaggcggtggggccccttcgcagaacctgcttgggaggtctttcccgggtttgccccgcctcccagtttgcactccctctcgcggccataattctgctctcaagcactgttgaaagtcactgccggtccttcctgctacggccttctctctgtgcagtgcttattctccagttctttttgtttcatcactttggtgcctttttccttctttaactctctcgcgtgtcattttttaaagaattctccccttttcccctgctcctctgctcctgggagcaaagtggtcgcagcccagtttaggactttctgcaggggttgggtctcagtccggagtggaaggctctgttccaaataatcartcatgcctggaagctggaacttatttcgctggggcagtgggagtggggccagaggctgctgggcagagtgggtggtccttgtgcccggaattggcaagagcggagcaccccagggacccctggaatgagacagcagagctgtgcagtctgagattccttaaggcccggccccttggcagcagcccaggccctacccgaggccttccacgtggagcctgatgatctcattcaggatttgagccctcgcctgtgaaagagtgactcagggcctctgcctgccrctcttgctccaakattttactacaattgggtaggattatgtgcgaaattgccttgttcagactgtgggatttcaaagagaacagaagaaatcctgctcacacacagaaagatcctgaccatgcaaaggagcgcgtggtctttttatttaaaggagaggagagaactttaaaaataacacttggagtgaagatatgcaaatatttttgttattgttgttctgggtatatttttgctttgtttgctttgactggttaggctttcctaatatatgctaggaaggtaactattcttggacagcctgaccataagcaaacttttttttttctttacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggtaagaggaagatggtaccagctgtgagactgtcctcttaggagtctacgttgtaccaaaaagatatatacaaggcatttcaccagtgtttttgcagttaaccttttttaattggctagcatggkttatcttactcatttctactgtaatttaaatatctcaagkttcacagttctattttaaaagcattagaaaaaagcttgattaaagtcacatgaagkcttcttatgtcaacaataatgaatgtagatgctccaaagcatatgtgaaggcacaccctgccaaaaaagttagatcccaagggtcatgctccccttattaataagtatttacctttgctttttgtaggacttgtgtgggtcccagacatgtgatactcttgggatggctgatgttggaactgtgtgtgatccgagcagaagctgctccgtcatagaagatgatggtttacaagctgccttcaccacagcccatgaattaggtaagtctgcttcaaagtagaagttaagctcaattcagaaatgtaaactggtaaaacaatataagaaggagagtctgtaggttatattgctattttaggtcctagtgcatcttagaaactatagaaaatattttgtcactatttcaaacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgyctcctgggttcaagcgattctgctrcctcagcatgcccagtagctgggattacaggtgcatgccaccacacccggctaatttttgtatttttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggtgagatattccagctactctctctagatggcatccaacctttcacgcataaagtttagttaaatgaactctttcctttttgttctttttattttccccacttcaaaattacttttcctctgtcaagatcctaactgttgagatcttaattccaaataaaaaatagtgcttccggttgagtagctcccaaagcccattcattcacattgttcgcagatcaataacttcctgtcattgttaatatagaaataccccattgaggataagatcttaatagtaatctaaatctcttcagcatttccctcccccagctttacagttttcagatcactttgctgtctattttctcatatgataaatattttctgaaatgggatctaccccttcatgccctcactaactctgtattgatattggttggcatttcctttgcaggggaatgtttgatggacaagcctcagaatcccatacagctcccaggcgatctccctggcacctcgtacgatgccaaccggcagtgccagtttacatttggggaggactccaaacactgcccygatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaaccttgaggactgtccagacaataatggtgaggagcaacggactctggttttaagaaactggattaaaaaaagatgtacccacaaacaggtggctcaagattggaaactgataatgttatcatattattctctttccaggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactttctttgctttccatattaacatatcttcaatttcaaatttgaactccttttcttttacattaattggcaactgcctgctttgagtttagtgttttcagttatgaatgaagcttaaatctaacacttcacatgcttgcarttgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaayatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgygggggaaatggatctacttgtaaaaaaatatcaggatcagttactagtgcaaagtaagttttaaaacacctatytgcagaccttataatttaaatgggcctttcaacaggtctgggaraaaaatatgtctcataaaagattaatgtgtttttargctaaataatctaattagccaatgaatcagagatttatgcctgtttttgtcacctgcagacctggatatcatgatatcatcacaattccaactggagccaccaacatcgaagtgaaacagcggaaccagaggggatccaggaacaatggcagctttcttgccatcaaagctgctgatggcacrtatattcttaatggtgnctacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgygggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctytgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatayagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaargtgagattttactaagacctgttttactttacctcactaacaatggggggagaaaggagtacaaataggatctttgaccagcactgtttatggctgctrtggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcaktttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctkgtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaatgtgtgtgtctgttttttgaagtgggaattcattcctaggaaggaaacctgaggcacaaatattgaatctgaagaccgaattattttcttaaattatttggcaataagattttgttctagaggaaggtgaagcaagasggctgaatagaagatttttttctaatgagatgtatttcttatatccttggtatacatgattgytaaaaagaaagaaatttatgatgtcatttgttactaatgtatctaataatatacatcagtggttggcaaacttcttttgtaaaaagccaaatggtaaatatttgcaactttgtcaatcctgtcaataactatcctgtcaataccatctatgtcacaactgctcaactgtgctgttgtagcacaaaactagccataaagaatgagtaagtgaatggacatggctgtgttctaaaaaaactacttgcaaaaacaaataatgggtcagatttgttctgcagattcagtttgccaaccctggtatataccataaattaaatggaaagagctttcagttctggatgctttttgaatttgtatctcttcctcaattatatcccataagtaaaaatacgtgaaagtatttagctattgagtagaaaacaatgactcataaattacatgtagtaacgttagacatacatggtgagttaaaccctctaaatgcttcacttgctcatcaggaatacctgaggggttttggagaaaacttggaaagcccaggcctttctgcatagtctttttgtaaatcactgtcttttaaatactaagtggcatatcaataactaaaagttcagattccttccaaagtaactacacttctcccaggaaatagtatttactagaagactcagattatgtggttaaccacagacattttgaactctacgtttttcttcttttccttgaaaggaggagtttgtgccctcttctgttgcagtttgataaagacacacccaagactgggaaaaaaaagaggtttagtggactcacagttccacatggctagggaggcctcacagtcatggcggaaggcaagatggagcaagtcatgtcttgcgtggatggcggctggcaaagagagagagcctgtgcaggggaactcctctttataaagccatcagatctgatgagacttatycactatcacaacaacagcacagaaaagacccgcccccatgatgcatttacctcccackgcatcccacaacacacaggaattatgggaactacaattcaagatgagatttggtggggacacagccaaaccatatcacaggtattacaatatagcatgctagtttttatgtataggtgataatttctaacttactctcagttattcaaagtgttcttcccctgagcaattgaacatatcattctcagcagtcaggtgtacaggtgcagagaatcaaattaatttctggttatttttttttcctacctactagactaaaggactgaaagttaaagtcatcttctcacattgtgggaactagtcttgctccyccagaactcatttaaacgcagaatttaatcattcaattcagtggcctaacttgccacttgcaacaacaacctctcacaataaattatttgtctacattagtgcagtacaaatccccacagtaagtgacatggaggatatacatgagaaatgccctgaccctcattaactatacatgccatttgagaaaatgagatayataaatctaaaatgatagctcataagattaaaaagtcacttttagatcttgcctcattcaccagaattcttttctttttaatagcttagattgatttgatgtaagtaatgacactaaacttcaggacactaagagatcaaatcagccaaaaaatttcctatcatcctctcagatcaaggcaatgtcagacaactttctggtgttgccacattgtttttcagccctctgctggtgaaatttttttttcatcagtaggctgagtagtttaagatactctgctggcagagattagctcaaaacacacatcctggttttagaagattgattaaccgcttgcttgaaagaaggagagattttgtgctctctcctgttacaggtataaatgatgagctgtgcctctgctgaaagaaactttccacagtggaaagatcagggactcaaggcctgcagtctggtttcctttgtcccatacgatgctcctttaatgtgatgcactcccacacccctaagagtagcggtccctgagggccagactaccgtgaatactgctgctcctctgggtctcatccccagtgaggtttccatactccatgctggtgctggtgaatgtttgcaagggatccagtgatgtgatctgtctggtcccccagcagtggatatcagtaccagctcagttgtgggtgggaagggagtgacgtagaccctgtgagatttccgtggttataaatagccttagtgtgttggccttctcaaatacggctgtggtggtcatgtactgggcacatggacagactcaagatctactggctagccagggtgatgtaggcaatggtgatagttgaggttgtgcaagttttctccttcctgggcactgtgttattgtacctgcagatgttgtaatgggctgtgccacttggcctccagccaggaggtggcacttgcaaaagaatgccaactgtgttggtagttttgggattcgtgcttgccttatgttaccatgggtaggggagtcggsgggaagggagtggcgtactctggtatttcaggcaatgtgcagggccatggagctcccaggagtctctgtccattgtatyacactaccagggcagatgaaggggcaaagccaggtggggactgggtcaggcaagtttgctgtttggctccccacttgtgagtacaagcagcagccccagtggtgatcagagggcaactccctgcctgctggggtaatgttacagggagragtatagctgcctctgctgtacaaatgaatccacatggggagtcgggggtagcaggtggcagtaagycccactcagcccccacacacttggcaaggcaggtctcgcatccacagtgttctactagcagcagctagctgggttccagacagcctgcactcagaattccaaactgccccaggccagaagcattctgggctgagagagaaactscggctttcaggccacacctcttctggtcctccagcaaagcgtgggcatccagcttctgtgcctgtggctatagcacagttcccacttgactctcaattctggccaatggggttcattcccactcaaaattataccgcacatctgttgggagcatctctcatcccatgaccattaactcaattagctggcagacttctgcgaggtcctccgtgaggtaggatcaggcatgatttccttccatcaccactggattctgcgagtgaacacaaagcagatccgcacgccattcctcatatgctccccacagcagtaagtcagctccagcgctggatagagtgaaggcctcccagcgtggcctggattgcctggctcctcagtgagagtgtgtgtcataaatgcagtctctccctctcacgctctggacactcacaggtttttgtgtggttcacggcgtaagctgctgctcaccacttctttgaaataggtctgtggtttctttcagttttttgattaatttcctatgctgtttcttggaaaaacgttcacagcatgaatttctacacagtattttgtcttttcaagtgggagaggcatgctaacaatgcatccagttcaccatcttagaaaaaaagaaaaaaaaatccaagcacaattttcggatcagagatttcatctacgattggcaaaaatagttcccagctctttgtttcatttgtcttctagaagagtccactacagatattaacgaaagaggaacaatatacagcagccataattttctaacctcattgatttcccaaaagaaaaaaatacttattaatattaagattgcgtgtgctgggactatcaaggaaattaagcaaagatatcatagtagggaaatgtagtctgttctgccatgcacatatttctgtgacatgggtgractcatatgacattggcagaaagtgagtgatgtcattaaagatggaagatgttttggttcatctacgtgttttctcaacraagtaaattatgctttctcataggaacagcagaacataaaatatagtaactcatgaacacagcaagtcacagaggaattcagaaccatacgcaatgcccactcaccccacttgtctccatctggtcacaaacagtcttggaaattctttatatggcctttgttcaatgtgttcttgtctccataattcagaaacctgaatttttctttacagccccttctagcagccatattgcctttatgtaagggtaggtttctaaaagtacagttttttttttttgaaatttagcatgttttgttagctagggtagtttctttttatttaggattactattgtcttatgttctgctgctcttaagagaagtacaaaacaattacttattggggtgtgaaggaggtgaggagtgaaactttatgaagaataatacagaaagttttcttaaataaggagatatgtgggtggaaaccagagagatggaaggggatagctctcagagggatattataatagaggggtggccactacaggtggaagtatgcttcacttcttggagaggacagcaagaagccaatgtggctggagcaatggagaggacagcaagaggccaatgtggctggagcaatgaggataggaggttggtggagggcagagagcatgttccactaaagtaggcagtatgtttgcattttgctcagagtaagatggggagcgaaaggaactgagcacaggagagacatgcttacctaacattttaaytggaagccattgtagargaggacccaatagaagaccattgccataattgcaataaacagcaatggtgggctgagctagggtgatagctatagaagaaataaaagaggtcaacttctacagctcaagacaatgagatgkgcagatttgtagatgtgaagggaaaagaaaaaaccatcatggatgactccaragatctgtattgttcttctgtttttttgtttttgtttttgttttgggtggggagatattttgtgcaacttatatgtgtgctgtgttctacctagagatcaacagaaattaaaatacaagatttctagtattattgaaaccagttacacctatagcaaaatataaactgcagagaatatggtttcaaaatgatctggaaatgtaaagatagttgttaaaaaagaggatatataatgtgagatattttaataaaaataattccagtacaaaaccatatgtcatatttacaaaattataaaagaatttgctcaaattatattgggagttaacaaagaatataattttattmttgagtttggtaattagataamtatagatgaatgatatttcttgaaaacaaacacacacaaaagtcttttcatggaaagagaactcacatgaaacccataaagtaaagaatggaaagcaaagtaaaaacacaaaataagatgacggagttccaattacattattatggaaacacattgtttaaactcttctattaaaagacaaatatcttcaggatgtgcttaaaaataaaatccaaggacatgataagtaaaaggaaactatctaaatcaaaatgacatttttgtcaaagaagtgcaaagatttattaggcaaacacagagaaaataggaacagaattgatttcagccaaattatttttaagatggaaacacaaaaaataaaataaagaataatagttttgtgaattaaaagtacaagtcacaataaaatatgtgtcctggataataaaacaactatctataaatttaaaacttttaaaaaaattacaaaggataatcaataggaaagcactgttctatttatt

SEQ ID NO: 13356 - DNA, 47572 bp, Homo sapiens
  misc_feature (1)...(47572): n = A,T,C or G, or insertion/deletion polymorphism (see Tables 1-2)
tcccctggctcctcctggtgcaggatcgatgaggctcttgcccacagcctttgtcccccgacttcctaccacctggtgtcctcaccccatctgggccccgagcacacagcctctggtcctggtttccactgaaaatgtaaactatggtccacgccacattctccagtactcctgtgctattgtgaaagtaaaagacaaaaatacacgtgcttggcagcccgagagcctgggtgagattattgagaataatgcggtggctctggcttaaaaaataaaagccggaggatctaccaccagctctgaacacacacccgtgacamaaactgactcatgtgcaattgcccattagtggcaggtcttgccatttttcgtttttttctgagtcgagatcagctgcrgctggggagaacattagttctgtctgtcggctccatgagtaagcagaggaaagtctgactacagaggcatcttctcaaatgtccatgaaaggctgcaagcccgagagtaacgcccctgctgccctgagtggtccacgtggtgtccagagtgtgagaaagccacagagagcttttccacacggagccacttaaggcctgcctcagcctgagaacacttgggcagaaaaggacagcacggcttcctcctcctccaggccgggcctacaagcacccacagttccgacagagaaagtctcttcttaatggtacrcatgtgtcttactgtagctcccagttagtcccctaagcgtgaaccaccacccacccatgctgctcccctcccaccatctctccataaacaggacccaacgcagccaaaaactcatggtcatgtgaccttggcatcagcttgctcgttaggaaccgtgcctggaggtgctctgagcactgactgccaacctcagcagggccctttgtggtgttgaggtgtggtgtccgcagggcagcctgcagcctgctggggtccagcctggggcctcaggtcctgggaaccctggttgaggctgggctgcctcagtgcccctccgcagcctgctgcacccaagcactctgagaaaaggagcaatcacccaacttcagtctgaaaatgagaatgttgagaagggcatgatgaggggaagcagaccagagcccaccggcaagggtagaacgtcagccccgccctagtgggacagacaagagagaagcctcctcacaccaggaggcagtatagcsggagccttccctccagggctctcaggagagcctgtgctggttcatgaaaaagtgaggcctctgggctttgctgctgcagagtgaggtcagagcccacaggccccacagatcatcctgcctgacaagcacaggaggcaccactgcttgaattcagagggcagctccgagggtcctaggtcccctgtgaatctccacagaatcctgggacctcagagcctgcatcagttggtcccccatgcagggacttagtgactcygcagccccagtcagggcctgctctgtgccaggcattgctctgcagacccaaagggactccaggccagtcctcatcctcagggcccacagtgtaacacagaggccgtgccgcaggctctgctcctctgccagcaagctgtgcagtcttgggcaggttacttcagtgctctggtctcagcttcctctgcaagtggtggcagggctgtgctggaggcatgagaggggtgtgggagctgcaggctctggcaggtggcacgctggggttcttggagaggggtgtgtggctgccaggggactactgctgtcattgccatctgcagagacaaacagaaacccaacacggcagccatcactggggccccttcatgggagggatagggtggaaattgcaggtcccagcaaggcctcaaagcaagtgcccagcctcccctgatcagtccaacctgaagccaggtcctggtgtgcacagagatgcacggctgggctgccccacctgcttgggccacaggaagcatttctctaaaggtgagcagcttcctctgcaggtgacacggcctccacccaaacccagaggctctggctctcccactgcggcttgccgcrgccccacacttgcctgctcccacactgacacctccaacaccacaggggctgctgggtcacgtggcccagatggcagggctgctcagacagtcattttctgctcctggccgcctcgaagctggcagcctccatgtcagccragccgtgggtcagagcagtgcccccaggaattaaatatgttgccttcagaacccaaaaaggcctgtcaggccctgtgcttcctcctttgaagtaggggatgcaagatgtagcaatttctcttttactttagaggatgtcctggtatgaacctgatcactggtgccctaaaaacttccatgaagttaggtccctgaatcctcrgagttcacctcccacccacagatgcaaatgtgtctcataaggcctctagctcatgaccctcctgttcctcctcctgcccattatgtcgtcactgtaatggatcagtgtggtgtccggtgcactgctcaggtgcccagatcttttcaggcaatattaggacagaggacagagttagcgtggccctgcactaaactgggaatgagtattgttgttcctcccatgtaaatgcaaactgtttccgatcctcttttctaattggaatagaaaagaatgcaatggccaatcactggcctcattaatctgctacgatgatacgtctgacacagcagatgcaactggagctactaccgggttcaggctaagtggtctggcgtcactttctaggatccatcagtctttgcaatgaccaggccagagaattagacacgacagtccaccaccctcgcctccgtgaggcctttaayggtggtgccatcctcccaggatgcaacgtgrtttgtgatttactctcttggccatggaaaggggacttccccactatgatgtctgtcaccacacaggcctgggatccaatatatggctactccagccaccaagtacataaattataattacatactcagggggcagggaagcggccactggatggtcttctggcccaggggtctcactgtgcccaacactttagccaggattcctttttattacctggccccgtcagccccttctctaacagggaggccacagcgacacttttggcctccagtatcaaggtccactcacatcccgcgtccatttgtcctcaaaatctctggattttcccagcgtgcagccagctgagtgagtgacagcgggattctacagaacatccttgtcaaggtattgcctggtccttccttctggtgacctggccacctctgcaatcaatggttccagacaggaaattagctcaagtccaggaatggagtagggaaccacgatattttactggagtccccgccctyggcctctttcttccttcctctgccgtccgccagggcggcttggctcaacatgacccatcgctttctccaggcttctgggagccatcccagaatcatctttgacccacgacctgcagaacttgccaggtaactaatcctatgtgccaagcaagtgcctccgcctcaatagttcttctgtccccctggataaagcaccctggaaatctaataccgggggtgytccctggctcctgcaggcacatgctggctgcctcgtgcagttcctggacatgcaacctctctactccctggtcaggcctagcaggtccccatccaggttaccctggactttctccctagtcactgctggcagccaagagacaaggtggagcagcccccagtgagggcacctgctgctctggtaggggaggcccctggagcatcttccagcacagaggaagtgctggcttccaagggcaggaggggcccctctgcaagctctgaggggacaggggtctgcagggccatgccctcagggcttccacctggatgtctcagcccatgtttcagggtcccagattttcccaacyggggtccagaccttcacataggccagccgtggccaggcatcaaaacatgcctagagctaggtggtccccacagtcactgtcggctcctcagccatactggttctacctctgccaaacatgggactccttttcagcaaccagagaggccctttgttctcacaccaagcctgatgggcaaccgtgggtaacgtcgcaatctccattcatccctctgtggagcatcaaccccactccccccatgcactgaaagggggaaactgccacacccacaaggcctccccttccaccaggaaaacgtcccagatcactcttggtgaaaacatttaacaattggggccctaactttgtgccaaagaytacccatatccccacatcaaccagaatggtgtcctcggtgttggccgggaaacggccaccgcaccagctgagtctcaggcccctcctgcaccacttgtgttaattggggtcttccaagaggcaggtgccatggaagctctgacgtgactggagatttatcagtgcaatgtctgtgaaggatgctggggrggtggccaaagaggayggaagcctcagaccacaggtgagacccctgtgaaggagatacggggagccttggccagcacgtgcccctagacagtgctggccaggccgagggagaacttctggagccaaggtaacccctaaaggattctggtcttgtgaggaggggcctggcttccccctgggagctgctggcttggaagcaggaggcattgcccaggtgagagttcggcatggacccaggggagtggcacacggtgcccgccgtcagctgtgctcaggagcagcaggcaggagccctggactcatggctaccatgtggctgccacactcaggcacacttaggcacatacactcacactcaggcacayttagacacacacaycacactcaacctcagacgcagacacacaccacacactcacagatgcacacacagtctcagacacagacacacaccacacacagatacacacaccacagactcaaactcagtctcagacacagacacacaccacacactcagatgcacacaccacacacactcagtctcagacacacacacacaccacatttgcaaacctgctcatcagaagagggacctcgcccccagccgctccgccmccttccaggacagctctgaagggagccctgtcccggagcccagggacctctccccaacccggctgcgcctcacctcaaggaggaaccccggccctggctgggggactgtgaccagggtggggagtggggaccccagacagagccctaccagggacccctgtcactctgtccccggctgggctcaggtggggacctmacggtggtcccagggcccagcaccaagcccacctgtggtttccagcgggaaaggggtggcaggggtggctcgccgcatgcccaggctctgccccaacctccgcgcccaggctctgctgtccctgccctcccggctccccaccctcaggccccaggagcrgcagtttctgcaggagctcctgacccggggcytctcgcrggaggcctgagcaagcsggacacaggacacggggtaggggaggggtsgggsggctgatggggggaaccctgcaccccccagggcagctgctaccaaggggcgagtcccagggcccccgtcggccctgcgtgcggggcgcggtccccaacacccagggccccggaggcggacacagccccagccaggtcgtccgggaaatggggcgggggcgacgggcggcsgggcccgggacgcgaagtccgagcagcagcgggcaggggctggcgggggagctcggcccgggctgcaggggggtccccaccctctccacctyctccwgcctcccgccctcgagggtccccgcttccctcccatccccctcccgtgcccccggccccctcctcccatccgcggggccgcagcgcttcctggcggcggggcgggtcaggccggcggggcggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggyccccgggaagggggactccagccccagggacggcggggggctcggcgggttcggggctcctcctcgcggggctggggccgcgcctgcccctgtggctccgcgtctctgggtccgaccctcgggcgcgcgacttggggccacctccccgcggcctcctctggggcggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacakctctggcttggaggcccccttgcacttcgactctggtgattatttcaagaaaggccagaccgggcacggtggctcacgcctgtaatcccaacacttggggaggccgaggcgggcagatcacctgaggtcaggagttcgagaccagcctrgccaacagggtgaaaccccgtctctactaaaaatacaaaaaaaaattagccgggcgtggtggcaggcacctgtaatcccagctaatcgggaggctgaggcaggagaaaatcacttgaacctgggaggcggaggytgcagtgagctgagatcgcgccactgcactccagcctgggtgagggagcgagactgtctcaaaaaaaaaaaaaaaaaaaaaaaaaaaggaaagaaaggcccggtgagatgctttctcttaaacacggccctgcacgttgagttgctgcctcctgtggcctatttcacgtttatgcaaagtcgggcgcctgatgcggggctcacccgccacaagcaggggtcctggygctgctcatggaaggggccctacccagcccgcggggcactggctgggacggggctgcccaggtccgcccaggatccaaacacccagccccgcccagcggcccttcctggcctgcagtggaggctgtaatgggcaggggtggtgggaatcccagctcacagggcgcctgctcttagaagggcggcrtctgggtccagaggtcagaaacgtcagatgcccatcccagaagtggcggggaacctgtctccacaatggatagcagcactgtctttttttttttttttttttttttctcatttcatagataaggaatgatgccttgttggggggtttgttctgcatgtctttggtttttgtgcagtacaaggctatttgggctgtttgatcactgaccgtgtgtagtgatgtgcattgcctggttgtgatgtccccatgttcctaatggatgttcgctttttgggtttttttggttttttgtttgtttgtttgttttttgagacagggtcttgctctgtcacccaggctggagtgtggtggtgctatcactgctcactgcaatctgcacatccctggctcaagcgagcctccacctcagcctccgagtagcggggactacaggcatgcaccactgtgcccagctaattttcttttaagagacggggtctcactatgttgcccaggccatggatgtgtttgtttgtttgtttgtttggggtgtttgggggkttttttctttttttattgatttgaaaaagctttattttcccgaattttttattgtggtatacaatataaaatgtactgtcttaaccatttttaagtgtgcagctagttcagcgacagtaagtacattcatagtgttgtgtagccatcaccaaggtccatctccrgaactcttttcctcttgtcaaactgaagcccatggagcaccaactcgcatcaccccttccctcccctggcagccaccatcctactttatgtttccaggaatttggccatttaggtgactcatatgagtgaaatcgtatgaaatgtctccttttgtgactggcttatttcacgtggcttaaatgtcctccagattgatccacactgtaacgtatgtcagcattcccttcctttgtaaggctgagcagtattccactgcatgcatgccctgcattttgtttacccattcgtctgttgctggacacttgtgttgcttccacgtttgagctactgtgaatgatgtggccatgaacacaccacacagatacctcttggagatcccactttcacttcttttgagtatgttcccagaagtggaaatgtggatcatttgattttttcatttttttgagaattaattgcctcactgtttcccacggtggctgcaccattttgctttcctgccaacagtgcacaagggtccagtttctccacatctgcaccaacaggtgtcattttccgggttcgcttggttttttttaaatgttaaccatcctaatgggtgtgaggtggtatctcactgtggttttgacttgcatttccctcatgattagtgacgttgagcatcttttcatgtgcttgttggccatttatatatctcttgggagaaatatctgtttaagtccttgacctatttttgaatcaagttgattgttttttgttgttgaattttaggagttctctgtatattctggatattaatcccttattagatacacagtttacagatattttctctcattctctgggttctttttactctgttaatgatgtcctttcactagatagatgcaaaaaatgtttttaaattttggtgtaatctgatttatctattttttcttattgtcatacccaagaaatcattgctcagtcccatgtcacgaaggtgttaccttatgttttcttctaagggttttaaagttttaggtcttaaaacgtaaagatccattttgagttaatttttgtatatggtattaggtaagggtctaacttcattcttttgcatgtggatatctagttgtctctgcaccgtttgttgaaaagactgtctttatcgaatggtcttgacggcttgattgaaagtcatatatgcaagggtttctttctggactctctgttttattctgttggtctgtatgtctgtctttatgccagtgccacactgttgatgactgcagctttgtagtaagttttgaaattaggacatgtgagtcccccagctttgttcttatctttcacgattttttttttttttttttggctattcgaggtcccttgagattccatctaaattttaggatttattcactatttctgaaaaaaaaaacaatcactgggatttttatagggattacattaaacctckagatcaatttgggtggtattgacatcttaatatagtaagtcttccaatctatgaacatgaatgtctttttttaaatgtcctcttcaatttctttcagaaatgttttgtagttctcattgtacaggtctttcacctcctaagtcaatttttaagtattttattatttttgatactatagtaaatagaattgttttcttaatttcctttggattgttcattgttagtgaatagaaatacaastgatttttatgtgtttactatgtattctgctattttgctgaatttgtttattagttgtaacagtttttgtggaatttttagggttttctacatacaagatcatatcatcagtgatcagagataatttacttatttctttccaatttgaatgcctttaatttctttttcttgcccaattgctctggccagaacttccagtacagtgttaaatagaagtagtgaaagcaggcatccttcctttatttctgaccttagaggaaaagctttcagtctttcaccactgagtatgatgttcactgtggctttttcgtataatatggcttttattatgttaaggttgtttccttctattcctaatttgttgagtgtttttatcatgaaagggtattgaattttgtcatatggtttctctgcatcaactgcaatgatcatgtgtgagttttttttcctccttcattctgttaatgtgtattacattgattgattttttttttttttgtatgttgaactatccttgcactccagaaataaatcctacttggtcaattcattaaattccatttaattgcatcaaattataccaaatttagtttactattaatagtattttgtttaggatttttgcatcaatgttcataaggaagactggattgtagttttcttytcttgcaatatytttgtctggtattggtatcagagtaatgctggcctcrtaagaatgagttaaatagtgttcccttctcttcaagttttttgaaaattttgggagggtttggtgttagttctttatgtgtttggtagaattcaccagtgcagccatcaggtccagaggttgtttgtcaggagatttttgagtattgattcaatctccttactagttatgtctattcagattttctatttcttcatgatttgattttgtcttgataggttttgtctgtctggaaatttttccattccatctgtgttattcaaattgttgacatatagttgcttatagtacactcttataatcttttttatttctgtagaattagtagcaatgttgccactttcacttataattttagtaatttgagtttcttctttttttcttagtctagaatctagcttaaggctggtcaattctgttatcttttcaaagaaccaacttttgttgtcattgattttctctattatctgtctgttctccattttgtttatctttgctctgatctttattttttccttctttctgctagcttgttctttttctagttccttacattgtaaggttaagctsctatttgagacctgtcttttttaatataagcatgtatagccatcagtttcccccttagcactgctttcactgtcgaacaagtttttaaatttgtgttttcattttcactcatctctaagtattttataatttcccttgtgatttcttctctgatccttggttatttaacagggtgttgtttaatttcgtgattttttaaatgtccttgttgctgatttttaactttactcctttgtggtctgaaaagatatcttgtatgatgtagatctttcaaaatctattgacacagactttgttgttgcaactaaccccgtcattgcaagcccttctccgtctggttgaagtgacttccaggagatttaaagggctggcacccttttctcccttcatttttctctttttcctcttttgagasgtagacattgaagactagcacattcaaaagcaaccatatatgtggagaaaataaaaaagtcattgcacatgctcaggggaagtcacgggcttagaaaagacctaagaagaccttaagtttatactttatgctgatccttagcacagagacagcaacaatcaaaattataaaaacaagaaaaaccagcaaactctggggaagaaagagattttgatttcacaaggcatacaaagaaactttcctatttcaaaggaaaaaaaaacaacagaaactgtcactgaaaaagacttggtggtagatctactagacaaaggctttgaaagaactatcttaaagatactcaaataactaagggaaaatgtggagaaagtgaaagaaaatgtaggaacaaatgaaaatatcaataaaaagctagaaattttaaaaagaaaccaaagggaaattctggagctgaaaagtacaataactgaaatttaaaattcactagagaaatgcaaaggcagatttcagcaggcagaataaagaatcagggaacttgaagatacaamaatggaaattattgagtctgaggagcagaaataaaaagattgaataaaggtgatcagagcctaaggggtctgtgggataccatcaagcaaaccaacataaacattgtaggagccccagaagaagagagagcaaagggagcagagagactatttgaagaaataatggctgaaaacttctaaaatatgatgaatgacatgaatataaccatccaagaagcccaaaaagctccaagcaggatgaactcaaagagacccacactgaaacattctaatcaaattgtcaaaacccaaagacaaagattttgaaaacagcaagaaagaatgattcatcacatgtaaggaatcctcaataaaactattagcagatttctgatcagaaactttgaaggccacaaggcagtgggccaatatatccaaagtgctaaaagaataaaaactgtctaccaagaagcccacatccagcaaaactgtcctttaaaagtaagggagaaattaacacattcttagatcaacaaaagctgagaatgttccttaccactagacctgccctataggaaacgccaaagggagtcctgygggttgaaataaagggtgatagacagtaattcaagtgaagaagtaaagatctcagccaggcatagtggctcatgcttgtaaccccatcactttgggaggccgaggcaggaggataacttgagcccaggagttcaagaccagcctgagyaatatagggagaccctatctctataaaataaaaatatttttaaaaatcgaccaagcatggtggtgcacacctgtggtcccaactactggggaggctgaggtgggagaatcatttgggcctgggaggttgaagctgcagtgagctgtcaccacaccactgcactccagcctgggcaacagagcaagaccttatctcaaaataaataaataaataaatatctcagtaaaggtaaatatatagacaattataaaagctaatattgctgtaacaatggtgtgtaatgctgctttttgttttctacataatttaagagactgatttaaaaataacattatgcttttggacacataatatataaaggtgtaattttgtgacatcaataactaaaagggttggggacagagccattcagggagcagagttttgtttatgccattgaagctaaactggtataaattcagtgtagactgttataattttaggatgttaaaatgcaatccccatggtaacaacaaagaaaataactaaagaataaatacaaaagggaatgaggaagggatttaaatgtttcaccatcaaaaaaattaattaaacacaagacagtgatactggaaattaaggacaaaaaaatccataaggtatacagaaaaaaaatgcaaaatgaaagaagtccctctttatcagtaattactttagatgtaaatggattaaactctccaaactctctctgttaaaagacagagattggcagaatggatttagaaagccaaatccaactatatgctctctacaagagatgcactttagatccagaaacataaatagattgacagtgaaaggatgggcaatgacatgccacacaaatagtaaccaaaagagagcaagagtggctatactaataccagacaagataggctttaaatcaaaaaaggttacaagagggaaagaaggacatcatatattaataaaaggctcaatacagcaagatataataattataaatatttatgcacctaataacagtccatcaaaatatttatatcttacactgggaagattgttgctggctctcagtctgcttccagtctgctcatattgcttttgttgtaatgatggtcatatgtgggagctcagtrtcaagagggcagacttgagcccacactgccaggcttcagacctcagctattagctgagtgccctgggcaagttacctcactgggccttggtttcctcatctgttggagtggggatggtaatagtacctatgtccaaggccataagtccaattgtgaatgttgaatgaagggatataggacagtatctggtacacaattattatagatttttcattgacattttatacattctgttttcttcaaagactttttggttcctgttttgcactcagatacttccttttcctggagtttatttgggagcaccatgtgaggtagtacctttatttctagtcacagggtgagccctcatcccagcctgcttccaccactctgaaaggccaccatgtcatagcctaagttctcgtgtgttgttatgcccatggttgtgtggagtgttggcctgttccagcaccaaaaccaaaactgtaattttatcrtttcatttgatagcacaagctttctcatcactctattttttattttgctcaactcttcttgctttttctaccaagtaaaacttggattcattttgcaaactcctatctacaaaaatgcaaaaaattttcttggaaactttaattaaaattgcattctattatagattcagttaggaataactgatatttttaaatcagtttaagatagtgggatgatttcttatccaaaaacaaggtttgtctttccaatatatttctcaaaaatttttttgagtttttttcataagtcctgcacatttttattcagttgattccttgggtttatgttgtttttcttamtagtgtaaatagcatttttctgcaacattttctaactggttgttagaaaatgtttcttctaactgatagaagaaaatcaataactttttgtatgttgaggactaagctctgatttttttatcttgcctatattsttatctaaggggtctrgggagtcatgccctacaaaccataaattctcatcagatggttttatctaaccctatatgcygtgacttactttccatctgactctggcatgacactacacgaccaagaagaaaataaaaatattttaccccaaaacatgtttctttgccacattttgaaayggccctgcaaagctgtcctttactggggaaaatttgcatctgtaaggaatctctgttaacatagctagctctttttcttccaggccctcccaattctgaagagattaaccgagagtctagcagcttttaaaggtctcartaggaaacacttgtcattgattgtctctaagggcagccactatgagacttcagaagaaccttggtctccacagtcttttatcttaacctgagcatttcctttctatgatcccaggtctttagacaaactcaaccaattgtcaaccagaaaatgtttaaatttacctgtagcctggaagccatctctccccgctttgaattttcctgcctttctggattaaaccaatgtatttcttaaatgtatttgattgatgtctcatgcctccctaaaatgaataaaaccgagctgcaccccagccaccttgggtacatgttctcaggacctcctaagggctgtgtcatgggtcatggccactcatatttggctcagaataaatctcttaaaatattttacagagtttgactcttttcatcaatgatatatttttctaagtggctcactaaattttctctccctaatctcccctcctttctctttctttctctctttctctctgtctatatatatatatwtttttttttctcttttttaaaaaaactttgttcagatgattttctgggtagacaatcctatctttaataaggacagttttgtctcttcttttccaacagttatacttttatttttactgtcttattgcattggcttccaacacaacactgaatggtagcgtaagatctgcactgtttgcccccaccccattttttttgtactgtagtaagcattcttctaatgcaggattttttaacccagggttagatctacgaatggaatccctgaattcctggacatgatttctgtatatgagcatctatgcatttgtgtaaggtgaaattgtgtagactcttaaaagggtccatgaccacaaagataagaaccactattttagctttttgtgtaaaatatgatgtgagctcttgatttgaaatgtatatcctttatagagttaattctactcctaaatttcttactaggttttaccttgtctggctgttgttgtttcttagttagaaattgatgtttcagggatctattgaagcaattgcatattttttcccattttatgttaatgtgacttacattaatgtattccctagtgtttgtggcaacactgtactttaacttcatattatagttctggtatagtggtccttaatatgctattggattttagtttttaatattggctagaatttttgtgataatgttatgggatttttagggtgtcacttttctggcctgaaacctctatggccagtggcgcctttgcccaagttcttgtcctgtgtccaggaagaatgaggtacacagacaagtggagggtgtgcaagacagagaagctttattgagtgttaggggagctcacaggagacccgcagggggcagcccctctctgtaggcrggttgtcttgtcggcgggttgtcttgtcaaatgttcagctctcagcagagagaaggccctggagtgggtggctcctctctgcaggcaggtcatcccattgtctctgcagctcttagcagagaggaggccctcgagagcgtgtctcctctctgcaaacagggcatctcaactagtgttcagctctcagcagagagaaagccctggagagggtagctcctctctgcagctggtcgtcctgacatcccttcaggtcctgaagctctcagcagagagagcacctcctctctgcagctggtcgtgccatgctctgccctgctctgactgagcctggggcttttaaaggcctcagagaggggaagtgcatgctgattggtccatgtgcagccatgtgcaggcccagaagaaagcaccttgagttcccctctggtccgtaggacgggcaacccggcccccaggcttcaggcctgccccagcctgaaggtggggcttcactggggacccatcctcttctgcccaggagcctatctgcctcctgcagccatccatggtgcccaggctgctggtaccaaggggcaccggtgcccagccaccctcagcacccccccaagcctcccctcctgcacttctcagtgcccacagtttggagggggccaagtcagcagggggctggcatgtcagcactgccacaagcatgcacccacccggccaggctgtgacagtgcccaggctcagccccaactctgctctgagattggagtgggtggtgggagcgggaagaagctgggcagcgggaacaggcacctccaggcctacaagggaaagaggggccttccctggctccccaagagtgcagcgatgcctgggtcagcagccccagttggggcagctgaaactgcaccaggagtgggggctggctcctgcctcctccatggagcagaaggcccagatccacagccacgacttgggcagttgtacctggggaactctcacctcgccaaactgcaaggggcagggatcccacttatccccggctcctgctggctccgtggagcatggtacctggccatgtcctctcgcagcctggggcagggtctccagacctgggccagcatcccagacaggggcaacaccgccgtgagctccccttcacccagcacaccacccggcccggccccatggcagcggcccccagggaggcagtctgcggggttgggggcctgtctgcctcttccatgggccctccctgagcagccagtgtgatggcagcggccacaccagatgggctgccgctgccatcagtaatatttatagtgatatttatctgtagagttacttttagggacttttttttttatcaagctttggtcacaggttatgcmacatttaaaaatgaattgggaaaaagtttatctttttatgttctaaaacaagttaaatagcatgaagtgcttgtccttgaagctgtgaaactcacccacaaactgcctgagctggcacctttgggaacggacttcattcctccctgggccccaggctgagcaggtctggcctgggtcacctcatccactccagacgccgcaaaatcacagcaacccttcagggccctctcctggcagcgcctcccctagtcccggtgcttggacactcctcccatctgcaccgaggagagggcggcactccaatccctgcatyacccctggaactgcacgctctgaaccaggcccggtgccctttctgcccagctgcccggctgctgccagccccactctgcggagccagcagcacagtgaggcccgtcctgatggcctccagctccactctgcggagtcagcrgcacagtgaggcccgtcctgatggcctcctggagctggagcttaggccaagccacagggcatcagggaggatggacgttcaagggctggatctgtttgccccagggtcctggcacccaacagaaaggaaagccaggctaatgacggctgtgtccctacacttgacagagtcctccctccctccttatcaaagtcctgtttaaagggaatggagccaggctggagagagagtgcctagctctgcaggggagccggtctggggaagctgggatctctctcccgccctcccctctgcactgcttccagggcagccccaggcagtggggggcgccagacagtggtgctccattcccttccatggccgacgcgcccagctacccacttccacccagccctgnnnnnnnnnnnnnnnnnnnnaacaagttaaatagcatgaagtgcttgtccttgaagctgtgaaactcacccacaaactgcctgagctggcacctttgggaacggacttcattcctccctgggccccaggctgagcaggtctggcctgggtcacctcatccactccagacgccgcaaaatcacagcaacccttcagggccctctcctggcagcgcctcccctagtcccggtgcttggacactcctcccatctgcaccgaggagagggcggcactccaatccctgcattacccctggaactgcacgctctgaaccaggcccggtgccctttctgcccagctgcccggctgctgccagccccactctgcggagccagcagcacagtgaggcccgtcctgatggcctcctggagctggagcttaggccaagccacagggcatcagggaggatggacgttcaagggctggatctgtttgccccagggtcctggcacccaacagaaaggaaagccaggctaatgacggctgtgtccctacacttgacagagtcctccctccctccttatcaaagtcctgtttaaagggaatggagccaggctggagagagagtgcctagctctgcaggggagccggtctggggaagctgggatctctctcccgccctcccctctgcactgyttccagggcagccccaggcagtggggggcrccagacagtggtgctccattcccttccatgccgacgcgcccagctacccactccacccagccctggaggacatggaagggcctcaaccatccaaatcccamccaaaactgagcccagaggcacccactaaacatctgtgaccccacccagggtggggcaagagggcgcaagccccccagtccagatgctggtgayggtgtgtgctgggcrcagaccccgcttccttgaagactgasggcagtgcccccaatccyrctgacctgctgtgcgtgcgcctgccatgggggagggtgccaggggagaggcactgggggtgtctgagcgacccccacccctgttgcaggacttcagggccacaggtgctgccaagatgctccagggcacctgctccgtgctcctgctctggggaatcctgggggccatccaggcccagcagcaggaggtcatctcgccggacactaccgagagaaacaacaactgcccaggtgccaggggtcgggggccgggggctctgggcatttggggggcagttgggaccagtacccaggtgccaggggtcgggggccgggggctctgggcatttggggggcagttgggaccagtacccaggtgccaggggtcgggggccgggggctctgggcatttggggggcagttgggaccagtacccaggtgccaggggttgggggccgggggctctggcattcgggggcagtgaggtcaaacccacaaacaggcacggggccaggaaacggggctccaacagcagtccctcctraggctggctcgtgacaggtcctgtgccccacagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctayggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgccygactccaccgagatcraccaggacaccatcaaccgcatcatcaaggtcatggtgagccgygggcgggagcaccgtccacrcgccaggggtggccayggtgggcygtccacccrctccgggcctcactttacccctctgtgagtgcggaggccraaggaggaagctccgggcagggcctgggccactcaggtgtccctccatccccacccagactcgaggtgcagccgccccaggtctcgaggcacacggctaaccagcatgtctgtcttttctgcagaaacacgaagcctacggagaggtgagtggcgcttcccttcctgccagtgctggccggcagctgacccagcagagatgaccgcgccaggctgccgactcctggcgcctccaggctggaacagatgagaggagagggagtcacctgctccatgttggacctgaggccttggagtctggagaaagggctcccagccaaagctaggctgtttagatcccgtgagggtcagcgttagggtcacccacagagcacgtgttacaaggagaggtcgagggtctggcctccgggcaggtgggatccatccaccctggactcgaggcccgagcccagcccagcaggtcaggggagaaggaactgacatcatcggggtccatgacatccccacctccctgtgtgtcccagctccagctctcaggaaggggagcaggcatctgagatctcccccgtgaggcttcctgcaaaaacgtgccctgcctcagaatcgctgctcagtaacagtggtttcattgccrtgtacaaatggtgcctccctcaccagtgccccttgctcttccatccttttgtaaaatttattcttttatatttgtttttttagagacagggtctttctctgtcacctaggctggagtgcagtggtacgatcacggctcactgcagccttgaactctgaggctcaagccatcctcccacctcagcctcccaagtagctgggactacaggcacctgccaccatacctggtgtgcgcatgtagttccagctacttgggaggctgaggtgggaggatcgctttcgtattgtttttttgtagagatgggatctcactatgttgcccagcctggtctctaactcctggcctcaagcagtcctccctgcctcggcctaccaaaatgttgggattccaggcgtgagctgcacccggcctttcttcccttctattttctgtcatggcttaagccaggcttggttttttaaacttgcctagaacacctgaccgagagccaaactctttggcttgtccctgatgggggcagagcctcacagcaccccatgtctcacagctccctcacgcccgcccaggttctcagggcatttcagcatctccttggcccctgctgagagtcgtgggctacacgttctgagaccctgccctgccacctgaggaatgtcccacccatgcaaccttctgtctctgcttcctcgtttcagtgctacaaggtgagctgcctggaaatccctgggccctctggccccaagggctaccgtggacagaaggtaagatgcccagattacctgcagggtctgcgctaccaggaagcccctgatttgttttgaaatccacacttggccgggcgtggtggctcatacctgtaatcccagcactttgggaggccgaggcgggcggatcacaacgtcaggagatcgagaccatcctggctaacatggtgaaaccctgtctctactaaaaatacaaaaattagccgggcgtagtggcatgcgcctgtagtcccagctactcgggaggctgaggcaggagaatcgcttgaacctgggaagcggaggttgcagtgagcagagatcacgccactgcactccagcctgggcaacagagtaagactctgtctcaaaaaaaaaaaaaaaagaaaagaaagccacatttaaggccagctgtatctcaaattgtctcaacacttctgtccctggagaaactaaaactctatatgtctaattccttttaaatagtatattgagaaaagcagaagcttgtaaaaaatgagatatgccattaaaatactttggtaagcaagcatattcaagtaagtaaaatgtgagatgcactacacttaataatatgattgctcattaatatgaaggaacctcttttgtggcttactaaataagcagttttagggagcctggtttgaatgtcccctgcattttctggtttgaacatcccctgcattttcctaacagaggtgcatcaaataaagtccttccaaaactcactaacagagtatgtgaaactccaacaattcacatctgttaaaaattataaagaaaagcataggaggagaaagtagcttctaaggagatgaaataaggaattgaccatcatagaggatgttactgctacgtagcttcgtgtttttctaaatttggataacagctgtctagaccagtaggtatctggatgtactttctccaggatgagacatctcgaggctgcaggtcaaatcctgccatctccctccctggcttctccagtcctggtggcaatgccgaccctactacagctgggaatgaatttgccacttggggcagccttggctgcacacagcagtgcagtgacccsttctgttgggggggccactggaagctgccacagggatcactgtggttagagtttgaggggtggcaaggtgccaagcggagcccaggacagggcacagctgtgatgttccagaagcctctgcccacctcatcccctgccctgagtttcctcccttttcttccttttgacctcttaattcttccyctttcctctgctcctctttgcacttaaattgggagcatatcaataaatagatgaatttatttaataaagttctgtatcataggttaaaattttaattccaagagagtgtaacctttatgtggtgttctgaagtcctgatctgtctaaagttacttagataaaggaattaatctttgtagtgacggtgacccaggcatcgctggagaatcagagcccagtgttggccacagtcacagctactgggtgcagaagggacccccacgggccaggcacccccaccccaggggkctcttctggctccattttgcaggtggctttgtgggaagcttccctcagagctgggagaaatgggtcaaagcaaacccttgtctgacagaggctggccctttggggagcagctgacaccaagacttctccacttgggcaggggaatcagtaacctctgctgtgtcacctctcagaggagctgtggcagggtccccagctgcctaccgcccaccctaccctrcctcgatgtactcttttctctgcttttagggtgccaagggcaacatgggtgagccgggaragcctggccagaagggaagacaggtgagtgtccttgccccacgcccgccccgcctgcagcccagcgccccagggctgggctcacactgctgcgttgtccttcacagggagacccgggcatcgaaggccccattggattcccaggacccaaggtgagtgacctcggccaggggcttggctccaccctgaggccccagcactgccaggcaggctccccccagcccagcctcggcctcagcctctacgaccctccccccagttaccaaggaacagaagcacctcgataacttgatggccgtcccaaaacccagcctccagcccgacccagggctcagcctcctccgcagactrtttgtcgagaacaytagatgccagcggcccaccgagcactccyctcagcctgcagggctggcccttccctgcctgtgtctctgcagagctcctcactaatgcccctctctcctcctgcccccagggcgttcctggcttcaaaggagagaaggtgaggctcttgccctgacagacctcagacctgcgccagcctcggcccagacccacctcttggcgtccgccgcagcctgtcactgctcctggggcaccggcctggtcttttctcagtggtggctttgggggctcctggggggtcctgtggccttgagtttggcccaagggctttgccccccagaggcagcagtgcccatgatgctttgaggcaccgagctcactgcgcyggctttcctcctacacagggtgaatttggagccgacggtcgcaaggtaggctggctgggtaggcagagcccctccttcctgctgctcagggcagaaggaccggggctaatggagttccctcttccttctctcttcagggggcccctggcctggctggcaagaacgggaccgatggacagaaggtagagggagcctcgggctcacagctggactggtctcacagaggcatcccagcctctgcagggcccccagatccagcctgatctgtcagcttacacatgtgtacacacgcatacacacacacacacacacacacacacacacacacgaacttcagctcctgccacatcccactgccccacccagggcttcaccagcctgcatctaattcatggctgcacatcccggcttggggcagctccacagctgcacacagaggccagcaacaagcctacccactcccaggtcaaaccacaggacagccccacccactccttccatggctccccgtgggaacatcctctgtgcccagggagctctgccctcagggcctctgggaggcagccagggatggcctgttcctgcacaacggccactctgcctccccggagacagctccacagcagccgtggcctcatgtgggcacccgtgtgccaggaggagagcgctgcagccctgcggggcagaaccgggtgggctgtgtcttggtcgttggcacacatggaccccagaaccccgccctgagactcctcctgcccccttctccttcagggcaagctggggcgcatcggacctcctggctgcaagggagaccctggaaaccgggtaagggccgtttgcacccctccttcagcctcggcccagggggtgtgggtgcctgaccgggtgggagggtagttgctgctgcagtgggagcrtgggttctcccggcagcccagcagccccagcccagcagccccagcccagcattctgccgggtcggagtcatgtgaggaactccccctgggagctcctggcrgatccccgtggcctggagacctgatgcatcccaaacttcggtgtcactggacagctccatttccctgagcagcagatccaggcctggcctcttggtcactgagcctggggcctcacagtgagggtgggaggtgcgtcccgggctgggacaatggagcacttgggccctggctcatggggagaaccccacccgccgtgtgccgagctccacctctcactcctctctcagggccccgacggttacccgggggaagcagggagtccaggggagcgaggagaccaaggcggcaaggtaagtggccttgtcagggtayggggcaggcrgggtcaccagcttccaggggcctcctggaggcagccccagctgagaagctgagcagagaggrcctttctggaaacactggtcagtgaggagccaatggccgtgggatgtggtggagggtgccctgcccgttgcttcatcagcttctaaccagggcttgggcggccccrccgctgctcaccgaggcctcrgcaacaaacccacctcctcccaggtggagccccagggagccccacccacacctcctggagctccccatgggaacgttggtgccccaggggctctgccctcctgggccgcctgcagtgtcgccccgcccctggcggccccaggatccccaagggcttttttctgggagcttggacttarggcttcccactttctgtccaccttccctcagcccaagcccaagtctggctgagtcctctgwgcagatgcacaggyrtcctgcccgtgacacacactctgccctcagctggcacggaggttccagcagcccccagccagcatctggcatcccaggtgccccgtggacatcagggaggtgcagtcccaagcccgaccgtgggtcctgcccccgcagcgggcatcstgcaccccccttcccctgccaaaagacgtgaggctgattctgcaaacccttccagggggaccctggccgcccaggacgcagagggcccccgggagaaatcggggccaagggaagcaaggtgagcccctctgcctcttcgcctgcagctgagctggccacactcacgcccatggcccagatgaacagtcacgctggccaccatctctgctgtcaccatgktgccgcattgggctctggggacacggggagggacaggaagaacaggccatgtgccctgagccaccagcccctctgacctgtgccctcctcacgaggctgaacaagttccaggggaccctgcagggcccccatgtgcctggcaagcagattccgctggaagataataggggctccacaccacacaccgcacaggcgtgaccatgcctcagggcccctgcctctgggtgactgtgctgtcctctccttcttcaggggtatcaaggcaacartggagccccaggaagtcctggtgtgaaaggagccaagggcgggcctgggccccgyggacccaaaggcgagccggtgagtccctcctgcccctgcctcagggcccygctctgggcatcctccttgcagcttgaggaggaccatgggggaagggcacctgggctgtaggcaggatcccctgctggcaaggcacagccaggcccccatcctcccaagaagtggacccggaccaccccacgggaccccccagagctggacttagaggtaaagcccaggcaggtcctccatggtgttccctaaacccagcaccagctgcccagggcatcctgtgagggctgagcagggcccgtcccagtgctgaccactccaaggggactctgtctgagcatggggcctgcctgggagtgaccgcagtgactggacagcaccaggtccccaccaggccccagcccatcacctaaaacgccactcaccagacatccaactccacctggagcctccccagatcattcctaaatcctcggcatgggcgggaccgacgcagcagagggacgagggctggcagcagagccacyggcgcaggctgaggctgttgggaaggagcctggggatcgaggtcccaggtcccaaagccagagccctcctgtagagaaggagcatcggccccggcacagcccccaccctccacaggctctgggcttggactcagccccctccctcacccacacgcctgttctctgcaggggcgcaggggagaccccggcaccaagggcagcccaggcagcgatggccccaagggggagaaggtgagtcctcgtgtggaggcagcccrgggtctcactgtggtgcccatgggccctgctgacgagggccccaaccccattcctcccagagaacaacagaaccccagggcctcactctccagmgttcactctctgcagagtctgggaatgcagccctgagatccccacaccccattctctgctgaggaagctccactacccacccaggcacaccccgcacagctgtgcaggcaccattcacccccggcccactgaggcaccrctcacaccccccggcccccactgaggtaycgctcaccccccagcccccactaggcaccgctcacacccccgctacacctctyacccccagcccactgaggcattgctcacccacgtgacctcaggggtgatgctgaagggctgtgtggtaaaaccccggccaccagctccccttgacatcaggtgaaggggcttcctcccaggaagtggaygaggtcctacccaygtgtgggtggcctcagggggaccgagagacmccgtgctcagagcggcagctacaggcacygggaaggagctatgggtgaaacaggcgactgttgcaggtcccccgggacagacggggttcttcctcccaggcccccttccccaacccccggccacacccgcctctcacatgggacccaggccggaggcctcagctgagacccgtggggcctcccttccctycccacagggggaccctggccctgaggggccccgcggcctggctggagaggttggcaacaaaggagccaaggtaggggagcagggtgggccgcaccccaaggtaggggatctgagggggtgcaggggggctgcaccccaaggtagggtggccrggactgcaccccaaggtaggggacccgggtgggtgctgcaccccaaggtaaggggggcccaggtgagggctatacctcaaggtaggggacccaggcgggtgctgcaccccaaggtaagggaccaaggcaagggctgcaccccaaagtagggracccaggtgagggctgcaacccaagatagggktgcttaggcaggggctacacccagaacccagcctactccactcagtgtgctcagggctgaaggtcaagtggagccacagcctccsgggagggtcataggggccggggccagaccygtcttacccccgaggccctgcagtgtccacaggattgatactggggactccagggtgctgctgtcagtcaagagaaccccaaattcctcccctttcttccagggagaccgaggcttgcctggacccagaggcccccagggagctcttggggagcccggaaagcaggtcagtgtcagtgcaggaggccggtgccctctgaccccacgggtgggtctcccctatccatgtggggacagcctggagctagccactgtccccatagcaaacccaggcagcagagcctggcctcagaagccaggacctgctcccctagaccccgagtacctcatacccaccctcagccccagccccccatcctgccctgaaggacccaggttgtggagtcaggggcaaggcagtgggcctgaggtcctggatgggycacagggaraggaggagctgggaccctcaagacagaggtccacggcccccacaggcagcaggaggagctgcggccatgtggcctggtggtcagggctggacggggcatgtcaggtgacccctgggcatggccagtccctgcctgtgctgacttctgaatttctctcctgccctcagggatctcrgggagaccccggtgatgcaggaccccgtggagactcaggacagccaggccccaaggtacgtgcccctcccccagcrggacgtattaggggttcggggcagctgcctgaggagcaggacagggggccggcctgggggaccctgttgccggcagacgtgcctcaggacgggcctgtgcctcctgttctcagctctggagtgaggggatgcctccggggtccaggaagcccccctggctctcctcttcagcagtgacccttgggtgtgcrtggcacatccttcctgaggcagggcctgagggcagctacgtggcctgagtagggtcctccccgcgtgtgggcaggcttcgggtctctaggcacgtccagcccccactggaggtggacagggcgaggttggccctgccaggcctctgctcacagccagaactcgacggcacccctagcccacttccaccccagtgtgcaccttgcgccctgttgagcacagccccccagccccaccccgtccyatgaccatgctgaccgactcaacgtcctcctccagggagaccccggcaggcctggattcagctacccaggaccccgaggagcacccgtgagtcacagcctgggatggcagctcccaggagtgggtggacattgtcccaagggccctgaagattcctagtagttccctcaaggcctcctctgtgcagaagaaagtgtgaggtccctcctgcgggacagagtggtgagaaggcttygggtgactcagtgaaggataggtccagcccagcatcaggaaaagagcacagctcagaacgcagcacagtggcctcacccagagtgtgaatgagcgagggagggaaacggggctgcagaaagctgcccagagggaggaaggagcactgggatctgaggytgagtcaccctggcttctgtttgcttcacagggagaaaaaggcgagcccggcccacgcggccccgaggtatgtgtgggtcctggccacctgtgcccacccagggtgggggtctgcacgcccaattgctgggaacacaatgcccaccgtcactgacaggaccacccctgtcttgagatggtcctggctccccaaggcccagccatgtcacctatgctgagctctgggggagctgtcagccactggctgrtccctttycaaccaaagttcaggctttgccaaaaaaaccacatagatgctcccgtttaaaggaccccaaaatgccagatcgatttttccacataaaaatctcactggtgtccctggtagagacagctcctctgtcccaggctaacatgtgttcyctgtcacagggaggccgaggcgactttggcttgaaaggagaacctgggaggaaaggagagaaaggagagcctgtgagtgtcrccgtcccgaagcccacagcagctgggcagaggcagggaggggccctgaggctgagcgtgtgcatctatgagtacaggagaacgccaggcagcttggccccagccatgagcaccacccccaccttcctaaagggaacggctggctcaggggccccctccctcaacccagcctcccttccagcgtcccctccccagtgaccccccaacatcccccccacagcatcccccacaagggtcccctccctagtgacccctccacaacatccccccagagtcccctcccagcatccccactacagcatcccccaccagggtcccctccccagcgaccccaacatagcatcccctccagagtcccctcccccaaaagatgcctccacatagcatccccctcagagttcctacacacagcattccccaagggtyccctccccaatgtcctccccacagttatcccccagaaggtgctctgtgcctccaaatccctagcctggccaagggtttaaccagggctgcaggttggtctggaactgagcacaaaacaagggatggataacgatggatggatgggcaagtggatgggggtgggcaaatggatggatgggaggatgggtgatggatggatgagtgaatagaagagtgggtggatagaagatggatgaatggatggattgctggatgagtgggtgggtggatggataagtggatacatgggtgaatgagtagatgtatgggtgagtaggtgggtrggtgggtagatggatgggtgggtgggcgagtgtgtggttagatgatggatggctgaatggatgagtggggggatggatgggtgagtgggtgtatgtatggatgggttagtgggtgggtggatgaatggatgggtgcataaaggatggatggatgaatgagttagtgggttggcagatggatggatgggtgagtcagtggatagatggatgggtgggtggatagaggatggatggttgggtaggtgatgggtggatgagtggatagatgggtatgtgagtgagtggggggatgggtaggtgggtggatggatggttaggtgaatgagtggatggacagacggacagtgggtggatggatgagtgaacggatggaccgatggatgaatgggtgggtgggtagaggatggacggacaggtgagtgggtgggtggatggatagatgggtaagtgagtggatagatagatgggtgggtggacagaggatgggtggatgaatggatgggttagtgggtggctgggtggatggatgatggatgggtgactgggtggatggatggatgggttagtgggtggctgggtggatagatggatgggtgattgggcgaatgggcgaatgggtggatgggtgggcgtggagttggtgggtacatgataatggggtggaatacccatggattggaatgagctgttttggctgcyatttctgggacacccagctctgccaggcccctacccctctggtgggccaggctctgacggtggccactcatggcctttcyagctctggtgccrgcatagggaaggaggaggcacagccttgtcttactccttgcacctgttagcyccccccccgccaagggaggacccgtggttggggacagcacagggggccctgctgtgtgcagggactgtccctgkggccactgaagcscacctgttcttgttccttctcaggcggatcctggtccccctggtgagccaggccctcgggggccaagaggagtcccaggacccgaggtaggttggtggccagtccccatgccctccccccracctgccaggccaacacacacccaagcctcgtggttctgcccacrgtggacccacgtatcagtgrgcagtggcctgggagagactcagccacccagccttggccccrgagtctcagcctcatccttccttccccagggtgagcccggcccccctggagaccccggtctcacggtargtgtcacatggggcagaaccagtgtccttctcctgccaaaactagacaccaagagcagcaggggtgggggaaggtcagctggcacggtcagagagcaagatcagtggaggaggtcagagggcaaggtcagagagcaagcttggttggggaaggtcacagggcaaggttggtggggggaggagrgtggcagcgaggttggtagggacaggacccgccagcctccccgcatggctgcctccacacgtgggctggaatgtcccgggacccccaggccaggaccttgctgtggaaactcttctggggccccggggggactrccctgcctgccgtgtgcattgcaggagtgtgacgtcatgacctacgtgagggagacctgcgggtgctgcggtgaggcactgcccacggcagggtcggggcccatgcaccgggtggagggcgggagtgcagcarggctgggtcatcgctgggtccygcatgtgcacgtgaccctagggtctgaggtctcccyggtaccccccgatgaccctgccacccccccagactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacaggtcagcggggcaggggcgggtgcagcattgcggggggccgggcggggcgtgggaggcgatgagatgggagaagtccagacgcgtccctccaacgagggcctctgcatggctggggatgccccagaccccgaggcctctggcaacsacctcacgcgtgcggcttgcagggacgcgtgtgggcgtggtgcagtacagccacgagggcacctttgaggccatccagctggacgacgaacrtatcgactccctgtcgagcttcaaggaggctgtcaagaacctcgagtggattgcrggyggcacctggacaccctcagccctcaagtttgcctacgaccgcctcatcaaggagagccggcgscaraagacacgtgtgtttgcggtrgtcatcacggacgggcgccacgaccctcgggacgaygacctcaacttgcgggcgctgtgcgaycgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccgggtgagcgtgtgggcgcggggcagtcggccgaggagcagcaggccccagcygctgyctagcgtgagccccagggacacccctcacctgagggaygaatgtgcagcccaggatmttgggctgtgggtgggaaggggtcgggccctctcggggctgcagggcagaggccagctgcaccctgagcctgtctaggcagatcagtgaacggccgctgagggttcgctagrgactgaccctggcctggcccggcctctctcctctcttccagaccctcagatcgtgtgcccagaccttccctgccaaacaggtaatgcagggcaccctgagccaccaccccagactagcaaagcagccctggtgtccttcctcctcgagggccgggctgggggaggggccgtgcagggacccggggggcggcggagccactgcggaggctgctccttagggagatggccccaggatggcagcacaggggaggaggggcttggggaaggcaggctcccaggaacgcaggaacagcatcacgaggccatgaggtgggtgctgctagcctggcgctgtgctcggcatgtggccactggtcttgaaggcccaccatgggccttgcagtctccctcagctgccgcccagctcccatgggctggccgtgcatgtgccactcggaggaagccctggattcagkgagtgaaaccatcccggggtggaagcactgacaccccccagcaccagcaggtcttgctccaaccctggcctgcctcggagctgcagctgcggctctcatctctgggagtgggggagcccatgtcccggatgtggcccacgtgggtgtgaagctggagctgggggtgccgtccaggctctgctggacgtggtgctgcccccatggtgcactgctgcaccgtacctgggcccacaggaggtccccgggggcgttakgagctgagtccccctcagtgagccgtcccctccaggagtgtgagggtrgggatgccatggagacagggtgggagggtccgacctggaggaccacagggaggaaacctcagggtctgcggtacgaagtcagcgcttcctcagcacgcgggtcgcggtgtgcgttcgggcgttccatggggagctcccggtgggtgagctgggccactgagcacattcacaggccctgaggctgccccaggggaggarccgtggactcagagccgaggttccccatacgtgctgcgacagagaacctagggcttgcacctgggtctggctgcccttcagcaggcgggcagcctctggccccacaacagtgggctgtgcttctgccgccaaggtgcaggcgtcctcccccagggtccacatcagcagcaggggcacctggaccctgagggcaggaaccagaccttggctcctccacccaccccctcgttcctgatggggcagggaagtctcgggaccccatgatgggcgacatggcgatggtcactgtgggtgctttgctatcaggtggggggccttcctctccactcygggtccagtgtgagtggccgctatggcttcccctccactccaggttctatcgtgagtgggtgggtgctgcgtctgtggatgtcacgtgacctttcctctttagcctatcatygtagttgggagttagttagcccgttgagcgtcattgaatttccagtgttgagccagccctgcgtgcccgggataaacccacctsgccgtggtgtgtggccctgtttatgcacgtgggccctgattcgctgatgcctgcctgagggtttgcgcttatcggcgacatcagcctgcacttttcttttctcgtgatctctctggttctggcctcagggtgacgtgggcctcgtagggtccygtggtggctcctccccagacggtgacatggagtgagcccattctccctcctgggagtgggtcactcaggccaccagagcaccacagggaaagcagccagggaggacacggaggcccttgaagctctggcctcttctgaggcctccaggacctgacagtgagtgggagcagccctggcagaacccctcccctcctctcggccgccctgacacctcatccccgacactcagagctcatcctccttcccagctgtttccaatttcaaagtgaactcgaccttgtggctccaggagatgcagcagggacagtgttaaatcggctttcaccagcccacacrgccaggcatcctcctcggccctcctgggcactgggtggacaccactggctgtggcctggccctggcctggccctggccttctccagacagccctgtccaccccaaagcccagccaccctgggcctgcagcaggcctgtggagttctcagttgcrtggggaccagagggtgctggagaaacaaaccagacgcagctgaaggcagtcagggcagggcgcamtcagcgataagagctgcataggggccacagcgtaacctgagctccagtcggtgkaaagaaaaggcagagacgttgcagaggccaggtctgctcaggggaagacagttctgggtgtagaggactcacatcccagagaggctgaggaagggtttaccaccgcaagctttctcaggcgggctcttgaggggtggctggggtcttcctggcgacgggcctgcggcactggaagccctactggagtttggcctgtctccggcacaggtttggacrgagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcsgggtcagcggggctacrgtccttccaggggctctggggcagctcccagcctcttcccaygctggtggccaccgtgtcccttgctgcggctgcatcttccagtytctcctccgtcttccwgtggccgctctctttataagaaccctggtcattgaatttaaggcccaccccaagtccagaatgacctcgcaagacccttaactcactcccgtctgcagagtccttctttgctgcatcaggtcaccctcacaggctccagggtttgggtgtggaagtctttggaggcccttacttagcggcccagctgggctgccgtgcgtctgggatggggctgagggagggtgctgcccaggtgctggaggatgttccagcaccaggttccagcggagcctcggaaacaggccccagaggctggtgagcctcgctgggtgtgggcactaatcccgtgcatggtgactcgtgggcgctcacggcccacctggtggcaggtgaaggcttccggttgggcagcagatagtcctgggggaagctggcagtcctggcaccatgacgtatctgggctggtgtcatgcacagtagggcgaatggccacagctgcctgccagcagccctgatcccggggtgtctgcacccttccagcccaacctctgggtctccaaaagcacagtcgggggagcatccaccaggcacaacctctgcggtcctcagaggactgagcagagaatcccagggtccacaatgttggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgttkggtgacagcagtgaaaatgttattagttttgagggggtttgggaagcccagcggtacctgaggagtttctggacatttaagccggttcctaggtgtggccttaacagggaggctgcccttcctttcactgaatragctgcgtcactcataagctcactgagggaaccccatctgccagctcgtgygtgctcagacgrcgtccatgtctcaagcgttctgtgaaggctgyggtgcagcgtgaggtcaccctgctgtgttcagagctttgctcactgcctgcggggctggaccrttgcacctccagggccccsagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacrtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgagcagctctgggacccagcgattgaggggtcaggctgggggtgtcagagccagggtcctccttaagtacctcccacactacacagacagtggcccttttgtgggcagcaaattcttgagccatgaaaggatgctttgggccccttccctcccaggagggcagcctgtgcagggatggtgctcagcaggtggacagggcctggggcctgtgtcagggtctcaggcctgggagcaccagcagaggagayggcggctcccagcagtgccgcctgaaagtgtyttgggctaaggacccacacccagggctgccctgcagaaacgcccccgcagagcccagtggtctgtgaggttgcaggcagggtgcgaatggaagggcacaggtgcggggctggcacctgcccggtcctgcccacctcycctccgcccagcccgcacctgcgtctccccacagagctgtccgtggcacagtgcacgcagcggcccgtggacatcgtcttcctgctggacggctccgagcggctgggtgagcagaacttccacaaggcccggcgcttcgtggagcaggtggcgcggcggctgacrctggcccrgagggacgacgaccctctcaacgcacgcgtggcgctgctgcagtttggtggccccggcgagcagcaggtggccttcccgctgagccacaacctcackgccatccacgaggcgctggagaccacrcaatacctgaactccttctcgcacgtgggcgcaggcgtggtgcacgccatcaatgccatcgtgcgcagcccgcgtggcrgggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgygccrccgtgttccacgagaaggactatgacagcctggcrcaacccrgcttcttcgaccgcttcmtccgctggatctgctagcgccgccgcccgggccccgcagtcgagggtcgtgagcccacccygtccatggtgckaagcrggccsgggtcccacacggccagcaccgctgctcactcggacgacgccctgggccygcrcctytccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccattgcgtgcctgcttgcgagcttctgtgcgcaggagagacctcaaaggtgtcttgtggccaggagggaaacactgcagctgtcgctcgcccaccagggtcaatggctcccccgggcccagccctgacctcctaggacatcaactgcaggtgctggctgaccccgcctgtgcagaccccacagccttgatcagcaaactctccctccagccccagccaggcccaaagtgctctaagaagtgtcaccatggctgagggtcttctgtgggtggacgcatgattaacactagacggggagacagcaggtgctgagcctgttgtgttctgtgtggagatctcagtgagtttttgctgttcagaccccagggtccttcaggctcagctcaggagccccacagtgaaccagaggctccacaggcaggtgctgacctgacaggagtgggcttggtggccatcacagggcaccacagacacagcttgaacaactaccagtatcggccacaggcctggaggcatcagccgggccatgcttcctctggagggctagaggaggactagagaagggcctgccccggcctctccccagcatcccagggttcctgatctcctggataaggatacaagtcaccacactggactggggctcagcctgctctagaatacctcacctaagtcacastggaccaggctcagcctgctctaaggtgagcttacccgagacactggaccagagatcagcctatcctgggataagctcacccgagtcacactggaccagggctcagcctattccgggatgagctcacccgagtcacactggaccagggctcagcctattcyrggatgagctcacccgagtcacactggaccagggmtcagcctattccgggatgagctcacccgagtcacactggaccagggctcagcctattccgggatgagctcacccgagtcacactggaccagggctcagcctattctaggatgagctcaccagagtcacagtggaccaaggctcagcctgctctaggatgacctcactggagtcacactggaccaggactcagcctattccaagataacctcacccaagtcacactggaccaagctcaccctgctccaggatgatctcacctgagctcactgcatctgcaaggaccccatttccaaacaaggtcacatccagaggtctggggcttagggttaggggttggggttggggttggggttggggttgggggtaggggtcaggagtcagggtcagatttagggtcagggtcagggtcagggtcaggtttagggtcagggtcaggtttagggtcagggtcagggtcagggtgagggtcaggtttagggtcagggtgagggtcaggtttagggtcagggtgagggtcaggtttagggtcagggtgagggtcaggtttagggtcagggtgagggtcaggtttagggtcagggtgagggtgagggtcaggtttagggtgagggtcaggtttagggtcagggtcagggtcagggtgagggtcagggtgagggtcaggtttagggtcagggtgagggtcagggtgagggtcaggtttagggtcagggtgagggtgagggtgagggtgagggtcaggtttagggtgagggtcagggtcaggagtcaacatgtgaaactggggaaatgcagttcactctggataccctgaaactttgttgtcctttgaaaagactcactcttttcttcatactccacygctctgtcatctgaccacacagcctgcagctccaggggagtacgtcagttattttctcttcctttcctccttttcccatcccacaaaaaaactacgcaaatgccagcaggagatgcagaagaggcccgcctgttttgctaagcccctgcgccctgagtgtcagccctcagatctctgtgctccaggtgaacaccgcgggtcccgcaggtggagggaggcagaggcccctgcaggtgcacaggctccacccacaggagctacacaggagctgcccagggcctctgcagggagagggcgctcccctctctygtgccagctcccacgtgtgcagcctcggaccctgcagggcaggaacgtcagtcccactggaagggacttccagctacctacaggctctacccacagctccacccagcaactgccgctcaccattggcccttcaccaattacaccacaccagcatcccctcaccagcatccctcacaaatgtcccctcatggtcccaacaccaatgtcccctcaaatgtcccctcatggtcccaacaccaatgtcccctcacaaatgtctcctccctcacggtcctaacatcaatgtcccctcacaaatgtcccctcatggtcctaacaccaatgtcccctcatggtcccaacaccagtgtcccctcacaaatgtccccttcattgtcccaacaccaatgtccccacacaaatgttccctcacggtcctaacaccaatgtcccctcacaatgtcccctcatggtcccaacaccaatgccccctcaccgtcccaacaccaatgtcccctcacaaatgtcccctcaccatccccaacaccaatgtcccctcaccaatgtcccctcccagccttccctcctgagtcccctccccagtctcccctcccagactcccctcccagcctcccctccccagcrttccctcccagcctcccctccccagcgttccctcccagcctcccctcccagcctcccctccccagcgttccctcccagcctcccctccccagcctcccctccccagcgttccctcccagcctcccctcccagcattccctcccagcattccctcccagtctcccctccccggcaccccctccctgtcaccccctgccggccggatatgtaggaacctttcatgctgagtgatgatggccctgtacccacacacaccttgggtgttttttctccctgtaggattcttgtcatttgtcttggatgatgacatcttttttcatgaacaagtatgttctattttcagaatgggaaatctctccaataaggcatttgagttttctgcttcactcaaggacacagtaatcttctttttaatatcctgcagtgctgactaacaaatacattcatacatcatctgtcacatgtaatagtccatctagaagtaatttgagagtatagtgatttgctaaattattttttaatggagaacttctctggagacaggaggctggctgggcagggagctgaggcagggaggaaaagtctcccaggagccactggttgaagggtggacgggaactgaggacagggccagtaccgtgctctgtggaactgtccagacctgccgggagctgcacctgggaagcgaggctatccttccagcgtcgaaggtcctgctgtccctggggtttctgtcccatgcacagaaccagggcccctttccctcagacaaggggcctcacagcccagggacctgcactgaaccccaggtcctctgaatacctgtgaccctgcccactgtgggctgcactgggtgtctggggaccctggcgctgaggtctgtctcctcacgctgcaaccccattccctccaaccctggctcccatgggccactgaccatatgtcctgctcctgccccaagacccgcagctcagctctcagccctgcccccaaaaccgccaacacacaacacaggtttggtgccaaaactttactggaggtcacatgggactaggggccttctgtccctgccagcgcctccattcccaggcgatgccccgctgcctgcccacctaycctccgggccccacaygaacaarctgtgtccccaccgaggtcacagctctgccctctggggatgggcgagggaggggccacagagcccrgagaggcctcccgcaccgtcactcctgccgggtctccaagcagtccagcaccagtgcagcctgggtcttggcttcctgcaggaggctggaaacacgatggtggatctgatggacacagggaaagaggggtctggtagttccagtcttcagcccagcttgctgggcagcaacctccgacccccactgcccacrgccagtcggcaatcaccctgaggctgtgaatccaggcccccacrtggggtccgggcaccacacctgcctcctgctcacctggtccttaaatgcctcgtctgtgatgtccctcaggttgatgagcacgttgaaatatgcgccaaacacrcccatctccarggctttggccgccacctgcaaggaccccagggagcccctacatggatcaaggctgagcaaactgccggaaggagggtctctgcctgacgggctctgggacaggccggacttcgtcctcctcctcacaaggagcccagcgcagcccccgctttcgccccacagagggctaagccccaccaytgagcttagaaaacaaaactttctcttatccaagcagggctcagccccacaggargcctgggagcagtcacactggaggctctccgccactctaggaaccaggaccacagttctagagacagtcatcccctggagggcccccggaggcagcttcaggctaacggcccgcccactgcccagggacacttcccagggactgaggggacacttctctgggaccagatgctgaaaagaggcgtctttcctataaagaacccgaagaccatgaggtcttagggcagctgcagaaagtgctgagcccatgagagagacgctccttctctgggaccctctgcccagctgtggccygtcagtgtgaggcatctacttccaagagctgccttgtgtgctttctcgtgttttgttgtttttgacccagggtcttgctctgtcaccaaggctggagcgcagtggtgtgatcacrgctcactgcagccttgacctcctgtgctcaagcaattctcctgcctcagcctcccaagtagctgggaccacaggcaccaccgtgcctggctcatatgtatctattgtacagccagggtcccactatgttgcccaggctggtctcgacctcctctattcaagtgatcctcccgcctcagcctcccaaagtgctgggaccacaggcgagaaccattgtgcctgggctgacataggtgttttctagaacaagacagtgggggtgatacaaggggtcttgggggagtatacacttatacagtggtcagggtgggctctgcagacacatttgggtctccgtctgtggtgccgccrtgagcgagatcttagaaggcagcggacaccccggccctgttggaggaggccaaagccccgggaactgcccgtgaagtgaggtctccctacctggctcagcccagccaaccaccgtgctctccagcaactcagccccaacagctgcttcctgctttgcggcaggaggcctggggtcccccgggcccccctacctggaggtctgaccggcaggccaggttcccacacygggccagttcctgcagsgccggccacagcgaggccaccgtctccrccagcgtcagcggcacagagactgcccgcctcagaccctcctgtagggccrccgtgcgcctgaaaggagcaagaggagagcctgrgcrcrgcggcacacacaggcaggcagtggacacactgcaccccaacagggctgagcaggctgcagaagcgggcgatgggaagtcattcccaaacacccagcacgcccaggccaaccacgccccgtcacagcacccaggtactcgggatcctggccaccaactccccagacacagaggcccacggtgcggccggccctccaggctcacctgtccttttcctcaggtgtgttcttggggagcctcattgcttcctgccataaagagacagaaccactgggcgagggaccgtagggggagcagccatgccctctgagctcccacaaggggctgtagcaaggagcatgtcccaggcagggaccagttctctgggaaccaagcttctgttgggccagtggtttatagcccttagcatcaggcttggtggaggag

SEQ ID NO: 13357 - DNA, 54767 bp, Homo sapiens
tccctggggctggagctatgggctgagccataggagagccagcccagctccctgggggttgggggctgtgtctctccatcccttagtaaaaatacagcaactcccaactcaaagtcaagggtcaatagtcacaaaaccttggtgcagcctggaacaggcatagaggtctcagcagagctgcccaaggacaagacctaagatccagcagggaactatgtagtcaccccgagaggcccagctctctccgtgagctctgggcctagggtgggggtggttgttggttctgcgcgcactgttccccctacatgatgggtccatcccagttggcttctctcactcgcttcctcctgtggagaagcctgtccaggtgtcactgcctccaggaagctgtctctgatttctccagttgaacagtgagatttgccacacctcacatgcatcgctcttgtccctggaattgtaaccataggttttcctgtctcctggaggacaaggatgagggctttccacttgagtctccctggtggagcccagctcctgacatacctggtaaaagttctcaagagaagaacatggaggaggaatgtggataacaaccctggctgcctgtgtgttccaagctaggaagatgtaatgtccccacaaacggggtaaatggcttgcctgcgtcacagctgtctcaagcccaggccctgggygccagcccaagcccaaggactaggtccagagccacacagcgccaggccacatccgcctcacctgggaccytttgtggggtacagtctccggccccacccagacctsctgaaggagagaccccatggcaaggactcagccacctgcagtttcataagcccccagtgggttcctaggcatgaagaccaccggttagaggctgaactggcaggaacctgtctccagccccttctcaccccagccgggccctgcctcagaggcagcacccaggacgtggccatgacccgtggactccactcaatccctcttctccaggagccatgcaaagtgtcagccagccaggcccctggaaggcagtcatcacctcttaaggcattgygggtrtcggtcctgcaactgccaggtgcagcacacgaccyrtgtccggtgttcgatagcagggagccatgacctggcaacgattccacgctcaaaggggcacccggggggccctgggtcggggcggatcagctttccctgggcacatctgcctcattccagatctccagggctcatgtctgtgacagggagggaaggctctgccctggccttccgtcagctctgccagtgcaggctgggcagcctgggctttagagctggcttctgcccacactttctccgtgaaaggaaaacaactatgagtctgccaaacgcatctcagatgcgttttaaaaaattctggtccccgctctctgtcccatcatcygcctcggggacttcctctctccgtggttctcaccccatactctgtcactgccacattttcacctgggcctggcctttgtctccacctgaaactcctgaaaatcttgaaatggatttctaggtcactggggactccggcagcacattcggcttcagaataaagggcgcccgcggtcccccagcacctscccaagccacacccctagcttccctccctatccctgcagcctgagggtcccttcagccacccytaagtccccacctgggctcctgccccgcccctggctagcagcgccttctccaccggggcccctctgctcacagagccccctcacctccctggggatgaggggccaggccatgaccctgaaagcctagccctggccttgacctcccaggagcgccctccccgccctctcccggccccggccycgtcctctgctgctggcctctgggtcgtgccccgcagactgagctgcgcttgggggtcctggcggcctgggccgtcccgcaccgaacccaggcggtcggagcccggcggggaggcgcgaggtccttctgggggctcctccgacgcctgagggcgctgcttccccgcggscgccccgggtttctgcggagccggggcctccgctctcgggwgacccggtgagacccccggggaggccgctggggaggcgcgggctctgctcccgggtcccaaaygcaccggctgcccctcaggagggacggcgacctccacccacggcgctggcgcccgcacggccgctcctcccgctcccgcagcctggacgcctcccgaggccgccccgccgggccccacgcgcggccccatccgcaggccaggactgccttcccggagctggcggcccccagcctggaggagccggccccagacgccctcccagccctccccagcccactctggccccgcagcccccgcctggtccgagtgcgggtctctggccccggcctttcccggggaaggaaagctcccttcacgcgccccagggaggcggccaggctcggagcgtggaatccctgcccgccgcggaccgcaggttttgggcaagctctggccttcctgagcctcagtttccccatctctataatggggacggcaggggtttttctgaggacccccaggaaaagctccaggaagcgcctactcacagcgcgtgctcagtggtggccccggagctggcagggagcaaacgcaacggaatacggccggggtcgggcggtgggggtctgggtcggggtcagggtgggggtcggatcgtggtgtccgcggcgggggaggctccgcgcaccggctgagcagctccggacagcgggtgagggaaggcggcttcctcctgcttcgagacccatcctcgtgcccaggggagcgcctcagggaaggaggagccacgttccagggcacctggmtgggacctgccgcagcctctgcgcgcagcgggctccatcccccgggccacggattgggagactgaggcaggcgcgaagcccgccgcccagcctccgctagggagaccccggccacctccaggcagttttcctgaagcccggggccaggagaaggtgagcggctgcccgtcgggggtcgcctgcgccgggtggatgcggcggcacttgggtgcggtgggctcccaacctcactgtccgaccaaaggatcgccccggctgggcggggacctggcgcgcmtaggccgggaggggacagctggtttcgggcggcctctgccccagtgacctgtagactttggctttggttcagggacgtctggggttaaaaatgatcgtttgggttcccgcagtactgttcgcggtctgagcatctccacaacgcgcacattcccataatgaatttccgagaaccggcacgcgtgcctcccctcttggctcctgggactgcgaggccggatccaatctgtgcgcctctgtgcgcagggacggctgatggcccggttccgcctgtccgtgccccaggatgctacaggaagctcagatgcaaactctttggggctgtgagttcccgcattgggaaactcttgcaataaaaataatcgtgctgtaatccccagggaccattgagaggaagtggtgagggcgggggaggcgcgggaggaagaggctgggggctgaggtgtgctggggtgggtaggagaccggctgmgcccagcacggagccgcttcctggtagccctggcggcatcacccttgggtcgggttccagagcccgggggtcctttcagctttccgttccttttccttatacttcgtccctctctccagctrgagaggggcaggctctggggtctgggtacttttgttttggagccatttaacttgagttataataacatgcttttctgattataaaattaatgcatggctaccataaacaatttggaaaagacagaaaacaagttaacacgttaaaatctcaatcctgtctggtgaggactgcagtgaagcccagctggccaccccttccggggcctctgttctccccagggccttgcagcctytctgggcttggcattgctatggctaaagtgtgaaaggktcatgcaaggctgtcagccctgcgtcccccacgtgtgactgcatggggtcccacccaaatcggagtaatatacccactcagcctcacccctgctctgctggccccagggaggaaatgctcatcattgcatccgcccaccccacccctgcagtgccacattcaccagcctcgctgggcatcttccccctccccgccctctgcccctgscgcattcaccagcctcactgggcatattctgccctccccgcccctgcggtggcatattcaccagccccgctgggcatgtcccccaccctgcccctgcagtgccacattcaccagcctcgctgggcatgttcccccaccctgtcttctgcccctgcctcattcaccagcttcactgcccctagccttccctcactcagcagcctctgggccccagtccccactgccactccgtgttcccaggctctgcactcccaacccttcatctgctcatccctgggaggcagacctgtcacctcatttacaaatggaaaaaggtgcctttcaggaactgacctgaggctgtgcagccccctgcctagcaggtgcctagcggttgctgctgtttctatcagaaagaaaaactaacagggggagggaggggggagggctgccctccagccttcaggggcttcctgggtggagggggccrgacctktctggtcaggtccctctgggttgagaggtcatctccgggmcaggactcagaactggaagagggaggggcagcgaggaaaggtccctgcctggcggtgctgccttccatgggggcctkgtggggcagaggctggaacacccacttggggtttctggtgggaactggggagcwgggtggggagcctgagtcccctcagrrgaggagtcattttgaaactggagggagaggctaaaagaggaggctgtggagagacctagtgttgaccagggtccagcgtcagtgtttaggttctctagctcttccccacctccaatgtcctccatgtccgcaccattcccacgtgcctgtgtcccaccycttctcccacacactgtccccactccccatgccccattcctctccagagaatcactggtctagaatagagacctacaaacttgggcccttaggctggccctccacctgtttytgtcaataaagttttattggaacacagtcatactcattcactttcagaaggtctatggtcactctgcagccacaatggcagagctgagtagtcrcggcagagaccatttggccagcaaagcctaaaacacatactgtctgcaggggcttcctgggtggagggggggtgaaccttcctggtcagatccctctgggttgagagctcttccccctccagggaagagcttgcccacctccgcatcgcagctcacttttacggagcactttctctctgttctgtgccacccgagcccatatccaggcccagtgagctctgcacattggtcatcccctcactgcagggggaggcccagataccacccacaggacacatttgtgtgtgaagtgccacactagggcccagaagggacagctccccaccaggtagggacaaagcaggggtaaagggaacacatgggccggcctatgagctggacccttcaggatgggaaatgcgtgggccgggttgcagagggggttggtgaggggctcggggacaacacaggtgtgttcagagacarggcgggtcattagatttgatggaggcttggggtccctgagcttaggaagcccccatggaaaccaagtcacaggcatccagggtgaggaaggctgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcwgcccacaggcatccagggtgaggaaggcagcccacacttttcttggagacacatccccaaagamgtcctcacgtggctccgtttgggcagaaaccatgaattgaacgggaaaagaaatatgtcaagtatcagaaagaagagtggcatgctttgacagcaagtggactccgagtccagggcagagcctcagttagggtaagaggcacccacccgacccaacccgacccgacccgacccgaccctcgggagccctgctctctggtcagttggccttcatgggggtggggaggtgggtggaggaatgaggtttagtggtctgcgaaggtggcagatcttgttttggtagatgagggcattatctcccactgccccaccacattcgagctgctttcagtcggcgtggtgcttttgctctctctgaccatgcaattgtcgttcactgctgggccatgtggacggactggaattacagtttcttcttctccggttttccccctggagtccatcgttgcttaactgttttcctcgttccatctcctttgaacattgagcatcttcccacccccagggggcctggaagacttcccagcataactccccaccyagccaaggctaccggtcagtctgtccctggacagggggtgacaggtgagcctgtctggcagcccttgccaggggctgtgaaatcttcctttgggtsagtcagggaagcaagaatgccacctcctcagctctctccctcaaggaggagccacaccacgcagaggaaggcagaggagggaggaactgtgctcccagtgtgggaagctgcgtcggggggttgggggggcacaggcccacccaggccacagggggatggaggctgcccccagcttctcgcagccctccctccttcctacactcacctgccttccccggggcagatctccatttctgcattgcacccagcctggtggcctgggaccagccctgatggtcagcctgtttgtatggatctgtgggggatcccatgagaaagagctcgttggagcaccccacctggggcacccaactccatttcctgccccgagccctccccactcgcctccagggagtgtgtgtcacctcctcccctctgccagccctgcctgcagccctcttctccgcccccgccyctgcccccagcctgcaaaaggtctcacccgccttcaaagggagctgaatcaacactgcagaaggaagtcactggggggaagaagtgaaaaagaaaaaaaaaggcctacgtgggggcagggttgggaggagaccagagttgggttgcaggggaatttgcaggcaggttggagggtgggcgggagagggaagtgtggtgagtgactgggagggagcagcggttcccgggtggccccagggtcctcgtggrggtgctctccaggcagraagggactttctgccacttggacatctccctgtggggccagaccccaggggtctccagggctggttagactcctttctcatcccttatgaacctcactgacctgactcttcccttggtgctgccaaaatattgcagctccccaagcacctctgtgaagtgagcctggaaccacccyctccccactggccctctccatccttagcatctttcttgaccttcaaaccctgstcctatggggtctcctccgtggaaacttccagaatcccacctgtcacagagagacctccttcccaagctctggggttgtgtgttatgggggtggaagctgggcgaagggaagctggggggcccaggccagtgtccaggatgggagggcaggagagcagccctcaggctctgaatctccttccccatctatgctcaccggctgcccccgctgcctccacgtgtggacgctgggggtccctctcatctgccttgtgtcatggctgacatgcttgtctcctgaactcgatggtctgttctggagctcagggtcgggcagcctcagagcacgcaggtctgccaggcaagcacagggaaaggctcaaccaaccaacccctgatgacagcaggtagttttctggaatacataagtgaaagtgactgcaaatggaatttctgggctgactggagggaaaagattgttcccagaatcctgctccagtcctgctcactcacgcctggcytcagaacctagcttggtgattcagcagatgagaaaccctgagcagttgtacccagacatgcggccagtttcgcccrcctgactccctcggctcttagggacggactcctcagtcctagcttgggatcaacatctactctttcctgtggctgcttggctggagggccctgggaagcagcccggcgtggccccacggatgccggttgccggtgctgctacatttccttctgcggtcgccatttcctcatcaaagcaagagggcagggcagcaggcctcccggctccgtggagcctgtgatttttcactccgtgcagccacacctgatatttttacactaaacgcaccaattactcacttgtctccacaaagaaaaacgtgcacagcctctgacttccagccttgtgcaacaggcacatcagatgggggatagtaagatgagtgctgagtgagtccccggaatggaggtctgggtccccccatwgcaagktcacggctctgggaagccccacggtccctagcccctccccttcactccctccaccagcctttatttaattwattwattwatttatttatttattgtatatatattttttgagacggagtctcgctctgttgtccaggctggagtgcagtggcacgatcttggctcactgcaagctccgcctcccaggttcacaccattttcctgcctcagcctcccaagtagctgggactacaggcacccgccaccatgcccagctaattttatttttattgatttatttttgttgttgttgtatttttagtagagacgaggtttcaccatgttagccaggatggtctcgaactcctgacctcgtgatccacccgcctcggcctccaaaagtgctgggattacaggcgtgagcccccgcgcccggcctctaacagctgttttaatgctccgtgtgatcatttcagcattgggattatctcggagttggcatctattagttatcttttctcttacaagttctcaaggttttctttgttgctgtttgagtacttttgggttgtatcatggacattttgaatattatttaataagactctggattctactaaaatcctctggacaacaatgatctttttgttttgctagcagtcagtctggttagggttagaccacaagtccagacctgcctcttgtgggctgtggttctcatgtgagttcagtttttattttttcttttcttttyccttccttccttccttccttccttccttccttccttccttccttccttccttccttccytccctccctcccttccttcttcctttctttctttctgacaggatcttactctgtcacccaggctggagtgcagtggtgtgatcttggctcaccatagccttggcaacgtagcgagacctagtctctattaaaaaaagaaagaaagaaacaacagcaacaaaaagaaaatttacggaattgtgcaatcatcaccacaatctaatttcagagcatttccaccccctgaaagatccttctgctcatttgcagtcacttcctcctagctcctttaaaaaaaaaaaaaagatataaactattttaagaatacagaacagcatggagagcactagtaccaatccccaaacagctacctctcatcttaccaaatcttaacatgttgcctgacttgcccagaactttttcttcctttttagtaaagaaaactctacaatagaactttgaagccctctgcttccatctcccaggcccgtagccttctctgtcttcaggggtaaccactgtcctgcyctaggggtgtgtgggtctgcagggacgaggtgcatgttattcttcaatgcctccttctacattttgcttttcagaagaatctcagtgttacggatctgtgggtcacgaggcttcagagcagcacttcaagggctcttattcrttaccccgtagcgtgagtgtggcaccatggatgtatgygatctaggctatatttgggtccacttttcaggagtgctgttttttttctttcatgccatcctttggacagcatctaatttcattcaattgtgtccgtgaatttggcctccttatggtctttgtgctttagaatatgtggttatttcccttgtggtctagtaattatgtgtttatcattgtcccactttgtaacataattgtgtttaagttggagacgaatggtyacgttcctcaaattctctacctgccaaatttgcatttctatttgattttttcttgtttgtttgttgttgtttttgtttttgagtaagagtttccttctcatcacccaggctggaatgcagtggcacaatctcggctcactgcaacctctgcctcctaggtttgagtgattctcctgcctcagcctcccaagtagctgggattacaggcatgcgccaccatgcccagctaatttttgtatttttagtagagacagggttttgccatgttggccaggctggtcttgaactcctaacctcaggtgatccgctcacatcagcctcccaaagtgctgggattgcaggtgtgagccaccgcgactggcctgatgtgtttatttctgagagagatctgttagagatatttgctgtttggggctgtgtcagtttgcttatatatttgtcagtctttgttttatatattttgaagttcggcacacaaaggattatggctgctgaactgtctgtggattctgactctcattggctacatcttcctttgtccatttgatgcattttgctttgatttctatctttttgatgttacacgatatcttcgttagtattttctagcacatacgtgtattttccgtttctttattttcagccttcagtgttctcttttaacagtttatctgatagagagcctttcttacactttttactttttaattgtgataaaatatacataacataaattcaccattttaaccatttgaagttatgcatttccgtggcattaaggacacttagtactgtgcaaccatcaccaccaacttctccaaaaccatttcatcttgcaaaacgggaactttatacccgcgaaataataactttacacttccttgaaatgtttttttaatcttactacaaaaaatttcacacatctacagaagtagagagaatagattagtgaagccccatgtccccaacagtggcttcaaaaataatcaactcacaggtgatcttgttgtatcaacacctctcccgactctcccccaacccaacccacccctctttattgggaaataaatctgaaacattatactgcaccatctgcaaatatttcaacatgtaactctaaaagatggggactttttaacataaccacaaaccattgtcacacttaaaacaattaacaatgattttaaaatatggtccatgcattgcaattggttctattaagagattaaatctcttaatctaaagggtctctctcccttcgtctctcctcttgtactgtgctgtttgccttgtgagggtttcttcagcctggattttgctaattgcatccctacgatgtcatctaacacaccctcctgatgcttctttgtagatctaaaaagttcgacctgattcaggctcaatagtaacatttgttctttctatttttcttgatttctattgttatttcatcaagactaattcattaaaggtgtgtgcataacgtctgctgcgtccgtgacgttcgcagcgagggtcattgcttactttaagtcatcagcgggtgtagtagaatggtattctctttctgtccttcttcattattttctaggctaagtctgtaatgagaagatacccttgacagagaacatttcattggaacttgttttgtctctttatttctaaaacccaacgcaagaccttgttgatttaaaacaagaaaatgtaacccattcacaggtgctgtgattcctgatgggtttgaaattattcccaatgttttattgtttggtttttatttacctttcttgtttgttctattttcccttacttttttcttttaaaggatttgcctttttttttttttttttytctcagttacccagactggagtgcagtggtgtaagcatggttcaccgtagcctcaacctcttgggctcaagcaattctcccacctcagcctcccaagtagcctggaccatatcgcgtgctaccatgcctggcgaattcttagaaaatttttttgtagagatgagggtctgggtctccaaatgttgcctaggctggtctcgaactcctgggctcaagtgatcctcccacctcggcctcccaaagtgctgggattacaagtttgagccaccatgcccaaaataaagatttgtcatattttttttcaggtatatacatgctatttttattcttaaggagactcttgaattgttagcatatatacttagatattttctatcaaaatgcccactgacaagcatctatattcctccccagataggatggaacggcaatgtgctccctggcccctcccaacccagtcctctaggcgttttgtttcacagcrttaatattcttaccactattttttaaatcaacaggttatgacatcataatttttacttatttctttgcccaactttgtatcatctgctcttgtatttctcatggatttcttcatgtctatttctgcaagacatctttaaaacagagtttaggagccgggagccatggctcacgccagtaatcccagcactttggaaggcagaggtggatggatcacttgaagccaggagttcaagaccagcctggtcaacatagtgaaaccctgtctctactaagaatacaaaaattacccaggcgtggtggtacatgtgcctgtaatcccagctacttgggaggctgaggcaggagaattgcttgaacccgggaggcagaggttgcagtgagctgagatcacgccactgcactccagcctgggtgacaaaagcaaaactctgtctcaaaaaaaactgaaaacataaaaataaataaataaataaaacagagtttagggtagtaatgtgtctgagtccttgctctgaagatgtctgatttgggttttttttctaggtataatctctttccctcctcttcctcctcctcctcctctcccttctctctctctctgagcctgtagtattttccctttcgtgttctgtggtatcctcctaatgtccctagttaacaggacctcatccatccatccctggggtgttcagtggcctcgcaatccacgtccccgcccagatccgcagccttcctcctgtgacctgagtgtctcctcctcgctgtccctgttctgtcccctcccgccctcacatgcaggtggatgtcaatgcgtgcacgcacccaggttttcttgcytgttcccacctctttatcctccttggctggttcctccgctccattctctggctcrggaatttgctccccagggtttttcattccgctctgtagcagaatgtgctactgttgctttcyagcatcaaacttttcactcccatggcctctgtgttcttcttcctaatgggtgccctttctgcctggcgctcctggaggccgggcccctctcccaagtgtgaatctgatggaagcaggtccttctcgccgggacctcatgtgagaaatgacatgtcccacctgtctcaaggggccgctctctgacatcagagctgctgtagagcggagaggggcaggggtgaagggccacggtggtgcaacccaccacttcctccaaggaggagctgagaggaacaggaagtgtcaggacttyacgacccgcgccyccagctgaggtttctagacgtgacccagggcagactggtagcaaagcccccacgcccagccaggagcaccgccgaggactccagcacaccgagggtgagtgtgcagaggccccgctatgtccacggtgatttttggagggaagcactctcctgccccagcctggagtgaccctggtggccctgcttatrgycccggcccaggggtgtctggcaggaaggggtctccagaccgtctgctccagggtcccctttgagacccggcaaggggaagtgcctgccaccaagagcagagccacatggtgtgctgggagcgcttgyggctgaggatggggccggcatgggaggacaaggggctgtgaggccggcaaggccaggaagaggctgggcccacaagcccctagggggacggctggggggtcctggtgctccgggctgggcaggaggcaggttcccggggcctcctctgtgaacctgctgcgcctgcctgtgttaggccctcctgtctgcatgctgccccgcctggctacagcgattccatctccagatcgactcgcagtgtgtggtgtgtgatatggtgtggtgtggttcgtggtgtgtagtgtcgtgtgtgtagtgtggcatggtgtgcatgtatggtgcacgtgtgtggcatagcgtagtgtggtgtgtgtgtgtgcatgtatggtgtgcgagtgtgcgcatgtgatgtggggagtctgttgtatgtacatgtatggtgcacatgtgtartgtagtgtggtgtggtgtggcacatgctccatgctcctctgggaccctcgagcttccctgcctcctccgtggggacccctgggtgacgtcttgctgtaggggagcgggcaccgctgtgcgattctggtcgagttggttcagctggtgaccctggcctccccacaacaggctcctggaggccattcccaaggtcctggtgggagggggattgaagccaygcccctgggtcccaggcccacctggcccccttcccccaacactgcactcttggggccagccctccccatgcatcctccacccctggcaccaccccttgcaccaccgtccccacacccaatcccccctcccctggatctgggagctgggattctgccctgctgtccctgtccatccggggcccctctcctctgtcagttcctgggtggggagaaggaggggtggcatggctgcaatggggaagggggggkatggccggagagctcagcctgggagcragctgtgggggcataggggacactcgctgtcactcgccttccccgtgacggtggcgcaacgcctgcgggtttgggggctgaggccggattctggaggcttcacagaaatgagctgctagaagctctgggctgtctgccgtcaccccagcgyttcaccatgagtgaagcccagctcactgcagaatccatgcccagctcactgcagaatccccgggggccagcactttaccaagagtggcctccagactccacatttyaggaaggaactccttccccatccagctcacagcagaatccccagggtccctgccagcctggcacccagcgtgcccctcagtattctggggatgagtgggggagtccctctgctgggaagaggtccctggctacgtccctgcagggcggcggctgagcccatgcctcggccccagggccagtccccgccgggtgccatcctgagcagggccacagaacrgatgtcccacatggccaggacccctgtggccacctgaccccgggggggctgyggccctcggtgaagcaggtgaccgggcgggctgtggggtttgtcagctccgcagcgtcactgccgctcagcgtatgagtttccactcccagcactcaatgaacagctgagcaactgcaggtgcctccgagtgctgggagaggggaatgctcagctccgagtgctgggagaggggacgctcagctccgagtgctgggagaggggaygctyagccacccaagggcctttgcctcaagggagtaaataggggcatttcctggtgggcgtgggctgggctggagaagcagggcctcctggcaggggctggcatgagatccaaacactgcccaggcagctggacactcctgagcctggagcttctcacctgaaccacagggtggtaacccctgcccctcaggcggcatcgacrtgacctgcctagtgcacagtgagcctgaggcaacacggccaccaccaggagactccctggggaagaggcccccagacagcgaggtgcccatgaaggaagttctgcacaggggccgcggccatccaggagatgggaggggccctatctgcaccctgtctggaaggggcatggggtgagcaggctatttggtcccccgtgactcagtttccccatctgtgaaacaggaggggtggtctggccaattgtgygcactccagctgtctctatagtcaaccgtgtaacttgaactcacttccccagggctcctgccaggcccaggtctgtccactctggcccaggccgggccccaccaggtaccagggctgtgggacatttgcctctgtggatggggcagcgtgacgcctgtggcgattccatggaacaggtcctgtgtgggccccccttgctgcactcgtgtcctgtgtcagagaaccgtggtcctgcctgaggccatgtcaccggaggctggctcccgttcccggaggagaatgccagctgccacaggggtcagtgacacaggcatttgcccagcaggtacaggccaggtcgctgggaagccccaactcaaggggctctgcagtgggcgcctagcaattatggagctgtgggtgatacccaccccaagccggacctggtgccagcaattatccctcccattctgcttggcacaaactggcactgacacggggcattgattaggtggttgcatttgtcgattccgagcccatgtgtgtggagcccaggccctgagcaagcacagagggccctggtgctgtcctgagctgaggcccctgcccaccccgggctgcgtgttctctccggccattcagggtctgagagtgcagaagagttagccccaggggaacaccttcctgcccagctgatttgtaaacagcctcgctggggacacatgttggtgttgggagtggtggaggtttctgtgtgtgatggaaacttggggtaggtgttggggaaaagaggtgctgagagtctcagcagagggcagagtccaggagtcctggagtgcagctctcagcccctgcgccrtgcctagaggagaggctggcaagcccctgtcccatggatgggtgaatgggtgagtgacagtggcaacaagcccatgccagcagggaggtcccactgccatgaagcagcgtcctcatcaacgtcacagtgggaacaagaaagccagtagctttggaatccgaaggagcaatttcagcataattcgtcggccaccatgaaattccatttttaaaatgtcctttattcatttatcacaaaaagggtggaaaatacaaacaggaataatgaaaattgaraatactcatagtgccaccacccagagaaatgcagaatattttggaactgtgtctctctttttttccccataaattcacttttaccacgaagccaagctgccctgagcagctgtttgcatgttttcgttgctgtgtgggactccatagcgcaggcaccgaaaccgccaaagcatcttacacgttgacggctacacagggaatcaagatattttggctgaaatccctggttctttcctggggtgactcatatgtttcttagccagttttcttccttcttttgtgaattacctgctcagggtgccacacccttgaaacatccttgaatggagtatttacctttttgttattaatttctaagatctctttagagatgaagattaccatttaccttttgcactagagagataatagctatttcctctatgcaatttgttagtacaacatgtgccatttttagagtctgtcttcttgctattttcccccttagctttttttttttttttcttttgagacagtttcactcttgttgcccaggctggagtgcagaggtgagatctcagctcactgcaccctctgccwcccgggctcaagtgattctcctgcctcagcctcgcgagtagctgggattacaggcgcccgccaccaagcccagctaatttatgtatttttagtagagatggggtttcactatgttgctcaggctggtctcaaactcctgayctcaggtgatccgcctgcctcagcctcccaaagtgctgggattacaggcatgagccaccaygcccggcctccccttagcttttatgctgaggtttccttactcttagatacctattcttctatttcctttattgttttattccctaaaactgaagtcctacacatttgtggccattcttttatgtccacagcaagagtgtccggggcctcggcctcacgtcgccacccaggaacagacagtctccttcatgttagatggaggagtggtgtccccttgtctaaaatgctgtaaatatcatttgatttccctttgacttcaggtatttagcagagtactttagcattccttattaatatgtgtgtgtcgggggggtggggtgtctcattttatttcatttggccasaaattgtggcctttaaaatttgtgctatcaggccgggcgcagtggctcacgcctgtaatcccagcactttgggaggccgaggcrggcggatcacgaggtcaggagttcgagaccagcctggccaatatggtgaaactccatctctactaaaaatacaaaaattagctgggcctagtggtgtgcacctatagtcccagctactcaggaggctgaggcagaagaattkcttgaacatgggaggcggaggttgcagtgagccgagatctagccattgcactccagcctggatgacagagtgagactccatctcaaaaaaacaaacaaacaaacaaaactgtgctatcaaacttcacagatagtcaaaccaacagtaggaacacgtctccctgacccttgggaaaataygcttttgcagggtcgcaggttcagaggcgacatgggctgggttttcctgcatcctctctgctccgacttgttcctatttgatctgacctgtttttgtccctggatttcctggagcctctgtgatccaaggacagtgttccagtccccacctgacggcacttctctccagttctttatcacrttcctacaaagcagaaatgagtccatcttgatgctctggcttttggcttaaaaggtggatgcctagtttataatcatcccttgagccttcagttcccagcgcaggggttggctcccatgtcctcttccttccaaccttgtcccctggcggcatcgtccatcacttcccgcgcacctccragtcactttgatgcgagtgcctctcctctargacagcgcaaggtgggtttcagcacaggcaggaggaagctctgatgcaaagttccaatgggtctgcggggcctctggttcctcaagcrgtctcgtcttagggttttacggggttgcaaaaaggaagcctgagactgggcacggtggctcacgcctgtaatcccagcactttgggaggccgaggtgggcggatcatgaggtcaggagatcgagaccatcctgatcaacacgatgaaacctcgtctctactaaaaacacaaaaaaattagctgggcgtggtcgtgggagcctgtagtcccagctactcaggaagctgaggcaggagaatggcatgaacctgggaggcggagcttgcagtgagctgagatcgcgccactrcactccaggccggtgacagcgcaactccgtctcaaaaaaataaaaaggaagcctgaccccgctggattcctctcccagcataggctctgccctctctctgctgtcttgcttaaagtttcctttctttttcttttcttttttttttgagacagggcctcgttctgtcaactaggctggagttcagcagtgccattagggttcactgcagtctctccctcctgggcgcgagtgatcctcctgcctcagcctcctgagtaactgggactagagatgcatgccaccatgtctggctaatttattttctatttttattttttgtagaggtaggagtctcactgtgttgcccaggctgctctcaaactcctggcctcaagtgattctcctgccttggcctctcaaaacactgggattgcaggcgtcagccaccaggctggcctcttcctttcctgtgtttgctcctgttctcctgtcctcgacttctgtgaaagggtgtgtgtgatttggcccggatctgctgcagrtctcttctgacgccgctttcgtgtctcagagcctgaatgttcagagctttgctcaccgtgaagtgtggttcttgttagctgtgtccatttggtgcccgggagggaagggcgcccggcccctgaggggttctccggggaaggatgacctcgtccccctggtcctgccccctcagccccctgcttcccctgtgcaggggacttggtgacaggtaccacttcctgcagctgggctggggttgcaccagcacttccttctcgggcagggttgaggtcaagggcgactctgatgcaaggttctgagaggcctgtggggctgtggattcctaagcagcctcagctttgggttttgcaccttaggtcttggtaaggggacccgcccgcccttagatgggggawgtccagagctggaggatgaggagggcacccgcccctggtgtggggcagcagggagggccttggagratgaggagggcacctgcccccagtgtggggcagcagggagggcctcagggtgatcaggctccaggccagagctctggggccagctcaggggctggggtggggggtgtctgtgctcttcctcccctcctgccctgcagctctgccggcttagcctcagggcaccagaggtgacagtggccaggcacctgtttgcccgaatgctgccctmcatctgtgccttacccattcccatcccccagggagctggcacaggcccttcgaccacctccaggcacatggaggaaactgaggcagataggcctgatggggtcttggtctctcaggcctcaggtgaggccctggacctccgtgggccatcctggctgctgggcagaggggctgccctgccctgttctcccacagaagggaggctggctgccaggctcagtgcactgccttacctcctggagcggaccttcatccccagctgtttgtctgggctcagccactggcattggggggtggggcagggcctggcttctcttgtgcccccagctccaagccccccagggctgctcatggaggascaacagtggggagaaggtggctccccaccagcccccttcctgtggtcaaggttggggtgccgtggtctctgagccaatcctgctggaatcaaggtgcaccccctctccctgtgggcaggtgggagtgcccggggtaactgggcaccaggtccatatcttgctgctgctggggccctcagtttccccatttgagggtatgaagtgtttgcatgccactggtcacgactgtgttaggggcggagacctcatgtctgcggccccagggagagcgtggagctggggtgtgagtccttaccagcctggctggggctgccaggggaggtctgcaccccctccccacttggcgcagctgcgacctgggggagtcctgaagctggctggaccctgcaccctgggggagtcctgaagccggctggaccctgcaccctgggggagtcctgaagccggctggaccctgcaccctgggggagtcctgaagccggctggaccctgcaccctgggggagtcctgaagccggctggaccctgcaccctgggggagtcctgaagccggctggaccctgcaccctgggggagtcctgaagctggctggaccctgcaccctggggtagctccagcaygcacagggcctccgatcagctgaggggctggtgggcactcgtggcaccgaggtcagtccaggcgcaggactttgagggggcccagatggagagctggaactggcctcggcctgaaccacaacccccaacgatcagagatatgggggctttcagacacagggtgggcccaatgtgaaccaaaaccacctcctccaggaagttacagcagggtgcaggttctgtttttgaccccaggacgggaaggatcaagggttcccttttgacatttttgtattctgattataattttgctgggaaccagggaatgaggtcactgccaaaacaacaggaccttggggcttgttggggcgtctaagctgtgggatcctcagatgggcccctggtgggtgttccgttggcctcagagcccccagcacaggtgcagggctttcgggggatggaggggagccagggcctgtggctgagggcacccgagcctcccgggccacagcacagcacccagcgctgtcttcaaagccggcaggccctagtttggggctctgctggcttgggtctgcccactgaaccttgggtggccctgccagcaccacccgagggaagggtgtggggcaggaacgccccagcagcctgggaggccgtgacaggaactggcatttgctggaggaggtgtgttgatctttgcttctgacaacagccccagggtaacggaaatgtcttcctgcccaccatgacaggaaggctcctgggtaccccttctcagtacctctccaccttcttggtgccagataaaagggtcccagccagctataatgttctcaggtcctgggaggtcagacccaggggcccaccccacctaggaagccctaagaccccccaaggagccgacctaggcctggtttgggcacctcccggatggagggaagggaacccaggggtggaacggccctgctgcccgctaggaggtgctgccggcctccagcaccaggctgaggcctgcttccgtcattttgcctctggggcygagggcctgtgagtgaccactgagccgcccctggctgtggatgcgtgggttaaggacggggtgggtgtgtatctggaaacaaaagggcaggaccccggcaactggtggcttgggcaagtcaggtgactttttttcccacctggcagggactgcagggctcctgggcaggcctagcacacagcttggcacccgcgggcatcaagccagctttctcttcctggcacacagcctggcacccgcgggcatccagccagctttctcttcctggctatgtttctgccacagagagacagggccaagcccagctctcctccaagcacaggctctgctcacggaggacctggggcacactggggcagagtgcacacaccgggtgtgtggggttctggtgtttgtgtgcgtgtacatttgcacgtgtgtatggtgtgtgcgtgtggtgtgtgtgtctgtgtggtgtgtatgtgtgtgtacgtgtgcatgtgtatatttgtgtgtggtgtgtagtgtcttgcggggagtatggtgtgggtaaggggtgtatacatctctgtgtgtacatatgtgtggtgtgatgcatgtatatgtgtggtgtgtgcatgcacgtggtgtgtacatgcagtcaggcacacatctgtatgcacgtacacrtgcatgtgtggtgtgtgtacacgtctgcatgtgtgtgtgtgcctgtgttgtgtgcctctgcaggggcccgctgcagctgtcctgggtgcctggctgagcaggtgtgctgcccgcactgctgagcccgggatccctccctccctggctgttggcagctgggcccagtgcagctgtgctggcctgaccctaacccaccccctgcagcagggacagggccccagctccttgtcccaggccagctggaggggagcttcatgggtggtcagccccaggggttgggcctgagaccgtcaccaagaccccttccctccacaggacawgctgggcctgygccccccactkctcgccytggtggggctgctctccctcgggtgcggtgagttctgtrttccacggaggggactccwcgcgtgacattccaatcagggagaacagggcctgccctcactttcccatagacagaagttcccgggaggctggggaaggaccttgccactgggggtaggtcggggactcaggcctcgtctccgcacgtgccaggaggctgtagctgtgctgtttcccgagggcccctctttgcacctgggggtggtggcgaatgcggggtctcctcctggaggctgcctccctgtctttttgggcctcctctgaccttcctgctctactcccccttgggtgtgggcagggcggcccagagcacccactcaccagccrgcctcgtccctcagtcctctctcaggagtgcacgaagttcaaggtcagcagctgccgggaatgcatcgagtcggggcccggctgcacctggtgccagaagctggtaagtgcytcctggrcccctccccacctgcccagctcctgggtgagggccctttcctgcccctgaagccagtggcacccagaggaccaacaactccattttctttttgagggggtccccagaccctggcctcaccctcccctcaaggggcccctgaggttctgatgtgtggtctgtttggaaacacacacagaacacacacttgtattttttctcagccatttccgagtaggttgtagacatggagccctttgtctcttagtacttcaagggaggtctttcttaagaacaaggttttcacttacaaaactacgtaagcaagtgcagaaacacgcgcgcttctggccccgcatcgccagcacgctttcctgcagagtcagcaggtttggggccagtgacgggacccaccaaacacagcccttatcagaatccaggggctttgcagggacaaggtggccragaggaaatgtactttgatgtaaatgtattttgatacatgtatatctatatttgataaattcatgtatcarattcaggaaattcagcattggtatctcattatcatcaaacctacacacyacgcatattttattggttgtcccaatgatgtcttcgtgagcatattttcctggtggattttgtcacccaggctcaccctgtgctcagctgtctcaggctcagaatctcctcactcaggctcaccctgcactcagccatctcaggccccaaatctcctaacccaggttcacacactgcgctcagccgtctaacgctctgaatctcstcacccaggctcgccctacgctcagccgtctccttgggcttcttgaatctggacaagtcctcagctttctttgtctttcctgtccttgggcgtttctgaggargtcaggagagcagctttgtagcatgaccctcgggggtcttgtctggagtttcctctgcctggactcaggtgtgctttggcaggagcccctcagtgacggtgtcctaagtgcccatgagaggcactgctgtggccccgtcccagtcttgatgaggtcagcgtggacggctctgctgagacggcatccccccggcctccccatcccgctgcatgatcccctcgcagccactgtgggctggtgaggttctgccctcatcaaatcgcacccgcaggctcagcatccgcggaggtccccgcctgaagccgccatcactgcgatggctgcagattggtgccgtgctggtccccgcctgccactcacggctgccaacctaaggaagggtctctccttctctkcagcctctctctcatcagcgtgacccacagttttattttgttcagtagtgcatgatctgtggctgtcctttcttccccgagwtgctcaaatccgctrggtctggctgcgtgtcctgtccatgcatccccgttctaccgttctgagcactttcttgctttctggagcaacatgatgctgcaggcccatctccatgtcccttgccccagcctggaatcagatggttttctgacggctcgggttcctttccctgagagtctgggctccagcaccgttgtagccggacaagccgcagacagaattcctcagacactcggttaaagaaggaagggctttatttggccaggagtgtcagcagacttgcgtcttaagagccgagctccccgaaaaagaaattcctagcccttttaagggcttacaactctaagggstccacatgaaagggttgtgatagatagagcaagtgtggggaacttgactgggggttacatgcatcagctgacagaacagaaagttttgcaatgctttttcatacaatgtctggaatttacagataacaccagtagttttggtcaggggttaataataataataataatawtattattagtttaaccaccagggccgggtggtggcgccaaggtcatctggctatttatcttacttctgtttctttccaactttttgctttctctcttttctcctgtcttataaactagagaaggggagggggtggagaagaaggggagggcagcaggagaagtggtgtctcattccttaccgtcagcagcttcctcatttctcaattttgcgtcccacrgggagcggctttgggtcctccagcccacgccaccgcggcgagcagtccccggaggagaagccgggtggctccygtctgtcctcggactgagcagggtggccaggccccaggtggaaactaccttggtcaggctgggttttttccctcccctttctggaggttttcagctcctctgaaataaacacctttcagtgagatttgtttgtttctgtgtggattacatttaggctttcttttctctcttgctgggatacttgctgatgyacttttatttctggaggacttctttaaaaaattctgtggttccaaaagtcagagccctacaaagaggcaccctggggactgtcgccctcccctcccacctgcccccctgcctgcgggactcaccagcctctgggggccgggcttatcctcctgagcttccctctacgaaagcaagtgcacaaacacgcgcttctggccccgcatcaccagcacccttccctgtagaggcagcaggctcggggccagtgacgggacccaccaaacacagccctcatcagaatccaggggatttgcagggacaaagtggctgagaggaaagcgccctgggcccaggcctcccaggctcccctccagcttttgttcttctaaactttgaggggcttggcccagaaccctgcccatgttctgggtttcttgggggcctagggactgccacgttcctttgggacacagcaactcccttggacaaaggttctgctgatgaagggcttgaagcccctgggccagctgctagaggacgctgaggcctctcctcttgggtcagcctygggctggagagtaggtcctgagtcctttctgccgctagaggcagaggaggaggcgataccctgccccccaggggtctgctgtggccgggagccttcagggaggggctgtctgggaggctgaaggagctccctgtctctgtccacagggacttctgtcccaaattccaggcgcagaggaggaggggacagggtgggtcctcagtcctccatggccagtcagcctcctgcaggtcccgcagygtggccccctcctgacccctkactccccctccccagaacttcacagggccgggggatcctgactccattcgctgcgacacccggccayagctgyycatgaggggctgtgcggctgacgacatcatggaccccacaagcctcgctgaaacccaggaagaccacaatgggggccagaagcagctgtccccacaaaaagtgacgctttacctgcgaccaggtaggcttggcctcrgtggtggtgccaggcaccgtctgtgctggttattggctctggctgggagtccggccctgctctggggtgtcagggctgcccagaaggcatgtgtccgggtcggacgggtgtgtgggccagtgaagccccaaggctgctggaaagctgagctcctcagtgcccttcygctctgtccccaggtggagctgccccagcccttaccatcggtgcccagtgtctgcactctctcgcagcccgacgttctgcaccttttttttttaaagggagaccaaaccatttgcaaaacactattccattacacactcagaaggccagggtactcttagaagagtaaaggctctgatcagtcttgcagccaagagacctaagtaactgtttaaaccagtgttgcccaaactgacttgaccagagcacctgtttcgacttgaccagagcacctgtttcagaacacagtcccctgtcagtgctttgagaaacgccctccttatcggtggctcacgcctgtaatcccagcactttgggaggccgaggcgggtggatcacttgaggtcgggggttcgagaccagcctggccaacattctcctgctgcggcaggagaatcacttgaacctgggaggcagaggttgcagtgagccaagattgtgccactgcactttagcctgggcgacagggcgagattctgtctcaaaatgaaaagaaaggaagggaagagaaggggagggaagggagggagggaagggagggaagggagggaaggggaagggagggaagaaacgaagctccctccttgctccaggaaggcaggtgtggtggtgsagcagatgggagaaggaggcctggtgtggccaccgacctgtgacctcccaggccacagtgaggccagggaaggaaggggaagccatctcccagggagagggtgcagacggggccagggtgactttagaggaaccagctggtgtcggacaggctggggctcagagctctgccctcaggggaagcccaggtcagcggccactgagttagccttggggcagagtggcccagggtgcaggcggccaggtgacagccagcagcagccgggagggaggcagctgggagacagtgagggatggggccgagccaytggggaggtcctgcaggagcagggcccaggtgtccctgggggcagcaggggacaaaaccccaccctggtggtagggtcaggcctgcccctcgctgccccgtgagcaggcacaagccccttcgtgctggaacctccacctctgacctcaaactcgagggcctggccctgtggcccctggaggcagctctgatgtattttccccacgccccacttcacagtgaggaaactgaggctgacagaggtgttgcctgtggccagagtttgtgcagctctgtggtgctggaggtgtcaggaaggatcgtcctggagggtgggggtgcgcctgagtgggggcatccttgtgccgtggggaagggtgggggagtggctgcccacggcctggcatgcatccccactgtgcagggggcaaatgctgtggcctctgggagggcacaggtgagctcgggtggatgcaggtgagggtaggcaaactcgggtgagcaccagggagagatcttaacagcaccccagggccacaggctcccagagcagggcggcaggatctgggaagggactgtcctctcgcggggtcctggccctacccccgcagcctgctggcccttcgctgagcctctactctggaagggaagggacggggccccttggtcagccaccaaaggcctatgtctgtgccctttgactgcagcatggccacattgctcgtggggacatggtcttggctgcctcctccatgtcgctgcagacgccgcacggcccccaaagccaaacacatttactgtctggcccttcatagaaagtgattggggtccttggcccaraggccaagtgaagcctctgagggctgcaaggcacagcagggcgagggccagggccaggagtgccgggtgtgaatgtgggtgagtgtgtgtgtgtgtgagcgcatgtgtgtgtggtgtgtgtgtatgcatggtgtgtgtggtatgtatgtgtttagcattgtgtggggtgtgtgtatatgtgtggcacgtgtgtgtatrkgtgtgaatgcatgtgtgtggcatgtgtatatgtgtgtggcatgcatgtgtatgtgagtgcatgtgtgtggtgtatgtgcgtgagtgcatgtgtgtgtgtttggtgtgtgtatgtgtgtgcgagtgtgtgtgcgtgcatgtggtgtgtttgtgtatatgaacaagtacatatagtatgtgtgctttgtgtctggtgttgtgtatgagtgtgaggtgtgtgtgtatgcgtgcatgtgtggtggttggtgtttgtggtgtgtgtgcatatttgtggtgtgtttgctgtgtgtgggtgccatgtgcgtgtatatgtgggtgcgtgtgtgctacgtgtgactgtgtgtgcatgagttatatttgtgtgtgagtattgtgtgtgtgcatatatgtgggtgtgtatgccatgtgtgactgtgtgtgcatgtggtgtatttatgtgtaggagtgcgtgtgtgtgtgtctgtgaggaggggcacataccctttctcccagggtgtggcagcaggcaggttgggggtggagtgggctctgcacttgtcctgccgcccaggggggctgaaggctggagggtggggcagaggggacaggcttcgtcaccctccctccctgctcattcattaacatgatgtgtgtttatggagagctgacttgtaccaggcacggttctgggagccagggacacaggctggttgcggtgacaggtaaacagacagctacacaaccgcacgtgtgactgagacgcgggcgagcggaagtccagggctgggatggagaaaggggcctcctggggacggcccgcgtgggccttgctgggaagtgccaggttcgtgtgatgcctgtctatgtggctgctgatgagggcgcccgtgggactgcaggcatggggccgggttaggtgtgagcccaggtgagccgctgccactctcaatgaaaggcgtccccartgtcgctggcgtcaactctaagcaccccaggcgggtttcagtgtcactgcgaggcacatgcctgcgtccgggagtcatgtccttcctctgaaactccagcctgcctggatgtcctgtgtctggtcctcagctctcctgccaggcggggagaggggaggtcaggaggatttgggggctggaggagagggtgccagtgcacagcccgctcggggccacacgcccccagacaccctgtgtgagatgtgaggtgtggctccttttgttctgtccccacyggcaggccaggcagcagcgttcaacgtgaccttccggcgggccaagggctaccccatcracctgtactatctgatggacctctcctacyccatgcttgatgacctcaggaatgtcaagaagcyaggtggcgacctgctccgggccctcaacgagatcaccgagtccggccgcattggtgaggcccaggcactgcaggacaaaacccagtcctttcccagaccctggccactcctgcctgtggcccacacaactcctcgcactcaggtccccagggtagatctgggggccccagatgcaggtccccccagggcatccacagggctgcagtcggcctgcctccctgccaggggccacacccagtccctggctccccaacacttgtagacattgtccagccctccacttccccttccatcttctacttcctttatttatttcttggtatgtttaaaagacaaaattctgacagtgccaattattaaacattaaagaccacaacacatatagacrgcacagcgacggcagcactgaagaaaccacacagcaagctctgctgggccaagggctccgctctacaccagcactgccttgccacagagcargtctccagcacacgtgtgtgtcagtcacagcgcatgtcttccccgccggccgtggcttctcacatcggcactctgccaccttccctacatgcggggatgcacacatgcacgataamacacacacacacaagcaaatgcatgctcacacaaatgcacgctcacacacaaatgcacgctcatgcacgtgaatgcacgctcacacacaaatgcatgttcacacatgcaatgcacactcacacacaaatgcatgctcaaacgcaaatgcacgctcacacatgcgaatgcacactcacacatgaatgtatcctcacatgcacaaatggatgctcacacacgygaatgcatgctcacacacaaaagcacacycaaactcaaatgcacacacacgtgaatgcatgctcacacacgtgaatgtatgctcwcacacatgctcaaacacacaaatgcatgctctcacatgtgaatgtatgctcacacatgaatgtatgctcacacgcaaatgcatgctcacacacgcgaatgtatgctcacaygcacaaatgcacgctcacacacgtgaatgcacgctcacacacaaatgcatgctcacacacatgaatgcatgctcacacttgcatgtgcacacacatgcacacacagtcatacacacgtgcaagaccacatgtgcacacagacatgctcacatgcacactcatgatcacccatgtatgtcttcactcacatgtataaatcgtacataaacacacatgcccacatatgtacctggtcacctacgtgaactaggtgtgtccatacctgaacatgctcacatgcatacaggaatacgtgcacacacagttgtgctacgcatgtacacactcatgtttacacatgcagatggctgcacacacagatacacatacgcacctgttcacatgcccacatgtatacctggtcacacacatacatgcaggaacacacatgcatacacttatgctcatccatgtacattgcacactcccaggttcacacacacgcccacatacgttcacatgygtgcttgcacaacgcacatgctcacacacacactccacatgtgccatcttgctttctccacctccctgctaggagagaggaaacaggcttgccctcgtgcccctttgaagctggccctcccacctgggcccagcctgccayctccccagcccctccatktgccctgcaggcttcrggtccttcgtggacaagaccgtgctgccgttcgtgaacacgcaccctgataagctgcgaaacccatgccccaacaaggagamagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggtgaggccgctgcccctgyttgggtccccacgttcccccagtgtggggggctctgtcaggcgctgtgtkggggcaggggggtaccctggcyggcaggtcgtctgagggactccagcctgggcctggggagagcagctcctcaccctgcygctgcccatgcaggaaagggcaggaggaagggagggtgaccacgagggctcgaaaatcatgcgctgatttcattgtttgctgtgarttaaatttgtgaccctgggcaaaccttatgaagcctaaacattttgcgagcggccaagggtggaacagggccgctaggcagcaggtcccgtggttcctggggtggaaccaccctcctccctccaggccgggtgggckctggctgcccagtgtgtgtcgctctccacgtcccgcccacccagtttgtgactgtcagcctaacagagcagccacagtccctgggccatgttgaggccacatgcactgtcctcccctcacaacccaccttagctctcctgcttccctgcagtcccagcgcagacacactgctcacgagtgtgaggycacagcctaggacacgcacggcccccacatgcgcctgccaggggctgtcaatggtggactcaaggcctgctgggcccctcaggctcgttttcctccatgttgcactcgttctgcgtgtggcccacacgtctgcgagggtttttccccttggggatggtttcctgagggtttgttcccagctctgaagtgcagggaccgcagccgtgtctctctccttgcctttccacacgtgcctccactccctgcgcctcacatgtgcacggggtgtttgagggccgttgtctcctcctgggcgtggcgtctgggggaacacagctgggtccctgagacccaggggaaagggggacccacaccagcctccgggccaccccaccagctctgcatcgtctcctctgctccagagggccgggtctgggaaactgaggcaggtaaccctgccccccacrccttcttctcaggaggaaatcggcyggcgcaacgtcacgcggctgctggtgtttgccactgatgacggcttccatttcgyrggcgacrgraagctgggcgccatcctgacccccaacgacrgccgctgtcacctggaggacaacttgtacaagaggagcaacgaattcgtaagtccccaccccaggcacccaggcaccgcctggcaggacaccactgacggaggagacaagggtggggtctccacctgacagagcctccttctgacccaaggagcagattcctgaggaaacttctggaagccccaagtggcagcgtggggtctccccggactggcctcaggccaggggagggtagggttggtgggggcagccaggctgaggcccggcctcgcccttgtgggacacccaggctctgttggtctccagccccactgcccscctacctgggctgacagctgctgtggaggtatagtaaccgcycccaggctacggctgcaccctgccgtccccgcctctggccagggtcccatccccaagcatccgcctcctccccctcccggcctccactgtacgttccctgctgcccctgagtccgcctcctccagtgtggcccctccctgcccccattgcctgagctgggtgagcrgctgcggggaccatgaggaacatgcagggagggacagaggcgagaaggagcccaggatgcacgggttaggatgagcctctctgcggaggcatctcaatggctcagaggggccaggacttctggctgggatcagccgtgggccgagaggcaaccactggtcacaaggggcttgtcctcgctggccgtagtgcgacgctcttgcagcctgacgttgtaggctctgggggccrcaaaggactttagagatacaagactcaggtcctcygccgggagccacagacaggggagggacggccctcgggtcccggaactcgggtagggagagccgcacctgacactcayggcctctaccgaaactgagtgtccctcagtgcgaaagcaggtccaccgtgtggggaaggctgggattctgcccccgtggacatccccagtcccacggtgagacgcctcaaatgctgctcatgcctggactctgaaagcccgagtctatgcacacattgcccagagggcgtggcagctctctgccctgcactcctgcgtggcagcctctgcctctccagccttccccagagagggttcgaagcacgggcagggctgacgctgagcggggcagacaggggcgggtacctggaagccttgtcctggactcggggccaactgagcaggacctcctctctccaggactacccatcggtgggccagctggcgcacaagctggctgaaaacaacatccagcccatcttcgcggtgaccagtaggatggtgaagacctacgaggtgagtgctgttgggtcccgagcatccattgggtgggggcaygtttcagccacaggccagacccagcgccactgcaggtctgagcgccacctctgcatgctgggcacgtgagcaaccagccggcccaggtcctggatccccctaggtgaggagcccgaggcttcccgtcggggacaggacgcctgcgtgtcgataggaggaggaattcctccccgtccctgaaactcagctgtgttaacagcatgtcttggcattggtgatatttctgttttttcctggaatacaacacaattctttattttatggaaacacacttattttatgctcacatacatttgaacatcaacactctccgtgaagataaaattacacaaaaacgttcacaagcttggagtgcggagtgggatgaatttcacgaaggaagcacagctgataaccagcctctgctcctagaaaaagaggcccccagtgaaacacgttcatcctgcatttccgctgctagtgccatgtgttcagcctgagcaggtcagtgcgtcaagacgctcaggtgctgttggggttcccaagacctttctcaggatcagtgatttgccggaaggacttgcagagctcaggaaccagtaaactcacagttacagtttattgcagagccgaccctcctgggtgccagccgctgcccgaggtgggaggatacagacaaaagtcagcaaaggtcaaaggtgcacaggagagaaaccaggcaccagctcccagtgtcccctccctgcaggggtgtgggcggcgctccatcctcccagcgatgatgtgtggcctcatgcacagaacatggtccccarggaggctcttgagcctcrgtgtctactgggggtcagtcacagcggcgcggctgacaccccatggctgacctcagtctctagccctccagaggtcaagctgaaaactgtccagggccccaccccaaatcacactgtgggactatccggtgtgacctgaggccccaggaacaatgaacacccccatcgggtaggatgtaccaagggctcagaggctacctctcaggagctcagccggggtctaccactctttggcatgtgtggggtgtggccagccaggcctgctgggtggagccctgactgtgtaacagggattcgctagaaggaaggaaacactgcacgccctcctgaaaggagcctccgcccatagcagcctgcacagtgtgtggccctgaggccacagggacagaaggactgagctggaggaaggaggtggttgtcattgtactttacacagccacgtgccccgttcttcagggtggagctggaggaacgagatagttgtcattgtactttacacagccacgtgccccgttcttcagggtggacagggccctgggtggctcacctcacacccagctctgttacttaccacaggacgccccaggcccttccttaccccgagccctcagtttcctcatctgtgaaaggggtagtggtgcccggcgggcagtgcgtcgtgggtactgagctcacccactcagggaattcacagagcagccgccctaaagggcccgattatcctcatccggacagtgaccgacctgctggccattccagggccatcaccgccatcttcttcaaaatggcacgcaggaaaccagggccccctcttccccctgcctggggctctgcccagctgggcagcctcacagcccctgccctgctgcttaggctgaggagacatactcggggtttggggaaggaaagtgcccgggagggccgctgcttttgtaaagtgaacatttgctgaactacagggatccattgtcaggcccgtatcccagctacaagctcaacctcrtggtgtgttggggccgacagcgagaccagcggttcctgccataggttccccgggctctggartgggagcaggaccctgcgggagacacgggatgggggcaggtgtctgggggaccctscgagtgggcacccagagctggtcaggctgccgggacagtgggtcagcgcagggcagggctggggccggacatccacagagaccacctgctggtcaggatgtcacagccctgtgtcccatctgtaggtggccatgacggtcccctcctcaccarcagtagcaggtcccaatcctttgccatttgtcatggcagccagactccaggcgatggtgtggcaccagggccaggcactggaggcaggtagagtgcaccccatgcctactgctgagccttggggcacacaagccttcctcagcctttcctggtcaccttcgggggtggtcaaggcaacaggcagcgagtgtggacacacgtgccacgccccctcygagtgtgtttctgcaccaagcgcacagcaggctcagcaggacaggatgtgggagggcccagctctcccaagacagggatggccccagactgggacggatggaagtgggcggtgggcggagggckcagaggagggtggtggccaggctgtgaccggccccaggagctccatggaagggactgggcccatgcagggcagtcatgggagggtttgggcggggaggtgacccgaccatctgctccgtgttcctggaaggtgaaatgatgccgcaatcttccatgaaagaagctgagcatgtgtgarcatgggggaggctggctgcgcccctgtgcatctggccggccagaaccgatgtcaccgggctgtttaacacccatggaaactcagtagagtgccaagagccgatggcttcctggtgattttactgtgatccaccctcgtggggctacttccgcctaccatctgtgtggtggtaggaattccctacctgtgtggtggaaattctggccaacactggccaccatgcacgtcctcccaacccagtgatattgcgagcttgaaatccaccaggcaggatcactcacaccacaggcaggagtactcacaccacaggcgggagcagtcacaccgcaggcaggatcactcacactgcaggcgggatcactcacaccrcaggcgggagcactcacaccgcaggcgggatcactcacaccgcaggcaggaggactcacacrggcaggcctggacaatgctgcagctcagggctttgctttcttttcttatcctcatgatgcaacagtaattttttttttattttttatttattttattttattttatttattttttyatttcatttcatttcatttcatttcatttcatttcattycattttattgagacagagttttgctcttgttgcccaggctggagtgccatggtgtgatctcagctcattgcgacctccgcctcctgggttctcctgcctcagtctcctgagtagctgggcttacaggtgcccaccaccacgcccagctaatttttgtatttttagtagagacggggtttcaccatgttggccaggctggtctcaaactcctgacctcagtgatccacccactttggcctcccaaagtgctgggatcacaggcgtgagccatcatgcctggcctgggttttttttgttttgttttgtttttttgagacaaggtcttgctctgtygcccaggctggagtgcagtggtgcgatctcagctcactgcaacctccacctcctgggtttaagtgatcctcctgcctcagcctcccgagtatctggtactacaggcawgtgacgccacaccactctaatatttgtactttttgtagagatggggtcttcttatgttgcccaggctggtcctgaactcctgggctcaggcaatcttcccacatcggcctcccgagtactggtattccaggcgtggcccctgggcagctcagggctttttacccccaagaacctcttaccacacatcactgaccacacactctggggaccaagtgcaaaactgcrttgaggaccgtcccagccattttgcaggtgcagaagcccctggggtgagcccagtgcgtggagatgccrtggcacaggtcctagccgtgccatgtctggtcttcttgcccaacagaaactcacygagatcatccccaagtcagccgtgggggagctgtctgaggactccagcaatgtggtccawctcattaagaatgcttacaatgtgagtctcccgcaccactcagctgggacccatggggtggccagcaatctccccactgcaggtcagctcctgctgcaggtcagcaggagggtggtctgggaggaaagcccctgccccgtgggccagctgcagcctcccgacctgccctcaggcctccaggacaccctggcccggcacttccacggggagctctgggtcctctctcgttgatgttgtgggcgatgctccctgaaacctgagctccggactcttcattccagactcttctctgcgggtctctatggagaagggaggtggacagstctggtggcaaacagtgcagctggggcaggaggaggccacaggaaacccccacagtggacttgggccctgggaagacaccctggggggtggaattcctcttgctctgttcacctgtcctgggcaagctccagagaagcccttamcccctgaatttctccctggtgcacggcccatcgagctgcaccctgggctgctcccctggggagcccatggccctggtgggcataggtaggcataggtgcgcactaggtgccattcagggccccaggcaccagaggtcccgactgctctggaaatctacccccaggtgagagatgttctcagaattctggcctggatccttctaggccaaaggtcctgctggcttgagggagctcagcacgttagcgcctccgacaaacgttgggtcattgaattaaactgaaggcccgtggaggaggtgccatttgcttctcgtagcctcccgtgagccccaaacccccagagcagaccctcctgggtgccagccactgcccgaggtgtttctgtccttacacagaggatgcaggtgacgccactgccctggccattcacccgatgcccctatgaacctgtccctctgcctcctctcaatttccgtctgtctstcagtctttgtctctctttctctgtctctctctgtctgtctctctctgtctctgccccatctctgtctgtctctgtctctgcctctctctgtttctctccatctctctgtctctggctctggctctgcccatctctgtctgtctctgcctctctctgtttctccccatctctcttatcgcttgaacaatttatgcagctcctgccctgtgctaggtcctggggactcaaggctgaggagcagcagaagctcccacccctgaggctcacaccctggctccatgctagtccctgtggtcaggctgtctcgagggcaggactgtggccctggcagccctgccatcctcagcacatcctgctgtgctctcctctgtgtcattagctgacactggggacttgcactgagaggagaagtggagacgggtctaaaccgctgggccaggcagggccaggacaacagaaacactcgcccccaagagtaaccgctctctgcccgcagaaactctcctccagggtmttcctggatcacaacgccctccccgacaccctgaaagtcacctaygactccttctgcagcaatggagtgacgcacaggaaccagyccagaggtgactgtgatggcgtgcagatcaatgtcccggtgagcctggccacaagggtccccatcccagcttgctgaggggctctggggacagccagaaggagccagggtccccatcccagcacactgaggggtcctggggacagccagaaggagccagggtccccatcccagcactctgacgggggcagggaggggcacacaggcatcagaggcwgtctgggagcaggcagcatccactggaaggaccctgtttctttccttcacatcctctctgccgaggccagacgctttccttgtgaagctgatgtcaggaacgtcagtgagagggtgccgagagggtgcttctcagtgagagggtgctgggagggttcttcacacacgccttggcccccaagagtcctactcatcaacctggagccccaaatccctgggtcaggccactgcagactgagggatggagtgatggctgcgccccctgggggcagacgccggacacacagaacaggcgcaaacggcaaacctgggtagggttagttgtcatgattttctgcgtgtttcattctgtttttttgacagaaacattaaggcatgggccacacaggtggttaggaatggacactgagttccttctctaatctttcaggtttaagtttattatccaatcatttgttgtttytttttgttttttgttttttgtttttttttttgctagctgtgaaataatattcagcaagacacttgctttcattgcattttcttaatatgactttggaattccttcaaacatgtttcttggtaaatgttgcctgtggattttttttttttttttttttttttttttgagatggagtttcgctctgtcgcccaggctggagtgcactggtgcgatcttggctcactacaatccaagtgattctcctgactcagcctcctgagtagctgggactacaggcgtgtgccaccacgctcggctaatttttgtatttttagtagagacagagtttcgccatgttggccaggctggtctcaaactcttgccctcagatgatctacccgcctcggcctcccacgtgctgggattacaggcgtgagccgcggcgcccagctgtcccatggattctcaccagaacgtttccctcatgttgggtggtctgagtgggagtgtgctcagcttctcctgatttgctgtctgcgtgtcacatgtctctgctgatgtgtggccggggagatcctggtgccggccagtgmgggagtgcgggcagagcacctccttgccggctgactttggctctcggatctgagcatcagctcttcctgctcctggtcaccccttcctccccaygctgaaccccccaggacccctgcagaggccaggaggtgagggttgggagctgggctgccaccctggccaccgagggtccccacctgagcccagcactgccctgcagatcaccttccaggtgaaggtcacggccacagagtgcatccaggagcagtcgtttgtcatccgggcgctgggcttcacggacatagtgaccgtgcaggtycttccccagtgtgagtgccggtgccgggaccagagcagagaccgcagcctctgccatggcaagggcttcttggagtgcggcatctgcaggtgaggcgggcgcaggtccctgttgaaccatccccgagccccaccccacagggcaggtgtcggcaggtgaggtgggtgcaggtggctccatcccttcccccaccccacggagcaggcatcctgggggcccccttctgcaggaggtggggagatttgggattggaacccagaacccctcggcaagccctcacccgtgctcctgagccagggcaccagcaatgccagcctgtactctacactctctggccatggaggacccaaggcaggggacttgtgggcaggaggaccccctcaccagaggatggaggcccatctcaggggcacaaggagtccccgctgggcgtgcccatggccttgagtgggtcactttctctgcccgaccttccttgaccctaggagctggcttctctctgaccttggggacccaaggccatcaggctggcagccctggggcatgggyggctagagagcctcctgggacaggtgatggcttctgggagcctgggccccataggccacctcttgggcgtgcacaccccctgccaggcgtgggcaccccacctcagggagaagtgggggacaggtggacccagtggggaggttcacatggcactcagccaggcggcctgcccgggggctggatggctgtccccctttccttgcttgcctggccagarctgctaggctgacctcccaggactctgccccctttgctctggtcacctcctcccctgtcctgaccgcagtgccaatccacgtcctggtggcagtgcccttcctcaccttcaggtccctgctgcccccagcctcctcccatatctcaggacaatgatggtctctgtggtcttggtggtctctgttgctgtcctcgtgcctcagtggccaccccgcccactgtcctgggtgtgcagccctggggcggcctcttcacgggactgtaggggtgactcagtcggaacacttggcaggtgtcggggggtgccctgccacaggtactcagacactcggtcctgcagcttcctcctctggggagcaggagagcccgtggcagtgccgtctctgaggatgcctcagggtgtgtgtggctcctgcctgccagcggcttgatgccagcttccacatctgwaaaaaccccttgtccctgcattctcccacaacctggcctgtcagtgcacgaacgcaggagggagggcrgggctgtggcaggaggcagtgccgagtccccactggccaccatgtggggcacgcaggagcagacaccagccactcacagagcacyggtatcgcagcacaggccatgtgcatggctgcaacacagctccacagtgagcctgccgagccactgcatgcgcaggccaaggccaggtgtctgctttcccctcgggacatcctggggagggaacgcggggcccctgcacgttttgagcacatttagtccgtggcaagtgctcagtaggcctcgaggaaagcaaaatgtgccataggggtgttctccaccaagggcraggggcctggaggacagggcggctgtcccttgtcccacatcactggggggagcctgaccttggggcccctcctgtccccaggtgtgacactggctacattgggaaaaactgtgagtgccagacacagggccggagcagccaggagctggaaggaagctgccggaargacaacaactccatcatctgctcagggctgggggactgtgtctgygggcagtgcctgtgccacaccagcgacgtccccggcaagctgatatacgggcagtactgmgagtgtgacaccatcaactgtgagcgctacaayggccaggtctgcggcggcccgggtgagcccrtgggtccctgctggacaacggccgtcctgcggcacagacttggtgttggggggtgcgttctggaccattcaacgagtggaacagaaaggggggatcctgaggacagacagtgcaagtctcgcccagccaccgggcgtcagcaggaacttggatggccctgcaccccgccctgcctcagtttctgtgtccatgaggacaaggcgtccttgtggggagggcccacaggaggaacggtcatagccctattgaggtcccattcacagcagggcaggggaggtccagactggccaggaggcggccacgtggctggcgggggcagaagggcctggctagtggccccatgccttttgctcaggaacatcccccaggctggaggaggcaggcgggccggagggagcaaccgcagtrgggtttcgggcgggtctcggttcccaggccaagcaggagcttagccrtgctgccccgtcttccagggagggggctctgcttctgcgggaagtgccgctgccacccgggctttgagggctcagcgtgccagtgcgagaggaccactgagggctgcctgaacccgyggcgtgttgagygtagtggtygtggccggtgccgctgcaacgtatgcgagtgccattcaggctaccagctgcctctgtgccaggagtgccccggctgcccctcaccctgtggcaagtacatgtgagtgcaggcggagcaggcagggcgggcagggatccccactccccggccacctacccagcagccgggctcactcggggaccccagtgagcacctctgcaccgcggggttctctgcgggtgcgtctggactgaggggccctccgcggccgccgtgcccctgtgtccctcctccctcctgtgcgcacctgccgcgggccctgggatcaggcttccagttcacccgctgcacccgcatctgccccacttgggccccctccttggcctgagggcgccccaaccccacctgccccccctggtggacacacacccaagcccgagcccccrttgccgragcccccgcacaccctggcaccgatgctcacacctggctccccgcagctcctgcgccgagtgyctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgaggtgaggccgctggggtgcagcggggaccggctccagagctccggctgcggggtctccgcagaggcgagggtggtgcrgaaggaggatctcacctccagtgttgtgggcccagcagggtggatgagccatgcgggatgcccttggcattgcaaggaggccagaggcckgtcccctcacccccagcagcctcccctttccctcccctcctcacctgaccccacatcaagctgggcagcagacggcctgctccctgggggcaccactgctccacaccgggcaggcccaccagcatgccacacggcccgggccatctcccgctggatgcctcatggggcaaggcttgcagttgcaggtccccaggggtggcccgcggtcaggttgctgcgtgaggctccyttgaggggattgggagatcctggtgctcggctctcagccctggaggggcccagggccaccaggcaccaccgtccccatcactcgttcggctccagtccagtcggaaccagtcccagccccacagtgaccttggtggcactgaccctgtctcattcggctccagtcggaaccagtcccagccccacagtgaccttggtggcactgaccctgtctcattcagctccagttggaaccaggcccagccccacggtgaccttggtgacactggccctgcttcttcaggtctcatgttccacaggctcctgagaggcagaggggctggggctggggggccgctggcggactccatcaggcatggccagcagccrgccaggactcttgcagaactgagacctgggagctcctccctcaccaggaagggacccgaggcaggcggcgggggtctctgagcctgtaggtgacatgcctggagctcacaacccacatgtgggcctggggctgcagacccccacctgccagggcaggaacccctgcgggccactttgagggacagacttgggtcacgtctggtttgtgcaatcctggccaagtcacttcacctttgaggacaggtgaaggaaggcaggtcccccaggaaaggcaggatggcaggagggggcayggggagtgagagtgcaggtcaggatggcaggagggggcacagggagtgagggtgcrgatcaggatggcaggagcaaccacagggagtgagggtgcaggtcaggatggcaggaggggtacagggagtgaggatgccagaccaggccagggactgcactgaacgctagtgtctgtcccagggtcagcagctgtgggcctggcccactatggcccacagtccccatgctcaggaggtgggcacagctgccgtgggaaccaggaccttgcgttgctcatcctggcaccggcctcacctgctgagctctggtctctggtcttgtccttgacgaccacaaatcactttcacagtatggggagtgaactccagcagggaccctgagcctggtyctgaactctgctgtaggagagcggggtccctcgcactgtgtcctaccccccagtattagcactctgtcctggctgcccggtaccctggccctgccttcttctctgtcagcaggggtggtggcaatggcccttaggtttcatttggaaccacagggcctggcctggaatccagcaggggctgggccaggttctcactgacccctggccatggtgatggatggtgagcygggrccctgggaacctccgtctctctaagtgctgtgttgtggggtgacctcggacctgtgggcacacggctcagtgagatggggctggactgacgctcaggtgtgctgcttcttccctagagtgtgtggcaggccccaacatcgccgccatcgtcgggggcaccgtggcaggcatcgtgctgatcggcattctcctgctggtcatctggaaggctctgatccacctgagcgacctccggkagtacaggcgctttgagaaggagaagctcaagtcccagtggaacaatgtaagtggccgtccttgggggtcccacgcagaggggcacgtgcrtcccacactatgygacctcctgctgcgggaggccgtggacacccgtgtgtggctgcaccccggcctccccaggcagcttgtcctctgggcgtccgccgctgtgggtgagcttggctgccggtgctgggaccctgsgggggctgccccacgtctagctcttcctcaaagtgacggcttccatgcggggagtgtcctcagggagaaagattctgctctgaaaacctcccacactcacaagcccctgtttgcatttcccaccaggataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccrccctcaaaatgacagccatggcmggccgggtgcttctgggggctcgtcsgggggacagctccactctgactggcacagtctttgcatggagacttgaggagggagggcttgaggttggtgaggttaggtgcgtgtttcctgtgcamgtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaactgggcactgtgtccgctgtattcccccgactggcaaggtggccaggcacacgtgggccctgtcctgcccgctgacctttgccacacaggcacacagctggcttcagaccatggggcaggttctgttttcccttttccttcctcacctgctggtctatacagagccccgctctgaggccctgtcccaaatcctaggtgcatttccgtaaacggtggtggccccaccaaagaggtgcctgcrgcggagcctggccagggcagaggcaaagcaggaaagcgggtacctgtctgccctccctccagccatctacacctcccctccagccatctacacctcctctccagctytacacctcccctccagccatctacacctcccctccagccatctacacctcccctccagccatctacacctcccctccagcagtctacacctcccctccagccgtctacacctcttctccagccgtctacacctcccctccagcagtctacacctcccctccagccatctacacctcttctccagccatctacacctcccctccagcagtctacacctcccctccagcygtmtacacctcttctccagccgtctgcacctcccctccagcagtctacacctcccctccagccgtctacacctcytctccagccatctacacctcccctccagcagtctacacctcccctccagcagtctacacctcccctccaaccgtctacacctcctctccagccatctacacctcccctccagcagtctacacctcccttccagccatctacacctcttatccagccatctacacctcccctccagcagtctacacctcccctccagccatctacacctcttctccagccatctacacctcccctccagcagtctacacctcccctccagcagtctacacctcccctccagctgtctacacctcctctccagccgtctacacctcccttccagccatctacacctcccctctagccatctacacctcccctctggctgtgcctacacttcccctccagctgtgtctatgccttcccttcagccatctactccttccctccagctatctacatctcccccccagctgtctatacctctcctccaactgtgtctacacctcccctctggctgtctacagagccccctctgcctcccactggggtactcagaggggagggagccagtactgctttagtggamgtgtggaaacagccctgggctgtgccaaagctgctcacggycccagagcagaattcagcaccaagctccacacagatcctgcctgagagctctggacacaagcaggctgctggccgtggttgcagttggtgaacgtctcagttctagcacaggaaggcctttgtcctgggaaaccccttagtttgtctgggcaagtcacacagctggccacactgccagggccactgcagacctgcaaatgggcacatgtgggtggcatctgctttaggtcccctactttaaaattgtaactgtggccaggcacggtggttcacgcctgtaatcccagcacgttgggaggccaaggtgggaggattggttgagtttagcagttcgagatcggccttgaacctgaggctgttaagttagcagctgttaacttaacaagagtcacacagcacacctggcgacccagccttgaacagtgagactccatctctactaaacattaaaaaaaattagtagtgtggtggcacatgcctgtagtcccagctacttgggaggctgagttaggaggacggcttaggcctgggagttgggggttgcagtgagctgtgattgcaccactgcactccagccagggtgacagagaaagaccctatcttaaaaaaaaaaaaaaaaaaaaaaarcaaacaaacaaacaaaccaaaaacgaacttctaactgygtgataacctcttactgtatatgcctgggagactttacctgggcaggtgggaggagctagaaatggccagatgctccaacaccgctcacttcccagctcaggggtccccactcagcctgcacctggggctttaaaagcccctgccctgtcggagaagggctgccgtgactggtgttcagtgttcctcggggaggctgctgtgcagccagggtggacacccgctggccttgagcctcagttccccaaggctggccttggcagcagaacaagcctcacctagaaacctgtcagaggcgsattcttggcttggcccyggaccagctagtcggcagcactccgggtgggctcagcaatctgggctttgcaggtcctccagggatactgatgcacgctgtagtttgagaaccactagacaaagctaggagatggaggtcaaattgtcgacactggctgggcgcagtggctcacgcctgtaatcccagcactttgggaggcaggccgaggtgggcagatcacaaggtcaggagatcgagaccaccctggccaacatggtgaaaccccatctctactaaaaatacaaaaattagcttggtgtggcggcacgtgcctataatcccagctactcaggaggctgaggcaggagaatggcttgaacccaggaggcggaagttgtggtgagccgagattgcgccactgcactccagcctggcaacaaagctagattccatctcaaaaaaaaaaaattgacatcaaggtatggtctacaggggtgtgtgcrgggtggtgatgccytctcaggaaggagggatgggggagggtgacctcaggtgacccaggcaatcagagggcctggcctggagcacgtccggcaaagatcagatgccagccctgagtgaaaccctcctcacagggttactgagaattccaacgcaggctttgggcagaattggagttaggcactgaccagggtgtggcaggcaccaccacccaactcactgcagctgctaacttaacaagagtcacgaggcacacggatcacctgctccccgttgttcctacaggtggaatctctgagcctggaccttttaagccaagaattgcttaaggtgtttcccacaccctgaattccagcagaacagctgacgccaactggtctgaaggccccaccaaggaaccgactcagctcaggaatgtggtttcttcatcccctatcccgtgacttcaccactcatactcaccaatcagcgatccccacgyctcagaccccatcacctgcccagacmcctgaaaaacaccatccccaagcccctcgggaggtgggtttgaggtttcctcccatctcctcgcttggctgcccacgcgtcttggactttctctgtggcaactccctctctttcagtgtgctggtatatcaccatgcagtgggcaataggccctgagccagggtcctaggacacgtgcccctgctcgagatccatctcagtgattgcagcaagggcctggatcacccccagacgtgcctctagcaagacaaactgtcagatgccctcaatccattttgtgatttttctgacattttcctgccagttttcagaaggtctttttgacgttccaaccttgwtccagagaaatgaggggagctcctgagacatggggaagaagcacggactccaagggtgagcccccagtccacrtccagctctacttcttactggctgcctgacctggaacaagctgtgttttgtcttgtcaaaagtataggtggagggatcactaaagcttggccctgggaggatgcagagaggctggcacaggaagtgctttgagaatcataactgcttgcaagggatgggcaaccggaactctctgtgccttggtcaaggacaaactcctgagcacaagagayctcgcgtggcacagaccagctctgaagccatgaagctgccaaccgtgtgcagccccacaggagtcctcccacataccaggggtgcaggttccacaccgctgcttagtcccatcatgggaaatgggctgtggcctgtgggcccagccctctctccctccctccatgcctcaccccagaccctgctgatccctgcctgtccaaggctccacactgtctagccccttccaaagtgagtccaaagtctgggaccttcaggtgctctccttgttctccccagtgttaagcatctggtggtttaatsggttgccagaagctycactctttttatgcagcctctctggaagtcacccactaaggaatgtactcataatgaccacatacaaaaaaaatccaactgcacagacacttaaccaccaaataaacccgctggtggaaatccctggcaggtgactccaatatgcacaactaggtggggaccctggaacttcccctctctggccccagcccactgtggctgtctggtcctgtggacagccctttccattgctctggggctcggctgtcatttctcctaagttgataccattgtgactgtatcagtttaattccctaaccatctttcttcatggaaagacatatgcacttttaattccagactgctctaagtaatcatcctgtttctgtaaagagtcataacggttgtacttcctgtacaatgtgccgtttgggtcatkcctctgagcttgaagctctttgacaattgaatatgtatctttggattccagacatgttaaattacacaatgcctcccatttcctctttttaaatcttgacttccatgcggttaaaacaggaactggggttataccatgcattttttgaacttctgcattgttaagttgtcccagaacttagttatattttaaaatgccattgtgcattgtttaaaatgtggtgatattcaccgagttttggttaatgtttacaaacacctaatgtccwtcaaataccattaaattagcattgtgtggttgtattgtttcaggggcatagttctaaactagacttgtgtttattctgtttctgcaaactgattttttttttttttcagaygtagtctcactcygtggcccaggctggagtgcagtggtgcgatctcagctcactgcaacctctgtctcctgggttcaagagattctcctgccttggcctccaagtagctgagactacaggtgtgtgccaccatacccggctaatttttggatttttactagagacagggtttcaccatgttggccatgctggtctcctgacctcaagtgatacacctgccttggcctcccactgttgggattacaagcatgagccactgtgcctggcctgcaaatggctttttaaacatcttttgatacaatcgaagatcccaatgaagatgtaaagtatttgaactggaagacgtgggtcagagacacagtttgctgtcactaaggtccctttgcatccactttatccctttatgctgagcctgagcaaacaggacaaacgtaaaaaatgattgtaatttctagaataagttaacagtttttgtcactaattttgccaagatcccaaccagctatttagccagttgtttggaggaggttttggctctgaaaggttggtttatgtggatttcacatcagccatgaatttagtgatgttatttggtttatctgggatacagacacagcttttagttttacgatagcacaggttaccctcgagctgcggtgagtrtgtctaaagccatatggttttataatacagattttctcaggtaagtttatcatttaatcatgagatacctggctatatcttaaggccttttgtgtgtaactggtgagggcctctacrtgtcaagtaacgccttcaatacccagttatggcagaaagacagaagctaaatgatgataccaatggaatacaggatgaatctgacaagactgtagatgaggaagattggtgagtgtgaaacggtatgaaatatttgaccttgtgaccggcataacccaaagaacactgtcccagctgtcccagggtatcaccttctggtacaagagcccatttcggaggctcagttttctttgtttttgagatggaatctcactctgtcaccaaggctggagggcagtggcacaa

SEQ ID NO: 13358 - DNA, 38449 bp, Homo sapiens
caaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcrgcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacamcctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttytccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggwcaaaaacacatgtccaaacaaggtactcaggcccatgacagatttcatgaagagcaaggaataccatgaaccaacattctccaycactataagctttgtcactttgacaaatcactcagcctctgtgaggcttttttctaaaaatggggataaagtgacctatgctattgtgcctgacatatcataagccctcaataatgtttaaaacttgaatgagcyggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcycagcacttcaggaggccgaagcgggcagattacctgaaatcaggagttggagaccagcctggccaacrtggtgaaaccccatctctactaaaatacaaaaaattagctgggcatggtggcaggtgcctgtaatcccagctactcgggagrctgaggcaggagratcgcttgaacccgggaggtggaggttgcggtgmgccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttcygcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgwgagccactgctcccgctcccggccctttttttyttctttttcttttttttttttttttgagacgtagtctcactctgtcgctaggctggagtgcagtggcgtgatctcagctcactgcaacctccgtctcccaggttcaagcgattctcctgcctcagcctcccaagtagctgaractacaggcacgcgccaccagtccagctaatttttgtatttttagtagagacggggttttgccatgttggccaggatggtctccatttcttgaccttgtgatctgcccgcctcagcctcccaaagtgccaggactacargcataagccaccacgcccrgcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttgsctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgayccgcccgcctgagcctcccaaagtgctgggattacaggcgtgagccaccgcgcccatccttctytttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtaraaatggggtttcatcatgttggccaggctggtcttgaactcctgatctcgtgatccacctgcctaggcctcccaaagtgctgggattacagscgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaasgagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcraagggatgcgagagctggaactcttaccaggcctgcggaaactcagccctccggcagctaatcccgcccgccascccccgtcctctctctctttctccctagctgaaggcgccacgggccgtgtgtcgttgccttccacttttggcgtcccaacgtctctccgctcccatctttctactaacgtccgacgcacgctccgcctctttctcccamattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtakaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccagktgagtctgggtgaaccgtkcsctgacgcccttttccggcgcgggagaggtggtggcggtggcggtggcggcggcggcggcgktggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctkktcctcgtctcctttctcccccaaccccgtttttcttcttgggcctctgcccccttacttcgttgtctacatcstttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgragrtggctctggccttggccctctgttttctggcccatggttacagggtgctaaggtggctycataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaagktgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgmtgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccaraaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacaygtaagaattggaggaaaataaakgtggatttgggaaactttgaggccagcttgcttcttgcaggctcatgatcaaccaatctcacataaaagtattgaatgttacatatctcagccttcttgatagggatttcatagattttttttttttttttttttttttkagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagwcggaacaggatgggcaagcaaacaggagcagtccgaccccaagaggtagacagaggcttgggggacctagagtgatgggtattttaacttgaacttcagggagcattggggcttggtttagtccagccacgtctgagccrgagacgaagaggtccctttcttacctrttgcaggttccttgttaaatgactaaggaatggtactaaactttagctttttgtcttggagagagagcatgaaaaaatagacaacagcctacaaaggatgacaaaattawtttgtccttrtatttgtaaatggtagcaatgggcatgatttcagtcctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctggagtgcagtggygcaatctcggctcactgcaacctctgcctcctgggttcaagcrattttcctgcctcagcctccagagtagcgggactacaggcacacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaawttttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgtygtaaaagagatgrtagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagcyccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactrtcagtgatagtgttctatcatttgtatatctgaaggagggaaggttttgtctggaatcttaggttgtagyctaataccatttcttggcagagtactgtagctcacgcctataatcccaacacttagggaggcttggggtggaggatcgcttgagcctagggagtttgagmccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcwtgtgcttgtagycccagctgcttgggaggctgaggtagtagaaycsctttaacccgggaggcagagattyctgtgagccaagaccatgccattgcactccagcctgggtgacagagcaagactctgtctcaaaaaaaaatcctgtctcacaagaaatacataaataaaaatgaaaactatttcctatrggcyaagactgaagaaagtactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgyctttcctcctttcctaggagcagctcctgaagcagcagcagcagcaccagtggcagcagcatcaacagggctctgcccctcctaccccagtgcccccatcaccaccacagcctgtgaccctgggggctgtgccagctccamaggctccacccccgccccccaaggccctgtacccaggtgctctgggccggcccccacccatgcccccaatgaactttgatccccgatggatgatgattcctccttatgtggacccccggctcctccagggtcgtccccctctagasttctaccctcctggtgtgcatccctctggtaagggggcatgggaggagtgagaaacaggaaagtcccctcagtcttaggcattggatattagggtcttactgtgaytctggtaygataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtraaaccccatttctactaaaaatacaaaaaagtagccggcgtggtggcgctcgcctgtagtcccagctactcgggagactgaggcaggagaaacgcttgaacccaggaggtkgaggttgtagwgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcraggggagatgctttttgggctggagggcttgtgacatgaataggattawttttctttttctttggtttcttcaggcctagttccccgagagcgttcagacagtsggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatgrrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatscctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggrgsccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggygccggcagcggggctcagaaacaggcagcgagacccatgagagtgatctggctccttcagacaaggaggctcccacacccaaggagggaacactcacccaggtccctctcgctcccccaccaccaggagccccaccttcaccagcsccagcccgcttcactgcccggggtsggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggagscrgtgggggtcctggaggaaggaccgggccaggacgaggcgacaagaggagctggccctctcccaagaaccgaaggtgggtaggaacaaacaaatttattgtggtttaaaaattggaggagggggrraaagcctgagggaaagataagtttgggtgkagtggagattgtggcctgaggggccatgggctctagaatgtcagtaggatttccatgtctggctaaggcaactggaaagcggytggtagggtgttagagtcaagaacacccacctatgtattcattgctggttctttgctttccagtctgtgcatctgtaygcataggaayccttagaaggactcaaaaacacctggactttaatagggaagagrataggttgtaagcagaagttgggaaacataacttgtgggaaaaartaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggrccctgcygctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcrgcctcccagaaaaccagagctgctacaggaggtaagggatgggtttgagattgtgcttcactgcactcttactcgtgaaawttcttctgggttatgttttctctgttytctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctggkttgagtctggagctgttytctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctrccccctggccccattggcacagaacgatcacagcrtacagaccgagscacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctacccccsrgcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggmtttctcccttcaggggctcctgcccagcaggtatattgtatcktcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctyccctttctctgttacctgtgggccctgcyctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccrttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagacgcccttcttcccttaggtcctyctctggcctcaattcccgtctsaaggccacgccttccacctacagtggagtcttccgcacccagcgcgtcgacctttaccagcaggtgaaggagaaacccttgtggccccaactctaaattygagttgccacytgatttcctgtccttccrtctcatcgctgacctctcactgtgactcactstttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttsyggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgrgacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacaycaggctgggcgcggtrgcccasgcctgtaattccagcactttgggaggccaaggcgggtggatcacaaggtcaggagttcgagaccagcctggccaatatggtgaaaccctgtctctactaaaaatacaaaaattagccgggcgtsgtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctggscattggggaagcgctggggactgtagttggggtcttcctgyagtcgtttttgtatatcagaccggagctaaagagaaaaagyaagcaggttggagaaasgctggccaagtcccyatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccvcttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattccyagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagmtagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatytcaaaaaaaaaaaaaaaaaaaaaaaaaaaagctgaaacctgaagacacaagacactacagcagccccattccaggaaagcaggaaccaasaaaatatggaaagaactggaaagtgccagtgagcaractaggaaaggagtttaaactctgagtggggaagaatgaaaactcacccacaaggactggctgcataagaagctgccccacaaggccgctcaccatctgggccaacgaggcattggtacccagaccrgcgccctgctggatagagagcaagggagaayttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccwcatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccratctcagatgatccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgkttttttttkttttttttttttttgagacagagtctcgctctatcacccaggctggagtgcagtggtgcgacctcagctcactgcaagctccgtctcctgggttcacaccattctcstgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccrtagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccakgagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtgratgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaamcacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttamtgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtartatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggmcctatctccattatgggttctgatttctaccctttaaraacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacraacaaagggatcaataaaaakaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgartcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggarggcccgctgttgcccagaccagagtgtacccgaaagactccctagcattaatccctgccccaatacctaaaaagtwtctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacrgacctgctagctgactgcccgcgtctactgccttcccacggtgttccagcagaacggcacaactaacccacagccaaacacacacacacacacacacacacacacacacacacmcmcacmcaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctyccccctctggcggcgttcacgtctgtgcgcgcgctkgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagt

SEQ ID NO: 13359 - DNA, 60844 bp, Homo sapiens
tagccagaaatggacagaagctatactataacctcactcagaggtggctctgaagaacaatggtaaagggaaatactggcagtaggcagagatgggatagtacctttggtcattcgtggactgtatatggaaacaagtggaggtatagatatacatggactcctgggcaggggcctggaaggaacaagactggaaaatcagaggcaaggatatctggggtagaggcatgtggatggacacgatgtatgttaatgtccagtagagaagctctaccacagggaggcctacgactatcaagaggacattagccagcttctctccattggccacatcagtgctggtgcaatgggtggtaggaatggagaccacacatggacagatagttatgagaaccatttcagaagtctgagatcgagtactagttgtccrtagtgtggccaaatcaatgaggcatccttttattgactttccttcttttcctatttctcttctctttgttcctcaacctgttccctcggatcgcattcccaaataacctgtcgcaaacaagcccttgttccaggctccatttgagggggaagaggctaagttaagctactacccatttacaattgtaacccctgttcacactcctagcctctcttacacggctctgtttctttttttccatataacctatttattatgtctattgttgattatgtttctctcccactaaaatataagctctgtaaaaacagggatatttgtctgttttggtccgtgtagtgtccccagcacctagaacacagataaagttgtgttgaatgagtgactaagtgattagagctaatgtatgtacatttagatgctaaatatttagaacatggtagaaaattctgggcctcaggaaacacaaggtttggctgtagctggtttggagactgtggtcaggactgagaaatttcgggattcaagagactaaggagtgggtttggcttggcccaggagcagggytggtccaaaatttagagtctcgtagaaccagagcctttcctgcccgtggtgccatgtttcagccaaagcctttatgcttgtaccacaacccacccctgtggttaagagcccagggtcttcatccaaacagacctgagttcagagcctacccctactacttcttagttgtgggatcttgagcaaactacctctctaacttcagtgtcattatctgcaaggctgtgctaaggacacattctacttggttgagttgtaatgagaactgagggttaaggttccatataaagtgtctggcacaataggaagtgctcactaagtacccgtcagcattaaactttcccacgtgccacatggtgagggtggyggcctttcagttctaggtcctctcttccttctggtgggagagtcgggcttccctcagtaatgttgcttattccaatttgttgggtgaaggtcagaagagagatacagtctggatgaaaaactcctgagttctccacagggtgcagagccactgggtgtcccttgcaaattgagttcacaaggtcctgctccaagagttctaaataaaaatgagctcattgatttggacacccagctgggtgcacctttcagcttcatttttgaaacttcgagtctgtgaaacatgggctgcctggggtgtatcatgtcaatccagccccagcaacactcacatcatgctgtcttgcctctacttaccctgtgccctgtmaagagcacccttcccgccaccctacacctgagctacctgctgaaacctaccaacgcttctgtttgtcctattctccctttcatttctttcttttcgtttcctgccctctttggctttacagcaggcttctctccccaacaagttccattttattgttcaactagtttaacatgcatgtttaattgaacaaggtcaaatgctagtcaatattttgccctcccaccaaataatagacctttcccactctgatcactcctcaccaatttgttattgttttatggttctttagttttatctcattttttttttcttttttaatttttttttctttttttttttgagacagagtctygctctgtcgcccaggctggagtgcagtggtgcagtcttggctcgctgcaacctccacctcccagtttcaagtgattctcctgcctcagcctcctgcatagctgggactacagatgcgagccaccacgcctggctaatttttgtatttttagtagagatggggtttagccrttttggccaagctgttctcaaactcatgacctcaagtgatccaaccacctcagcctcccaaagtgctgggattacaggcatgagccaccatgtccagcctatttcatttttttctaactccacaaagtggacatttttgtaattattttatgctatcagtgcttattaaatccacttctgtgtttacatatttctttgctcaccattcttacttgaatcttagacttttttttctgagattatttttcttgtttttgaagaacatcctttagaattcccttaggtgagagtctgttagctataaatgctctcaattttcatctgaaaatgtrtcttttaaaccttatacttgaaagatagtcaaggttgacagttatttttttattagtactttgagatgttgttccatcgccttctggctttagttattggtattgacatattagctgcccatctacttcatcattcatccatcttctgtctagtgatcagcagttttgctaccaaaaatgtttggtgtagatttctttttatttatcatgcttgggttgggggagcttccagaatctgaggattgtgtctttcatcaagtctagaaattttccattttcttctagaactctaattagacatatttaaatccttgttccttgtctatgtctcttagcctctttcatattttccaccactttgtcctcctgtgctccatcctgggtaaattcttcaaatctattgttcaccccagtagttgtctcttcagccatattaatctgctgtttatttttatgtatgtatttatttatttatttttgagacagagtctcactctcacccaggccggagtgcagtggcacaatctcgactcactgcaatctctgcctcctgggttcaagcaattcttgtgctacagcctcctgagtagctgggactacaggcatgtgccacctcacctggctaatttttgtatttttaatagagacagggtttcactgtgttagccaggctagtcttgaactcctggcctcaagccatcagactgccttagcttcccaaagtgctgagccttaatctactgtttaatctgtacactgggcttctattttcaaaaattatgtttttacataactgcttgctttttttccctcaatcttcctggtcactttaaatagtctcttgttccttatctatactttcaattaccaacttttaattcttgaagcatatgaaacatccttattttatattatatatactgcaattccaacatctgagatgtgttcgaaggtctgcatttttagtttattgcttggtgctcctctcacctaaagcaccttgtgtcctgtgttttatgatttttctgttttacaaacatgtgaactcatgttccatgggagtttttctgtgggatttctttgagtcatgaatataggatgagttactccagagacaatttttatcatttgtttctgccacgtgcctaaggagctattatttaccttactttaaattcttatcttatctttttgtttgtttgttttttgtgtggttgtttttgccacaaagtcaccatgagtttcacctccaggcctattagtgggtagacttgtggtgaggggcattcagggttgacatttatttttctcccactcagagtccatactgagttgggcaagctctgtgtcagctcgctttaaggaatttttctctccgagttctccactgtggatgttgtatttcagtgctctttgtttaaggcagaaattttggattttgtttttcacttcgattttgtttctcagctttaacttttgtccatgttcataagactgaagctcttggtcaactggatcaacagatacttctctgctggctgtgatctctttggatttttgttgtctttatatattaacatatacaaggtctcactctgttgcccaggctggagtacagcagtgcaatcttggcttattaaagccttgacctcctgggctcaagcgatcctcccacctcagcctcctgagtagctgagaccgcaggtgtgtgccaccaaacctggctaattttttgcaccttttgcagagagagggtttcaccatgttgcccaggcttattgtcgtttttgatctctgatgattttcttcatttctcaccacctcagctacacattttaaaagatggtttacaatatttttgtggtgttttgtattaggagaattcttcagcatctgctgtctaccatattgtcagaaatggagtctagccatccttcccggcccatttcaaacgggttcctcttaggaccaggagacctcacattatgtgtgtcctaccttggcctgtggtttggtcacttgtgtgtgtgtgaacttcatcctccttgagggcaggaatatggtttcctctctttcrcttccacagagtcctgtccagagttctgcacaccaagactgtgtaaatgaatggaattgcatctgggagctcgaggcacccatgcaaacctgtgctgccagtgacttccaccagagggcagcggcagcaggtgccggcgctggggcaggactgggaggagtctcactctgggggcgcctggttccccgtggctctaatacttgccgcatcaaatgcatacacccacmtttaggaccgaacccaatggaggaggaccgctcctcattccacatgttggggaaatgaagacaagcaaggatgcaggaagtggagggccaggagaggtggacctgggatgggaccaaytgaggcagggccaggatttggaaccaaaccccttctggatttgaccacttccagggccctgcttggacaaccaaattatctattccttttctcattcaataaacatttattcacctcctaccatatgctccacagggagtaccatgggaattaaacacgcttggcccctgccttcttcctatagcgtcagtctgctgcagtgcaatggggcaactcggggtttctcaggcagccctgggcttccttccttcagccctttgctcctgctattccttctggcccagaggcctcccatgattgctgtttgtcaaaatcctgctcagccttgtagacccagctcccatgcctgactcccacggaggcatgcccagtctggtacctggagatgggatagctggccccactgtgccatctgacggggcggctcccacaaggccttggcacccttccctgtagaaggacttgtgggatggccatctctcaggcccttcccaatttatatttctctgaggggagacttaggctcttatctccaaaagtgcatcaagaccacaccctccttcccaaccaccattgcacctaaggttaagataaaactcaggatttaatccaagagagccaaattacacrgaccgggacaggcaatgggtcattcactccctcttccaatatgtactgattgagcagctactacattatcaattttttcttctgggccaccagaaatgaggcatggctcttccacttcccttcttcttagaagaccctcggggaagtgtgtctgcatggatgcgtgtgcatgcgtgtgtctggctccgtgactcttggggtgcagcctggatgggtgggctcccagcacaggcagctggggctctccccamcagcccctgtaacagcagcccagcttcctgcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcrggaccactgatggtggtactttcaacgccaaagctraggcttggggtccagcaggcgtaggccaatcacaggagagcacckcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacwtgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtwttttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatgrtagtccaaattgagatgtgtaaagtgtaaaatatgcaacaggttttgaagatgagtttcaagaaagaatgtaaaatatttcaacaaattttatgtgatttatatgtcraacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccactkcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattrtagtgtacccagcactggagygttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaacckaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccasctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacaygagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcayctgaaaatagccgaacaaaatgcagtgctcagaaatgttagcttataaatgctctacagcaagaccaaagataatcccttgcctatgtgaatacaggactcggtggttaayatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcaygccctcatggggtttgcctgggggttgccctgcaccttggggccagsaggaaggcaaaattaaagaggcaccatgagccagrggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtrcctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtgrctcacacctgtaattcagcacgttgggaggccgaagtccaagagttccagascagcataggcaacatagtgtgaccccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggcmgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcstatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggcygtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagasggaggcagagggaagcccaggttcccaccctccattttgtaggctcctgcagcccgaacgccttctgcctgaaaatggcrgctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcggggggggggttctgtgcatggggctggggacagcagatgcccgggtggggggsgktctgtgcatggggctggggacagcagatgcccgagttggcgggggggggggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccayttggtgtgctctcgttttgcctccctccctccttcaaccaaactaaaggatgcacagttgccaaatggattcagctccttggagaaatatgttgctttgccgggatgggattctagaagtatgacaatgtctgagctgsaagaaaccccagcgagctgccagccatctcctgtttgtcagaggaggaaagcraggtgcgaagtggggaacgacatgccccagggtcttggagcagggctgagaagcccagtctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgaktctcgtgcctcagcctcccgagtagctgggactacagtcccgcaccaccacgctagtttttgtatttttagtagagacggggtttcaccatgttggtcaggctggtctttaactcctgacmtcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagatttkgccaatggttccaataatatcttctaagacaaaagaaattttgttcagtatgctgcrtttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttmtctgctgtaaagataatttcctcctttgtaattaacatgtatcttgtgggtagattctttgagaatatgtaartatcttactcttcctcaarcctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtcygggtcagcacctctccaccttagggctagttctccctccatctttacarttttgccattcatttgttgagctactagtatgtrttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggytgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactcctttttttttttttttttttttttttgagactgagtttcgctcttgtcrctcaggctggagtgcaatggtgccatcttggctcactgcaacctctgcctcccgggttcaagtgattctcctgcctcagcctcccaagtagctgggattacaggcatgcaccaccattgcctggctaatttttktatttttagtagagacggggtttcgccatgttagccaggctggtctcaaactcctggcctcaggtgatctgcccgtctcagcctcccagagtgctgggattacaggtataagccaccgcacccggccaccctctccttttataaacytaagtttatttgaacttagaaatctgtcactatcatgtatctcaaaccaatactacttaagtaaatagaatatatatatatataaacaaagaaaacactgaaaccaaaagtgtcattaaatagcytgccgtccaagcatgmgctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctstatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccatcgatttcttacccctgagaactcctactcatcctctaaaacccttcccaattgtyccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagrggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaaggggrccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatckctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggygcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagawtttagaaaatacaaaaacagaaaaatttaaaaatttatcaatagctaccttcaaagataactgttgttactagcctcttgtagaatcttcyagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacaccyggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggaggctgaggcgggcagatcacctgaggtcaggagttcaagaccagcctggccaacgtggtgaaaccccgtctctactatatatatatatataatttatatataaatttatataaattggaccctattgttctgaaacttattatacttttctccttgttttcaaaatctaaccaagtggatagatrtgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttctttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatrttcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatrgagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggctttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctyattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaaygagagaaaagggatgaaagcctcaggttggaggataataacaacmacagctaccatataccgcrtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaacygaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacrcaggtgaacatcatctgtcctgtgacataggggcaaaagaaaggtaaaaaggctgaatttctggccgggcgcggtggctcatgcytgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaaaaaaaaaaagctgaatttctttgacctgagtgactgcagtcctctgggrctgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattayttgtatgagccagcgcatgcgtcttyttttttttctttttctttctttcttttyttttttgaaatgaagtcttgctctgtcacccagcctagaatgcagtgctgcaatctcagcacactgcaacctccccctcccggattcaagcgattctcctacctcagcctcctgagtagctgggactrcaggcatgcactaccacatccagctaatttttgtatttttagtagaggctggatttcgccatgttggccaggctgatctcgaactcccgacctyagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagcmccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttargcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctrctcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggygggcccrccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacrtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctmacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcataytgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcrgctcctgacgcccaacccagtgaccctctccactgtgcccccaacaatgctgacattgccgagaagagacaccctgacctgccagccacatgagctcttcaattcttccctgggaatgagtatggctttagctggygtggccacactgtctgcccaggtgctctctgcaggctcattggagcagggtgactgggtagtcagtatgaaagctcactgtattagtacttcaagctagmccacatgtccccccaggaaaaaagccctgtgtatttatttggggacttttaatttttatttgatatagaacatttgaaaaaattagaacaacacaaggcmgaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcrggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagkagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggatargttcccagatgtggaattactggattgaaagagcttggtttgctgttgttgttaaggctgttggcatctgtgtttgcaaacactttctgttgatttttttttttaactatacttctagcaggtgacacrtgcacctggctgcaccacttgtagattccacctccatgtttccatcgtccctttccaccctgcctctggctctgtacagcatctcttcatccatcatccactcaacgagcattcaggatgcaaccgtgttttcctcagcayctctgacagtgccggaggacagaaagtaacctcaggtgtagctggtgttgaccwgacactggtcactgggcacggccagrgcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtctttttttttttttttttttgagacggagtcttgctctgtcgcccaggmtagagcrtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcrtgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaaygtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacwttttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaaccaaacagaaactttattgtctyatagttctgcaggcgtggaaagcccatagatctaggggccacatctgatgagggccttctctctgcatcataacacaatggaaggcgtcacatggccagagagtgcacgagagacagagcgagggacggtggaactctcacttttacgacaaaaccacttctgcaataaccacacacccctgtgataacagcattaatccgttcatgaaggcagactcctcatgacctaatcaactcttttctttcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgacyaatttttgtatttgtagtagagacagggtttcaccatgttggccaggctggtctcggactcctgacctcaggtaatccacatgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaarcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggatagggratgggagaatgcttgacacaaaaataaagccctcgaggttatccgctttcaaccagctgccttggagctggcagctgctgctcactyattcattcaktcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccargggctcaggctgggcagmcagccagggagttagcgaggacggcaattagagggctgaagactttctgcctgatgatgaagaggcccacacggtttcctggagagggctgtctgccagggtgtgcacgcgcacatgcacaagctcaggctcagggggtatgtcygtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcayatcttcgctctcctcacttctgcctagctctgctaaggctccccattggctgaatctgacmgaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggcyggatgyagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatcygggaggtggaggttgcggtgagccragatcaagccattgcactccagcctgggcaacaagagcgaaactctgtctcaaaaaaaaaraaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagytgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccscttcacaatcctccaaggttccctagtcactgtgacagcctctaggacagtaccctcagaggagcagaggggccttcrggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtctyagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgkgttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcaygcccggccgcgggcctatccacygggaccaggtgaactgctcgggggccgaagcttacctgtgggactgcccggggctgccaggacagcactactgcggccacaaagaggacgcgggcgyggtgtgctcaggtcagtgggcggagtcrctgaagcccggtcactaccaacactcaccataggcctactgggcgccaagcctggagttagtgccggagaggtggtccctgcccttgagatgtcacagttcaggaggggagatgagactgagacaaacatrattcaggagagaaagtggyaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccrgtgcctctctttgataagcaggagatgggggaggtgggggtgttaaaatgtagattctgattcagtaggyctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcrctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcarccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacycaaggcctggcacacagtaggtgctcagtaacatgcaytgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgayaccacctcaagcaggggtcagggtcggggcagcagggggagggtgatcttggcccagctgggtagcgggaatgccrgcacacagccctgtgttcataaccggccagacactgggcctagggctttatagccattatttcccaaccctttaatcctcttggtagccaaatgggagaggtyttattataacccttacatcaagaaaggagctgaggctccraggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatayagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggccctyggtccatcagcccctccctcrgccamggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagrgttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggagggrggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggyaagaagaagggtgagtgcccrttcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaycccagcagcagtggcrtggtccagcaatraccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcarccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaaggktcagtcattcatcctttatgatatatggatttatacctcttgcagaggaatttgagcttaatcmccttgcattatgaatgtattcaatcacctttatcgsaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatartgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagamcagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgcygttcatactctaccatcyctccctacrcctttccgcccaccactttgccatgccctcgactctgttctctccccagttttcatgctgcccatccaggtccaggccccgccccctgaggactcagactctgrctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctcygtgtcccatcctgccctgtctgaccccatcagccccactcacttcctcacctccacgctcttgccagcttgtgcctcatagccagctcttttcattgccttctggggataggaagaggaaagataaygctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaaygatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccrcctgctaaccyagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccrccgcctctgcttgcagattcccagcggcatcgggtcacagatgaggaggtccagcaaagcaggttccagatgccacccttggaggaaggtgagtcaggatgggraggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcrggggaggattactgcaatagtcccaaaagcaagctgcctccatggaacccccaggtgttttcttcagagaggagttccttcctggagcagcccccaaacttggagctggcyrgcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgakcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggctyccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaccagggcgtggaatgacaatttcttaaacctcatagaacccaggctgcatgtgtgtgtgcacgtgtgtgtggcatgtatgtgcatgtgtgtgtgtgtgtgtgtgtggcatatgttggatacaaatgagacaaagagttgagctcaaatcttttatttgggaagtaatcccagggagcagcagtaagaaaatgaggaagaaagagggggaaggaaggaagacaatgttcatgaacaggttgctattatgggcagccagagctcaatggtgctggggacctctgggagacacacctcagaattgtcccaccaagggggcagggagctgggatattgacccaccctctctgcctgtcattggttgaggagacattaacccccagccccagcactaccgagcggcctgtgagtgagctgggcacacgctgtgtcgggagaagccacaggcagagggtcagaggcacatgctataaggaaccatcttccatgggaatggtccaggaaaagcaccaacagcaactgctccatgttcagagtgtgtgtgtgtgtgtgtgcatgtgtgtgtgtgcgtgtcagggagaagtcaggttgtggcaatggtgggggcaactctatctgtttaggaggaaatgctagggaactggaaaacccacggtggctcagcaccataaaaaacactggggaggccgggcaccgtggctcacgcctgtaatctcagcattttgggaggccaaggcaggaggatcactttagcycagaagttcaagaccagcctggacaacatagtgagaccctgtctctaccgaaaaaaaaaattgaaaatcatccagtatggtggtgcacacctgtagtcccagctacttgggaggctgaagcagggaggtcgcttgagcccaggaatttgaggctgcagtgagccatgaatgatcacatcactgcactccagcctgggtgagagtgagactctatctcaaaaacatttttttaacactggggataggaaaacagaacctgacagactgagaggcagggtctatgagaactcaacctcactgcctccctgggctgctccacagcagccctgggctcagcggcaggggttactgcactgaatgagttcccgcctgagcccccaaatcttcaaaggtagtataattccagggagttttatgcttagagttgcctggaaaaggattgcaccaccccagaaggaagtggggatgaggctggtggcgctggaggggactggagcggatccgcactgagaaatcggcattgcctccagtcctctgcccattcagggctatgactttatccctgctgccatggccagtgcccagctctgcctgcggggtgagggttggggctcaggttttctccgagccgtctcgggaggggcggatcatgaaggaggtggggctgtgtggtgggcggggcctgctttccattcacctgtcccagaggtggagagaaagccgcgctccccagggcaaccgtcacaggatgtggttggcagtgttgggccccctcctcgggccctctgaaccctccccagggtggcgggggattcctaggggaggagccacttctggggtaggtggggcagactcagcggcagggggcttgtgaaagcctgtgttcaactccccactccacccctcctggcagtgtggcctcaggcaaatcactcaacatctctgagactttgtttgctgtaagttggtctgtagaatgtgtgggcagtagtgggtaactcacaggtggtggtgagggttagagggttggtagtaaatgaccccgtcattggtagattaatcactgcaggtgagagcgctccttaaaaggagaaaggggaagccaggaggcactcagcagtgcctggggtcttcagtgcgttagtgctgggggcagggcggggcaagggttgggggaacatggagaatgtcttgtcccactctcattttacaggtgaggacactgagacctagggtgggaaaggacctgtccaaggtcactgagagttagtaacagagtcacaattcaatccttccccacctcgtgcccgccccagctcacacagggagatggcaatgccttctgagtcacccccatttccccaacctccccggagctgcctctctcaccccagctctcccacccagggccccccacagtctctgagaaattgggaagctctgccctagccctgggcagtctgaagaaacagcaccacacacagtaggagggctgatcccagctggcccctgtctctatgtctcccagggactcagacctgggacctgcaccttattgagccgacatgggccaggcctstgctgagactgggaaagctgagatgaatgacagccaggctctgacctgaaggagcaccagcctggcagggaagtcacaaacataagcaggtggcttcccctccactcctgggagacctcattataatacgcctcaaggatctgggacaggaaacacaaagaggctcaatggacttggcagcggaacccagtggttccagaaacattggcgtggggggaaaggctgtgtcccagaacggaagcacccagcaatttgactgacagctctgcaagctcaggcagagagtgatgcacagggaattcctgggaagctgatgcctgatctgggttgtagaggatgaataggagtgaaccaccgacgtggagagggaaaagcattccaggccaagggaatgacacgagcgaagacacagcaagaaactgcacggctcgcgaggtcaagggaggtccagtttgagaggagatgaggctggggatggtcaagtctcacaccaaccccatttcatgggtgagaaaattgaggcccagagaggttaagtaaaaagccaaggtcacacagctaaataatgacagtgctgggacttaaatacagcctagcttcagagtctgagtgttaatcatggctcttccagtgtccctgtgccaccacagccacacrgctgggcattattaccagagccccagcctagaatctggagacaccggcctatctgcccaccaacagcacaggcaccggctgcattctgggatacggggttcgggaatgtagaatcatcactaccaggcacccttatagagccagctctgtgctgagctctgggaggcacagaaaggaatggagcctggcccttgccgctggggagtttacaggacctggggcagagagagaccagtaactgccgttcatcaacatggtgatgatgacggtgggtagcatttactatgtgccaggtatgtgttgtttcatacaatcctcataagggcactctgagaaggtattattctccctaattcgtaaatagggcaactgaaaccccgagagattagatgactagccagaagccacacagcttggcaggtagcacaacttttccacctcactgcaaagccccagtgtgaaaacaccacgccgcacagcgagggctcatgataagcatgtttaacccacatgaacttaagtgtgtgctcagcagcaaacagaaagacaaggggcaacccagcccaatatttcccttggttgaacaaacacccaggaggagacagacaggagctgtggagcctccgttccctcagatcctggaagccgttcatcctgtgggtaccttgccatgctgggtgagattttagctgttggggattcatttttcatacacggtgggcctgaaacaaagcccaccatttcaacgagctgctctaatgctgcagggaaaacacctggtttggagccagagcagggcagactcacatgcaggcgtcttcctaagggagtgttctttcctttccctcactccctccctccctgtctgccctcctccctccctttctccctccttccctccctccctccctccttccctaccctccctccctccatcccttccttccttcttctttccttccttcctcccttccttctctttctctctcttttcttttttttttcttttctttttttttttgggatggagtctttctctgtcacccaggctggagtgcagtggcagagtctcatctcactgcaacctccgcctcccaggttcaagcaattctcctgcctctgcctcccgagtagctgggattacaggcacacatcaccacgcccagctaatttttgtatttttagtggagatggggtttcgtcatgttggccaggctagtcttgaactcctgacctcaagtgatcgtcctgcctcagcctccgaaagtgctgggattataggcatgagccactgggcccagccctttctttttttaaaatgggaaataccttaacmktattaaaactccaacaacatgaattcataccattaaaatcttgccccctccaccctgccccttcctccccacccggcccacccaaggtaaacacaattgtgtctctgatgtagaaagaagcagatgtgaacccctcttgctgcctaccccttcttatacagaaatgacgtccgggcaccctcttgggctccttgcttctttttacttctctggtatcccagataacgttcctaagggaagagtgatgctacccatatttgagtttctcccacatgctgtccaagcagataacttttgcctcatgtagggctccaccacaccactacagaggctgtgtggacagagaggaagaagccactaactgccagggtttagtgggaaaagcatgacaaaagagggaacaatcaagtcggccattgaaggttgtgtaggagtttgctggatggatgagtgaaggatgttctcagtagcaacacgtgcaagtatggtgcatgccgcctgaaggccaggggaaaagggggtgcgcaggtgggaaagaccatggggagcatctccaagggtcttgtgtaacttgacccttgtcattgtcttagacctgctgggagttgcgagcagtttctaaggcagggaagtgatccgatgagacggatgctctagaaaggttgccgctatgaagcggagggaggtttgatggggctggggcctggaggaagggaggccagctggggggtggtcagcactgggagatggagaagagggaacgagttggagacggattcaggacttggagagtgatcacagacatgggagatgattttccaacacagcagcctccagccatgatgacaatatgacggtgacattaatgatagcttcgattcctgagggcacactcagaacctgtgtgtcgggcactgttctgagcacactgcaggtactgactcatgtatgctctcaacagccccatgaagaaccagcatcatccccatcttatgactgaggraacaggctcaagaatgttcagtttttcccagggctatcagctgaacatggtgtggctgggccctggctgccactgcccctgccctcctcctttccatgtgaaggtacaatccacaccaaaggctcacttctgtgcctcccaatgcycagctggagccacacacagctcttcaggccccacaattaattggcatcctccagacatctgagagagcccaaggggaccaggtcaggagcacgctctggcaggattatcccaccagggcccacatggatgtggctctcaggctccgaggctgctcccagggagcacaggtactggctttccttccttggcagggcatcacctgcgggtccctaaccttgtcccctggaaacctcacctccgacgtacacctgtccatcccccacccctccctatcgccccatctgcggtttccacttccgcccctctcaaagaccctyttsatggttctggtgaacggacagagcggctggagcccgtgtggccacctggcgtggacctctcttggccgccrtccccggccccccgtcctcgcttcgtgaggatgggatggagtctccagagtggggaggtgcaggggagccccagggaagggatgggttgaaagaagcttcagtggaaagttcatctcccgccacatccttca

SEQ ID NO: 13360 - DNA, 52520 bp, Homo sapiens
  misc_feature (1)...(52520): n = A,T,C or G, or insertion/deletion polymorphism (see Tables 1-2)
gactctaagcgcttcataccacacctacaggaaatatctagcagccagttccatgctcagtttcttgaagcatgagattccaggcccctaatatggcatrtgactgtgggcartacagaggcctcaattctcccatctgaaccatggggaaggtccccccgccctgaatcccctacagggctgagaggagggctctggaaaccttgaaaaggactttgtagactctgagctgggcaccctcaaaggcttggttaggarggagacaagagaaagaattaatccacttccyrccaaggaagccaagagctgaaggagaaatggtccgtgtcctcctccagggcctgcccctnagcatggttcctccctttgttaggagggttaagaacttggccaagtctcagctccactcatctctggctgtatgttctttgtacttcccctctctgagtgtcgggcttctcaactgtgaaatgggggtgataatgataacagccttaccaggactgtagtaaggacaagccttggcccattggttcattgtcttagtctgctcctgttgttataacaaaatacctcagactcagtaatatataaacaacagaaatatgttgctcatagttctagaggctgagaaatccaagaacaaggtgtcagtagattgggtgtcaatgagggcctgttcctcatagatgacgtcttctatgtctttacatggtagaaggggtgaacaaactccctcaggcttcttttataagggcactaatcccatttataaggatggagcttcatgaagtgatcgcccccaaaagtcccacctcttartactaccacattgcagattacgtttcaatatataaattggaggagacacattgagacacatggatattggttgaataattatctttcttttttctttttttttttttgagacagagtcttactctgttgcctagactggagtgcaatggcacgatcttggctcactgcaacctctacctcctggattcaagtgattcctctgtctcagcctcccaagtggctgggattacagatgcatgccaccatgcctggctaatttttgcattactagtagaggcagggtttcaccatgttggccaggctggtctcaaactcctgacctcaagtgatccgcccacctcggcctcccaaagagctgggattacaggcgtgagccaccatgcctgccctgaataattatcttttgacacctggtctgcaattctcatggagtttccggtctggaagaagagtctgtatgtaatgtgtttggcacaggtaggtgcccaatgggtgggtagatggatggatggatggatgggtggatggatgagatgagtgacttactgcaggtctcacagttataaagtaactcttcctgatagctcacactggccaccaaagacacattaagcactgattagagaggtactccatggaccaaattacttgagcaaagtcttagaattaggaattattgcagcatggataagaggcattcattttatgttctcttttagtatttttcccaacaagatcctgagaaggaggatctggatggaggttctgccagagccycctggagcagagccaggaagttgagtagggagtagcgccccacagcccatatgagcaggcaggagcaggccaagcctgagggtcgggcctcagaggcctggcctggccgtatttagttttcaaggmactggaaggcttctcacctcctctgctgtccaggcacagaagcaaggccacccacagttgctgagtcagggaggcccctagggcaggaacagaggccccacagtggggtaacttgaacacagtggttcagagcctggtctctgtcaagaagatatggtgctgggaacagtggtgtgtccctgtggttcgygctcctcggaaggctgaggcaggaggataagcctagggattcttgagcccaagagttctaggctgtagtgtactatattgatcgagtgtctgtgctaagttcagcttcaatatggtgacctcctgtaagcaggggtgtctaaggaggggtgaacaggcccaagatgaaaatggagcaggtcaaaactgtgctgatcagtggtgggattgtgactgtgaatagccactgcattccaccctagacaacatagtgagactctgtctctaaaagtaaataaataggctgtgcgcagtgggctcacgcctgtaatcccagcactttaggaggccaaggcaggcggatcacytgaggtcaggagttcaagaccagcctggccgatatggcgaaaccctgtctttactaagaatataaaaattagctggtcatgatgtcatgtgcctgtggtcccagctactcaggaggctaaggcaggagaatcacttgaacccgggaggcagaggttgcagtgagctgagatcacatcactgcactgcagcctgggcaatgagtgagaccctatctcaaaaaaaaaattaattaarttaaatttaaaaatgtaaataaataagtaaataaataaataaaagctgtgggttcaaatcctgctcaacaaccaatagctgtgtgcctggcctacatatcacctatcagagcctttgttttctttatttgtaaaaacaacaacaaaaatggcggtaaaaacaagcaccattactgagttggttatgyacaagcctctgctaagcaccttacctgcattatcttatttaattgtcatcacaataaayaagtattattattgtcctyctgaaacaaartacatgagaacggtgtctctcatccatgctgccgtaatttctaacccaagccsctgctcatgcagtcccatctacctggagtgtatctcttttttttttgagacggagtcttgctctgtctccagctggagtgcagtggtgcartctttgctcactgcagcctctgcctcccgggttccagagattctcctgcctcaacctcccgagtagctgggattacaggcaagtgccaccacacctggctaatttttgtatttttaatagagtcggggtttcgccatgttggccaggctggtctcaaactcctgtcttcagatgagccacctacttcrgcctcccaaagtgctaggattacaggcatgagccactgcacccagcctgtaaccaactcttatgcaaccttcagtgttcagtgtaaggtatccaaaaagttacttcctgactgtgagacctggatttccaaatraggaagctgagtcacacagggtgagatcacattcaagtaagagacagagctagagaccgggtgcagtggctcacacctgtaatcccagcactttgggaggctgaggtgggtggatcacctgagctcgcgagttcgagaccagcctgatcaacatggagaaaccctgtctctactaaaagtacaaaattagctgggcatggtggcgcatgcctgtaatcccagctactcgggaggccgaggcaggagaatcgcttgaacctgggaagtggatcccatctactcgggaggctgaggcaggagaatcgcttgaccccagaaggtggaggttgccgtgagccgagatcacgccactgcactttaccctgggcaacaagagtgaaactccgtctcaaaaaaaaaaaaaaaaaagacagagctaggaagtgcttacaacttcctcacgcttacctacatttcaatttctgttattgaatcttttccccctcagatataccctatcagcttctatttttatttttatttttattttttgtgatggagtcttgctctgtcgctcaggctggagtgcagtggtgtgatcttggctcactgtagcctccacctcccaggttcaagtgattcttctacctcagcctcctgagtagctggaattacaggcggatgcaaccacaccgggctaatttttgtatttttagtagagacggggtttcaccatgttggccgggctggtctggaactcctgacctcaagtgatccacccgcctcagcttcccaaagtgctgggattacaggcatgaaccaccacacccggcccctagcagcttctataaaacaacactgggcacctgtcccatcccctgctgcctccttcagytccaaattgccaccaaagccttattcaaccctttgcaacagccctgtgcaaaaggtaggctagatatcatccccatgtcacagacggggaaactgaggctcagagaaatgaagcaagttgcttgaggccttgcaaccagcaagaggagaaaccataggtggacaacagtgctgtctgactcccaccccagtgctgtttccccaccacagcgagctgaccctcgacccctcaaccttcccagatgggagacttcacctcaactctcacacctacacaggtgattaggattaaagagaaaatcaacatgagatcaatttgaaaggaagggccctgcaggactaatagggtattttgcaaataagtaaaaaaataaaaataaaaagtaagcctccttgaaaaatcgtaaaagaactgggggaatgaataagctgtaactgttctaaatcagatcgtattcctacaagacacaggagaccagaacagctccctacagccattagctcatctcactcatttacaaggctctctgctgagagccaagagggggccccacccagaggaatcattacctggccagcacttcactgggatttcatgtcccagtaaagttttttcctaaattggggtacacrattgccaacatcttgttatttgtcaaagaatattaaaaggaaaaataaattgctactttctgctgttaccatcatctcataaaattcaataacaaggactaatcccagaatttggcaattttaaaaattacctatgtaagtgactcactatgttgtcctagttttctcactagccttgggccagtgagaactgtatctaagatgggcatttggcaaccctcagatgagtaggagagagaaaacatgtatgcaaataactcagagtagctcattgcaacttgggatgagaaccacataaaactcttctaattacttaatttaaaaaaaaagatttattggaagagggttttaccagaagrttttttggattctgagggttatgtagtgactagggatcaaccaaacaaccactcttggcarggacagaaaacttcaagaacaggtggaatcagcccatttgcatgcactctctctctctcttctctctctctctcctcattctgtgtctctgcttctctctctgccttagctgtcttctcactctagttacagacagggttcctccatgtggcagagaacatggtggctaatgttaccagaaaaactctgaactaggtacggtggcacgagcytgtagtcccagctacttgggaggctgaggtgggaggatcgcttgagcccaggagtttgagtccagtctgggcaacatagcgagtccctacctctaattggcggtggaggggggggcactttaggcaaattaaatttaacaaagtgtaactgcagaaagagcaattcacaaatccagagccttgcagaaccaggataggttcacagcaactcagagactgccacaagggtcagattacatttatggacagaaaaaggaaagttacatacagaaaacagaagtggggtacagaaacagctagattggttacggttggcattattggtacactgtttgaactgtggtcggcctgcaattggctgaaactcagcagctgtgactggatgagacctagccacttgttacaagagtaccttacggtctgtttacatacctaattagattacagttcacaatgtatggagaaacctttagacccaaattaatatacaacaggtaaggaagaagctttaggttaaacttaactcagtttcagtgagaaagaaaaaagaaagcaactgccacaaaaacagggaaggtgtctgattggcccagctgggtcagatgtctatctctggaccaatcagctgtggggtctgtaacaacatggcagctcccatgagaacggcatggttggagtcagaagaggaagaagcagaactgggcaggtgagctgggaagagaataccatagwtgtccactatggagatgataaatgccctaatagatgcgcacaaaaaatgtcatgggcatttaggggatgaagacacaatttctagctgtgcaactgtggtgatcagtcagagcttcttggaagaggtggcattcgagctgggtcttgaagccgagaatcatctggaacgtacagagattctaaatgccacctcacattagaaaagaaagatgatccctggtaatggagaagatagcatccgaaagaattaaatatgaatgtctcactttgtcaagatttcataggttttttatttttacagatgktgtgtctcgctctccctcccagactggagtgcagtgcgatcatagctcattgcagccttgaactcctgggctcaagcggccctccagccccagcctccagagtagctgggactacaggtgcacaccaccacacctagctatagttttcaaaatttagatataattcatawataaattatattttatagttattttggtgtttaattttgaaataattttagacttacagaaacgttgcaaaaatagttcagagttatcctaaactcttcatttcctacaccttcacctagctttccctgataggaacatcttacctcaccttagtacaattaycagaaccaggaaattaacactggtacagtaacctacataccttatttgaattttagctgttttccttttgatctaatccaaggtccaacattgcatttagttgtaatgtcttcttagtcttctctaatctatgacagctcctcagcctctcgctttttttctcaaatgaccctgacacgtactgttcagtcattttatagaatatccctcaatttgaatgtctgattttttttttggtgattagattgagcttatgcacttttggcaagaatatcacagaagtaacgttatgcccttcttagtgcatcagatcaggggctactttctgttgatatgacttattactgggcatgttaacactgatcatgtggttaaagaggttatctgctgggtttctcttttataattttataataagtgtccttttgtaattagtaattatcttgtggggagataataagaccatgcaaaaatgtaaatttcttgacatttacggtatgtttgtttgtttttttgaaatgaaatctccttctgtcacccagggtggagtgcagtggtgccatttcggctcactgcaacctctgcctcttgggttcaagcgattctcctgcctcagccttccgagtagctgggattacaggggcccaccaccatgcctggctaatttttgtattttttagtagagacgtggtttcaccatgttggccaggctggtctcaaactcctgacctcaggtgattcgcccacctcggcctcccaaagtgttgggattacagacgtgagccaccgcgcctggcctacatttttttttttaagtgctgkcaaatgcatgccgtctacttttcttcagtaaatgtcaactctttacccattatgtgccagtccctgtggggtgtgccaagcagaaaaagcactgatctaagatgtgtggctcagttatgtgtagatccatgaccttgctgggctttaggatccttatctataaaatggatatcattatatcttaccagtaagaactgctgaggataaaggcagaccgtacttgtgaacgtgttctgtaatacaaactagggttgttcattctccttctgcagtgctcagctctggcctctcctctcctgtttrcatttcccttttccttcctgcctgtgttcaggcctgcagacttctgtctgtcctccctggtctaactcccttatcctacttgccaagycttactgtgatgtcatttaataaattttggagacacaaggagcgcctcatagagatggacaatttccttcartagtctcctgctgtttttagagttgcctccaggtgcctgggcctgtgggtgttgggcaggagaaccttcctcctatggcagaaataagtgggagaagtagggattgccttcctccaataataatgctttggccctaaaaaggaaactcttgaaccccatagaatattttattttattttwttttwtttttgagacagagtctcgctctgtcgcccaggctggagtacagttgcacgatcttggctcacgcaacctctacctcccagattcaagcaattcttgtgcctcagcctcccaagtagctgggactacagtgatgcaccaccacgcctggctaatttttgtatctttagtagagatggggtttcactgtgttaccatgctggtgtcgaactcctggcttcaagtgatccgccctccttggcctcccaaagtgctgggattacaggcgtgagccaccgtgcccagccaaaccccatagaatattgaagaagcccaaatggatacttgtgtcttactgagtggacacactttaaagttacttcaaaacatgaaaggatgacttactccatatcaaacctcctaattaatccaacagtaattttttttattttgttttattttattttattttttgagacagggtctcactctgttgcccaggctggagtgcagtggcacaatcacagctcactgcagcctcaaccttttaggctcaagtgatcctcccaactcagtttcctgagtagctgggactgcaggtgtacgccaccatgcctggctaacttttgtatttttttgtaaagacagagttttgccatgttgccgaggccgctctcgaactcctaagctcaagcaatccacccacctcgtcctgccaaagagctgggattacaggtgtgagccaccacacctggcctgcaattttaatctaaggcaggatttacttatttatttagagacagagtctgtctctgttgcccaggctggagtgcagtggtgtgatcatgactcactgcaagcttaaactcctgggctaaaacaatcttcctacttcagcctcttgagtagctgggactacaggcacacaccaccatgaccagaaaggttttttttttttttgacacggagtcttgctctgtcgccaggctggagtgcagtggcatgatcttggctcgctgcaatctccgcctcccaggttcaagcaattctcctgcctcagcctcctgagtagctgggactacaggtgcgtgccaccacacccagctaacttttgtatttttagtagagatggggtttcaccatgttggccaggatgatcttgatctcttgacctcgtgatcctcccccttaggcctcccaaagtgctgggattacaggcataagccaccacgcccggcgcamctgcttcttcttctttttttttttttttttttgagacgagtccccctctgttgcccaggctggagtgcagtggcacgatcttggctcactgcaagctctgcctcccgggttcacgccattctcctgcctcagcctcctgagtagctgggactacaggcgcctgccaccatgcccagttaattttttttttgtatttttagtagagacagggtttcaccatgttagccgggatggtctcgatctcctgaccttgtgatccgcctgcctcagcctcctgaagtgctgggattacagtcatgagccaccgcgcctggcccacacctgcttcttaaaggaccaagtcctggctgggctcggtggctcatgcctataatcccagcactttgggaggccaaggtgggcagatcccttgagtccaagagttcaagaccagcctgggcatagcgaaatctcatctctacaaaccattaaaaaatgttttggctgggcacagtggctcacatttgtaatcccagcagtttgggaggccgaggcgggtggatcacctgaagtcaggagtttgagaccaacgggccaatatggtgaaaccccatctctactaaaaatccaaaatttagccgggcgtggtggtggacrcctgtaatcccagctactcgggaggctgaggaaggagaatcacttgaacctgggaggcggagrttgcagtcagccaagaccgcgccattgcactctagcctgggtgacaagagtgaaactccatctcaaaaaaaaaaaaatgttttaaagggaccaagtccttttaggggagcttctgatcatttgaatctccaataacagaagaggttttcaaatgttaccccggggattcctcattgccygctcccagtattttccaagaaagacctgaggctcctttctgagcttcattcccttgttctcctcccagcccctcagctgtcttttgtaccaattrggtagttattaattgctccctaattgcaaattggctgcctccttactggctcccacccatgctggctggctgaccmaggggtcacatgcatccttcagggaaagstgttttgtgaatccagtggttcakttgttccacacgtgtgttgagccccttcgttgaygccagatcctttctaggtcctggggaccstgttgagcgagacaaacccaagtccctggcttctcagagctcacagtctagcaggagacaaacaacaaaaaaattaatcatttccgatcgtcagtgctrtgatggggagtaattacagkacagagtaattttggggagcttcagatacgtgctctgggaagacytttytaaggaggtgaygtgtgagttaagatmtgaatggtaatcyggagccagccagagtgaagatgtggttgaagagcacagtcccrggggagaagaaagcaaaggcagaggccaggggagagaaagcagcatggcctctctcaggggcattcatytyatctatgaagccctaagsgattcwgaagtcaaacatcaggttgggsctagttgtaaggtttagggcaaaacacccctcctactccctgttgttagaagaccggaggcggggtttgcccccacctggccccrctccagaaggaggggttattatacgtctgattgaatcarcttccagsatccttattggtccttggwggtaaytagggcgctctcttccaggatccttattggtccttggtggtaattaggccactctcgcttcaaagtcccaaattcaggcgccccgctggggactagagcgaccgttccccacctcacccaccccaagctcagaggttggagagaactgcctccccaaaggaacccagacccaggcttgagactttgcaaagagacacaagatggggattgccatgtgaagtttccagattttttaaaatgttagaacgatgaattcgaaaagctttaaaacactgcacaggccaaacaacaagtctatgggcaagacctggccagctggcctgggtgcggtggggcttggtgaacgcctagaggtagggacgagggagagaaggagtcaggaaggatgctaactgcatcctggattctgggacacccatgccctggcagagatgtgccctaagaggaacgaactcacggccacaggcacagattgagcayctaactgtgtkcatggctctgtgctaggatgggggacacaaaacacttcataggactgcaccctcgctcagggctgggtgggccgacctcaggaaacctgggttccagccctgacttgctctcctataattgctgtgtgaacttgggttgattcatcatctctctgggattcagcacacagcctttgttgacattagattaactaaatccagtaagggaagattttgaagggcctctgggtgtctggatagggaatctgggctgggtctaataggaagtaggaaccaccccaggttcttgagcaggggagtgacatgttgaagaggaaagtgaagcaggccacctgtgcagagacacacatcatccaggtgtggggtagtgaggacagcaactgaagcgtatgcaaatcagatctgatcacctctagctcaaaaaccttccatggctccctgcagccctcacatgaaagtcctttcctcttactatgggccatgggcagggccagcttcacgtaatgaagggtcggtgtaatgctctgctgtcactatcttgaaatacttcagaatttttgaacaaggagctccgttttctcattttgcaccaggccctgcaaattgtgaaggttcccacaggggcctttcagtctgggcctttcccctctccccatccaaaccccacttctcccttacccttcatacttcactcacgttggtcttccatcagtttctggagattgttcctgcctygggayatttgcgtagtctgttccccttgcctggaacayccccacccccacgtcgagaccaacttagwtttttgttcaacaatttcttatcttccagacttgagcataattatctcctgagagataactcctctgrcctcccagaactacctgttcaaaacmaaactttaaaaattatttaagccagccgggcacratggctcatgcctgtaatcccrgcactttgggaggcccaggtggkyrgatcacttgaggtcaggggttcaagaccagcctggccaacatcwtgaaaccccgtctctactaaaaatacaaaaattaaccgggtgtggtggcaggagcctgtaatcccagytacttgggaggctgaggcaggaggattgcttgaacccgggaagcagaggttgcagtgagctgagatcacgccattgcactccagcctgggygacagagtgaaactctgtctcaaaaaaaaaaaaaaaaagaaaagaaaacgatttaagcctgagtgcagtggctcactcctgtaatcccaatactttgggaggcaaggcaggagtattgctgaggccaggaattccagaccagtctgggcaacacagcaagatcccatctgtacaaaaaataagaaaattagccagacatggtggtgtgtgcctgtagtcccagctactttggtggctgaggcaggaggattgyttgcgcccaggagttcaaggcttcagtgagccatgattgygccactgcactcctacctgtgcracagagctasaccctgtctcaaaaaaaaaaaaaaaagcaataatggaggcatttcaggcatstgtcagcagccataggtgttcaggggctttgtgcttatgaaggtttgttcagtaacaaatattcagctggagcgggcatcatggctcacacctgtaatcctagcacttcgggaggctgaggcaggaggattgcttgagcccaggagtttgagaccagctgggcaacaaagtgagacctgatctctacaaaaaataaaatacataaaattagttgggcatagtggcatgcaccggctgaggtgggaggatcgcttgagcccaggaggtcgaggctgcagtgagctgcgatcacgccattgcactccagcctgagagacagagtgagaccctgtctcaaaaaattaaaaacttaattaattaaaaaaaattcaactggggaaatagttctagctctctctttctctctctctctctctyttttttttttttttggaggcagagtttcactctgatacccaatctggagtgcagtggcatgatctcggctcactgcaacctccaccttccaggctcaagggattctcccacctcagcctcccaagtggctgggactataggtgcatgccaccacacccagctcatttttgtattttttgtagagatggggttttgccatgttgcccaggctggtctcgaactcctggactcaagcgatcctcccacctcagccccccaaagtgctgggattacaggcataagccaccacacttagccatattgccatctcttaatgaagtaaataaaaccatttacaccacaagagatagagggaagggataggatttgtccaaaacataataaatccccttggccaaattcatggaccctggcagggtaagrtcagagatagcatcatttctgcctatgtggctgacattcattatgtaagtcccatgtaccaggatccccatcccatgcaagctccgtgaatgatcactcccaaccttataaggttggaagtattagctccccattttgtggatgaggaaactgaggcctagagaaattaagtaacttgccaaatgtcacacagtaaagaattgacagagttgggattcgcacctagatctgtccaactccagatctccctgagcccttcactactgcaaaatagctactcaactggcttgctgtatgatttggggcaagttcctcaamctttctgagtctcagattctttttttctttttctttttttgagatggaatttccctcttgtcacccaggctggagggcaatgcacgatctcagttcactgcaacgyccgccttccgggttcaaaccattttcctgcctcagcctcccaagtagctgggattacaggtgcccgccaccacgcctggctaatttttgtatttttagtacagacagggtttcaccatcttggccaggctagtctcgaactcctgacctctggtgatctgcccgcctcagccccccagagtgctgggattacaggcatgagccactgtgcccagcctctttttcttttttttaagacaaggtcttactctgtcacccaggctggaatgcagtgggcaatctctgcttactgcagcctcaacctcctaggctcaagtgatcctcccacttcagcctcccaagtagccgggactacaggcgtgcggcaccaggaccagttaagctgagcctcaaattctttacctataacttgtcccttatttaagctaacacatggtaggtgctgaagttgattctctckctctctctttttttttttttttttttttgagacagggtcttgctctgtcacccaggctagagtgcaatggcatgatctcggttcagtgtagcctcaacctcctgagctcaagcgatcctcctgcctcagcttcccagagtagtgggattayaggcatgcaccactgttgattctttatagatgttaattctctgcttaacacacaygcccctccaactcccaccacacatacagacacagacacacatacasacgcacrcacgcatgcacgcaygcacgccagccccacaacaggaggaatgtaacggaagcaatgytttgtgttctgtaacctgtttccttttcctggacacacaggaaggtcatgttctcatttttcctgcagttagtagagtcacgtgactacataaaggccagtgaaattatacgtgacccctgcgcaaaggcagttaagtgtggatgtgcctcctttgattttctgattccctttccacatgcagaggattcaggaatagattccagggraagcctggggtggaggcaggattsgggggcaaggtcactgcttggaaaagagctccctgggaragccccaacctgtatcagactttgcaggggtgagaaataaactctgattgggttaaaccactgagatatttkgtttgttacagcagtcagcattaattacactgaataaaacwgtgtatcagttatcaattgccacaacaatgctacataacaaaccaccccaaaacttagtgccttaaaacagcaaccgtttttttagctcaagatttcatggattggcactttagcctgggctcagctaaagatttttctggtctcagttgggcttactcatgtatctgtggtcagctattggattagctggtgactgactaggacagcttcagctaggataactagtccctgttccagtggtctcttaggcaggatagcccaggcttgttcacataacagctgcgagagttccaagagaataagtggaatctcttaaggcccaatctcttaacacccaggcttygaactggcaatgccacttccgtatattctattggccaaaaatagtcacatgcctgcctgggcatggtggctcacacctgtgtaattccagcactttgggaggctgaggtggacggattacttgaaaccaggagtttgagaccagcctggacaacatggggaaactcyatctctataaaaattagtcaggtgtggtggtgagtgcctgtagtcccagctactcrggaggctgaggtgagaggatcacctgagcccagacaggtcaaggctgtagtgtgccatgatcgcaccactgcactccagcttgggtgacagagatcctgtcttaaaaaataaaaaagagctcagcctctagaatcacagccctgggcttaagtcctgactcacttgctattgattttgrgcaaatgccttcccctccctgagactgacatttcccttctataaaacaggtgctggggctgggcatggtggctcacacctgtaatcccagcactttgggaggccaagaagggcggatcacctraggtcaggagtkcaagactagcctggacaacatggtgaaatcctgtctctactaaaaatatrtaacttagccaggcgtggtggtgcacaccagtaatcctagctactcactactcgggaggctgaggcaagagaatcgcttgaacccaggaagcrgargttgcagtgagctgagattgtgccattgcactccagcctgggtgacaagagtgaaactgtctcaaaaaacaacaacaacaacaacaacaacaacaaaacacaggtgctggaagagaggagycctaacgttgggggctattgtgagaattgactgagggaatgcaccgtggaaacgtgtgctgtaaattacctattttattacacccaaggtgggcttaatagctgtcagggagtgttagtattatctcaaccaaacccccaatttayagaggagaaaacaagagcctcaggcaggtgatgtgacttgccaaggctgcatagctagggagcagtgatgtccccaccgtactcaagtttgtctgtttccagaagctaaggtcttagcctytctacagttagaaagtcctaggtttgagtctcgactctgtccattatagctgtgtgaccttgggcaagtcacttttctctctgggcctcattttttttcttcgtctaaagaaattagcatctgtctcataatgccatggggaatcaatgggaaaatacaaagaaagtgcttagcagagtgccaaggagggacagtgtgcatgctcagcaattgaaggctgccaagttcctgttatcatcaggggcagtgttccatccatcaaaagggctaagaatagtcttagcccggccaggcgcggtgtaatcccagcattttgggagtccgaggcaggtggatcacctcagttcaggagttcaagaccagcctggccaacatgtcaaaaccccgtctctactgaaaatacaaaaattagccaggcgtggtgacggrcccttgtaatcccagctacttgggaggctgaggcaggagaatcacttgaagccgggaggcaggggttgcagtgagccaagattgcgccactgcactctagtctgggtgacagagcgagactctgtcttaaaaaaaaaaaaaaaaaggaatagtcttagccagtgggggtagggtgaggaataagtaagttactgtgggctaagctttarcccagtgcccagcacatattataaacttcataagcagttgctattttaaagggtttttgttttgttttgttttgtttttgtttttgtttttgagacaaggcctcgctctgtcgcccaggctggaatgcagtacttttaaagttctgaaccctgttggaggccaatatgagaccatgggggaccccaggccccaactggcagtggctccaggcactgcctccgtgccatttggctattaytaggcccggcgtcctcatctcaaatccagatggggatcgagaagggcgggtagggcagggcctggctggcggaaggctgggaacacggcttggaggctgggtttgggtttgggccccaccctgcctgccttcccttgyttgcagctggtccagccgccacgtctacacttggctctgaggttgttgcagagcactccctcccaccgtggccgcctcctctgggaagatgcagagcccttctgcagcctcagcacttttctccctgcccyagagaggccaggcctgcgtggraactctgaattggacactgcgygccttcagaaccrgcaaaggagccatccaccccgctgtctacaggtcttcatgcctccagtgaggcttactggatctgctgagggggaagggcctatatacctgggttcaaatcccttcsctaccaccaacatgcagtgtcaacttggacaaatgacttcccctctctgagcctcagtttctttgcccataaaagggacagamyrttagcatctgctttatagggctrtggtgatggttacatgagtgcatggtatgccataggcactcaatatgtgtcagttatttcatgcttaagtgtgccaggmcctgaggaggaaacaaagttttgrgaggttgagaatctgggatgcasaatggctctgctcctgatttgctacactacctgaagcctgtcccttgtcctctctgggactcagttacctatttgaaccataaggtgggtatctaggactctgtgatgccaagattcaggtgctatgttcagaagtagagagaagggtttgctgggatcccacactgacaggttggtaaaatattcattctcggactggactctggagccaaaataccctcrgcccctgagctgctccagatactccctactctgccagtccagrgctgaacctggaagaatctagacccttcttgttacagttttttgccctaggagggcctgaaggargcsagtcaaaccccctcattttacagatgggcagactgaggcccaggtctccccagtgctcaggyktcatccaagyggagcttccaaatggtggatggtagaatatggtgattaagaacaaatgttctggccgggcgcagtggctcaygcctgtaatcytagcacttyrgaaggtcaaggcaggmrgattkcttgaacccaggagttcragactagcccyggcaacayagggagmcccttgtctctacaaaaaataaaaaaattagccrggcatggtggcaygtgtctgtagtcccactgtgagcctgggaggtcaaggctgcagtragccatggttgtgccactccactccagcctgggygacagagtgagactctgtctcaaaaacaaaacaaaacaaaaaaamaacaacaaaagaacgagggttctgagcctgtctccttatctgtataatggtggtcytayctcacaggactcaagctgtgaaggtcatagtggtaacaaaattgccacacatgtagtataagcatgatcaggagccagtgtccaacccatcaggtagcaattacatagtgtcccaccatgagcctagacccccactccctgmgcccaggcatcagggactcccagaagtctaaagaggtccaggctggcacatccaraactctctccttcctgttccagccccttgcctctcctttgtctgtgaggctgggtctcctggaattcantgctgcccagtgggcatctgaggcccnttctcctcctgcagggccagaagtttgcctggcactrttgcccagagaacacagnggctggatgacatcvtggagatgatggccttgccaaactggtttcccarcaggtcctcagtcccactccgagggctgctggccatgacctaggrykcayccagttctgcacataaggaggaaggtcataccccttggatccagccaaccccaacaagaaccatccacctctaggggctccattctccagcctcacctgcctgtctgttgcccarcaaggtcgtcacaatcctacttccgttcctttgctaatgctgttcccgtctccagaatgacagtgctgtcctggggagagaggcttagagagcccaaggcacagctcctccattgtgcatatgagcaagttgaagctccaagagggccaacccttacctagggttggagccaggggtaagacacccatcacccttcttgcctcctgacccaaggcctgggctttctctgaaggacmctgactgggtggagggttagccagggtgacttagggatgcaayrcagacagcttggtaaaatagtcattctcagacttgrgctctggagcaaaatattacccctagcctctgagctgctccagccacttcccattctgcctttcyrgggttgaacctggaagaacctagagtagaccctttctgtgacagccccttgccctaggaaggcttgaagcagaccagtctaatcacctcattttacagggggcaggstgaggcccaggcctctctggygcccacaagatacattcrtcctgctcatctggyattcagaatccttggcaaagagaaccacccacatttcctgctccgcccacagcctatcctcctccttttcccagactattggtctttgctcacactgttcctmtgccacaaatgccctttcatgcctttccccctcttctayrtgggatgaattttaaaaattagctgggcgtggtggtgtgtgcctgtagtcctagcctcttgggaggctgagatggaaggattgcttgagccaggagtttgaggccatggtaagctgtgatcatgcgactgcactccagcctgtgggacacagcaagaccctgtctccaaaaaaaataaaataaaataaaaacaagtgtgacacacagtttatacaccacttccctaagaagtcttccagagcttcccccatcctagtggcagcaaagtggagggaaggggcttcagcatcaggcagaattccactttagtctgaatgcctttactaggccaaggtgccttcacctccctgagcttcagcttcctctgtcgaatcaragtgtacctatcttgcacagtggtcacctggcagtagtgggagccccacgtctgacatgcaacaggtgttcagcaaatgctggggccctcgtcacgggatgtttactctttcctcggctgtagctgtaaacttccctagcacygtaccggactgccctttgatctctagatcacccccactcccttgcagagaggaagacagaggcaggcgggtatgtctggaggtggacccargcactaagggcttgaaggggcaggacccacacatcccttccatagggccaagggctagtgagcgcatgtgccagacagtaaatccaagcatggaggaactcacctgtaccattcctcctagcctacagtagggcagggagaaaggagggcattagcacaaagcaggccattcattggagctggtgaccgccattcaggcaggccctgaaaatcagaggtggcctaggtgtgccctgcatgaaggggaggtcccaagggacgcgtgaattttgaagtattcagaattggtcttagagggcgcctgaccctcgttctggataataacatggcatctcgcccaggtagagaaagcctaggaccttsaaatatgtcctccgaagtgagctctgtttgcctctcctgctgtgtagcattgacaagtcgctttcttctgtgccttgattttcttttttctttttttgagacagaatcttgctctgtcgcttaggctggagtgcagtggcacaatctcggctcactgcaacctctgcctccaggttcaagtgattctactgcctcagcctcccaagtagctgggattacaggtgcatgccacttgcccgactaatttttgtatttttagtagagacggggtttttgccgtgttggccaggctggtctcgaactcctgaccttgggtgatccacctgccttggcatcccaaagtgctgggattacaggcatgagccaccgcacctggcccgtgccttggttttctgatgtgtaaaatgggaccacttctcaggggtgtggggatgaaatgaaatgacacatggaaaagactctcagtgtggagactgggcctttccttagatgggggctggggggtgtcacagaggacctgaaccggggctcttctgggttaacaggctgaaaccacctccccagaatcccacattatagtggttaaaagcagggtctggactcagaaggtgctgggtatgaatcacagctttactacttatcagctgttgtcctcatctgtaaaatggggcaatagtcatggtctcatgtgcttgttatgggcattatatgcctggtacatggcaagtacaaaataaatgatttgttattgtttttatttgacaggactccagaccccatcctcccaactccacccactttagtctccatggagacccaagggcggctttagggcctctggcactgaagatggaatagctttgccttgtggatctgacctcctgggtaccctggctgattccttgtttggtcttggacatgtcagctctctctgggcctcaatttcccccttttgctgaatgacagcctggactccatattccctatttaggactccagcgctcctaaaggcagactctcagggcttggaaggtagaagcatgctacaagaaggcaatgtctgttcaaaggtgtgtgggctgggggaggcgtgctgtgtgattgattctgctccacctgagatggtcccggcactccaacrcagggtcaaggtgctgccagtcactcagtccctgctctgaggtggctcagaccaggtgtcccgaaagcagcctagggacggcggccaagcttaaacactgacgcgagaaaggggtggagtcgagggaggggacgtggtctcaggaacaaagaggagggcggagaggggctgtcctgaaggctctgagactcctacgaccccaggaaacttacctcggctcggggcgccccccccgacttggcgcagagcctgcgtccccctgccgatgcccacccgactcgctaaagccaccgaggcagacgaccccaagactcccaatttccgacctccctggcccgcgaggggcggggccttccyctcggggcgtggccgtcaaattgaattttcccaatggggcacgagagtgggaggtacccaatcgagggttggctggcgcgtcggggcagggcggggccagccgggctgctggcgcggctggacgggcagctctccgcagaatccargggacggttgctgagcgggcctgggacagcgggtcgcggcacctccsgcctgcgcgtgtctaatccgtctgtcgggtcccgaaagagctaagccgagcctgcgccggacgggtgggctggactgagaggtgggtgtgcggacctcgggggggatcctggtgctgccccaacgtgtccgggggtggaacccggatgtctagacaggagttstggaacgtccagacctgggagcccccacccatacgagargtctaagccatgggataaagttatgagactgttgggggaagacgcccccggattcctaagagactccacgccccacaggggcgctagtctgtggcggcagaaaccctggggaagctgccacagaatcctgaggcccctcacaatgtccggcgaccccagactgtgtgacagggagattggagaagagcagcggcagggatcttcttataatcccatgggtgtcctagattaggcattagggtcagctgccccatagaagaacagacatggggggaatcagaatgtccgcagaacctaaggctggtgaccactggacagtcttgaagaggtttaacccakacagagtaactaggtaagaggcaaggatcctaacaggcagagattgggaggttgacacctctgagcctaccaggatgggagggggaacaagcagtgacttgaacaggctgggacccacacaccccaactgtgtggagcggtaaccctcaccccccacccatgcaccgtatggggtgacttcccaagtgactgttctgaagagagggaagggatgattgaaagatgaatcaacaggaggtggggggcaggcctggggccacacattagtcagtcaccatacattaactaagcatccacagtgtgccagaccagggcccctcaaattccagacagacattagttggggctacaggaggaaggagagatctgygctgggaggctgggccaggatttaggggtccattttgatgggcagcactggggcaagatggggctcttgcctctgtcactgagagtgttccaggcccttgagggcactttggaagggagcttcggaagccggagatgacgaagattttgattacatccttctctgccctctaagtctttggcttcctccttgctcagtgacaaatccttggccctctccaatcttctcagtttgcctgaaatccaggggttgggcaggtcagcttctgaaagcccttccaggtggggaattgaattctgtatgaattggcaggaggtgctgggtgcctggacacctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcrgccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagaattctctgagctggtgacaggtgccacaggcactggggatctcaccagaaaggaaccgacggagctagrggccagcgagatggcggacgaggccttagctgggctggatgagggagcccttcggaagctggtaagtggccccatcacccactgtggggacagraaagccaagccagagaggcagggtcaatccagggtacctctcagctgacaggaagaagtgatgggggaaaggtcaggaggagggggacatgggaacaggggtaggccagttccatgtggctgatgcagaggcccttgtggcatgtgcctgtccatgcctggtactgaagcctagtccctcccaaccctccacagccaccacctgtttaaacagtaactgctgtagactcgcccgtatgcagccacaggtgtggggaggctggatatgcctctccagagcaatagctcgggcaatgcccacccctggaagctggcccagtgataatggtagcagcaatgattaataatgccaaggcctggcagggggcaggctgggtactgggtataccatgtcacagaataatcacagcagctctgaaagcctgggcactgcgactcaagagagttaaaatcacctgctcaaggacacccatctaagaaggagctgtgccaaaatcccaaccccatagtgggccacgggggaccagagtcctgggaaagtcaaggctggacgaggccataagagagagacaggttttgtgggcccttatggattctgtggyttctcatctcatttttctactcttgagtctcagttcctctacctgtaaaatgaagggagggagggagatgtgtttgcacacaagctctaggtcctagagttggcatggggacagaatgaggcatggacccagatctcagktggaggaaagatgagcccactcyatcccctttcttgttcctcttcctgagagccctgtctacctccatgcacagaggccgtagggcaacccagtggggcagggctccttccccaaccccaaaggccaggcagcctgacctggaggaggggccagaggagctccatctcctcagtccctgacccttgtccatgggggtaaattaaagatttactttacctagaagacaagtgacccaccccactctcataccttcccccgcaggcagaggctggaaccaaccagcgtagcccagccactgggcagtgcccagctgctgccatgacctccccaaggcactctgcctgtatgttctcggaccagcgcattagactctctgggtgtctgcctctccactatcaccgcaggatgtgtgcagcctggaggggatgaggttaggtttccaaaggtgcccgccagtcagttcgaccttccctcaggaagtccaagtcccagtgggggtcgtagaggcagcacagtccaaaaagagggaatgccaggcctggttcccgcacatcctcatctcaaggtatccacaggcaggstcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccmtgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagtacacggagagccggctccccagggggaggaagcaccctctttcctcccgggagaatttcactgggcagtttcggaaaccgccccatccccttccccttccccctcggtagacaatggcgctttgtacttccttccctccctcccacagytccctccttacacagcggtggggcctgggcgggtggaactcgggacacacagaggagacactgtggtccaacctttgcctccaggcccaaagggaagggtcgtgccagagggtgaccagtggaatgaggttgtcagtctscagccttgcccacccactttgggggatcagagggaggctcccattttccagatggggacactgaagctccgggggttgtgctgtagaggtggccaagttcctacatcaggcttttgtcagagacaagsaccccatctccgagcccagagcactgagaatggggacctaggagacaaaaggctascccttgcccctctgggcctctttaccctctgtacagaaggggctggaccctctgtcccctccagcccccagcctccaaatgtaccacagaaggctctaggcctgagacacagccagcaccgggggctggggagtgagcctcattccccccgcctctgctataaggcctccttaggcctcagagcatctctagtccaggctagaggggtctccaacacagtgccaggatccctgaggtccccaccatgacacacagaccccagtagcagagctatcttcagcctagggcaggccctggagtcagagagacctgggttcaaatcctggctcaggtcatttgaccatgagcaaatcacatgtcctccctggacttcaatctcctcatctgtcaaatgggaataacagtagtatctagggtttttgtgggcttaggacaagtagggggctcagcacagggtttgactcacaggctctccataaatgttactgatgcctcggggtatcctgcccttcccatttgcccccttgtctctctccctcctcctgactggctagaaccaagtatgggggtgatgcttattgcaactgcarctatgtacaggagaggccaagtcactgttcccaaccccacccactggcaaatgaaaaaaccaagacacagagagtttaagggatatgctcttgatcacccagccaggattggactagggctggaaccaactargggctctggcctgagtttcagggggtcttctcataattcctcaggaatgtggagcctggagggctcttcccccaagactctccctgctctcttcagactaggacaagctggctcatggctgagttgggccagcccacactccctgctgaaaactatctccatcccatccccacccttgccacctggccttcccgctaagcagaaaggaatgacgggggggcgctaaaaagggagatgatagagggttctttggccctacccctgaatgatttggggggtggggacagaggaaatcaccccgcctttactggctcccgtctggttatcagacccacactggaggcttatctctgccactatcttccaggggaacmctgggccagtcctctctcccttgagccacggaggatctgtatgtagcaggtgrctctacatggtggaggtgtgggggaggcaacaggattggctgactcactccagagaaggtgttctttcctgaacctggttagaccagtcacccccaatttcccgggaactgaggggttgagaaccggtagaagcagctgtcacccagggatgccctctataaggccctggggtggcccctagtgccagccaccttatatgtctgggggattggtcctcccactctgcaccctggcttcttccatggtggctaggtccaggccagtgcagtggggacartagccctcagccaggcaggactcctgagcacctgtcctcagtttccccrtctgtggatgaagcagtcaacccccagctgggctgtggtgtttggtgactagaccagggagcctcccttgctcagagggtggacttcatctgtcacctttccctctagggaccctgttagtgacccacagggtggcctccctcctcctcctacaatagctccctgacttttggggatctgggctctgagaggcaggaatcgagttgtagaaaggagtgcctggcttggcacctggcacaagtgggcagtttctggctgtccactcacagttgtgtgctctgtgaaccacaatgcaaagtggactacccaagatccctgaaacagtgggctgggtctacccccgggaccctgcgtgggcaggcaggcacgtgaagagcttgggacacagggagtggacacaggccacacattgtgccctaggcagagccgtgggcagctggtgccagccctccgcccctggcagccaaaatgacctgccyctcgcacccactgcagstggaggtcacagcagatctggcagagcggcggcgcatccgctcagccatccgggaactgcagcggcaggagctggagcgcgaggaggaggccctggcatccaagcgtttccgtgccgagcggcaggacaacaaggagaactggctgcagtgagtagcggggggtggaacatgcgggtgagaaggtgagtgtgagccctggctcagctcatgtgtgcaggcaggcgtgagcacaagtktatctgtggattgcatgtgctaatggcagtacgtccacacacgcttctggaaaaacagagatgtttgtgggcatggagcatgtactgattgtggcgtcgcggccgtgctgatgtagccagcacgtctgagtgtgtggtattagtgcccacgtccatgggcatatgtgtatcagtgtgcagttagagggtgtgcacagccacatgcccttctgccaaggttctgggtactctgttctggctcctacccttagcccacatcctccacgacctggccatggcagtggtggttacagtcatgatgtctctgcagctctcagcagcgggaagctgagcagcgggctgccctggcacggctggcagggcagctggagtccatgaacgatgtggaggaattgactgcactggtgaggcccaggctggggcaggggatgggggcagggcaggtgaagacctggactccacagcccaacacccgcgacctgtctcttacccacagttgcgaagcgctggtgagtatgaggagcgcaagctgatccgagctgccatccgccgtgtacgggctcaggagattgagggtatgtggcctgtcccggccccacccctgccctgctgtctgctgtccacagcacctccctgtcactcacctgccacttgctccttcccttccagctgccaccttggctgggaggttgtacagcgggcgtcccaacagtggctcaagagaggacagcaaggggctagcggcacacaggctggaacagtgtgaggtaaggagggtgggagagtggcccagtgtcctgtgcccatggataccggtagcacagagtgcctgagtgtctttgctaggctggtatttcactgtaaggggcccacccctgccatccagcctctatttagcagtcagagggatctcccagaaatgcaaatccggccctggcacctcccctgcttcaacccgtcccagggctgcccctcaccctccacacagcccacatctttaccttggcttatggggcctgcatgtcagaccccagctggctcacagttcactctattttccagagtgtgggtgagaggtcaggccatgcaggttccccaagtggccagcagaggccgctgggtccacggtcctggcaggaccccactcccactccagatgaaccaggctgaggccaggagtcaggaacctccactccagggatctattaaggctcccgtccccaataggtctcctgccatacccacccactgacatcaggacctggtcctctctgaacccctttggctaggtagtgccaagagattgggaagtggggatcagagactgcccttagcatgccagtgccagtgcttgcgcaggtgtgcctacaggaagccatgccccaccactctgctttgcatgccctgccctgggcacttgccagcctggccctcagtggtgggggtggcgttcaaagcctagggagccttggttgcatcctgtgggtcccttacaggtgccagagcgagaggaacaggaacagcaggcagaggtttcaaagccaacccccacccctgaaggcaccagccaggatgtgaccacagtgacactcctgctgcgagccccacctgggagcacatccagctcacctgcctcacccagcagttcacccacccctgcctctcctgagcctccattggagcctgccgaggcccagtgccttacagctgaggttccaggcagcccagagccaccccccagcccacccaagaccaccagccctgagcctcaggagtctccaacgctccccagcactgagggccagktggtcaacaaggtgagtctggatgaggggcagggatgccaggcaagtgagcaggtctgggagtcaggccttgctcaggccctgttcttctcccttgcagcttctgtctggccccaaagagacccctgctgcccagagccccaccaraggcccctctgacaccaagagagcaggtgagggtcccagcaggggtagtcacaggcatctttcttcccctccccctgcctccctttccctgcctagaaaatgggctcttgtgcctggcagctctagcttcctcaggtccatgcagtccctsatactgcaccccacccctgaagtgtccccgcccccagctaggccagcctccccctccacccccatggctagaggcctcccctgcagccttgaaaggcaacgggcctcaggcacattcttctccccaataagggagtccacccatctcccagctggagctgtgggcagcactggccaggagggctgtcccccctccccatctgcagaaaggatctgggcacccttcctccagcctaagcctcgcctggcccccaggagtgtccaagtcatcctagggtcagtgtggcaggagaaggaggtgcctgtaggagagatgcagccgagtggggatgccggagtgtgggagatccaggaggggatggagaggtggggtgggggttgagtacaggaaagggtgggaagctagggaggtgtagaggagaggattatgaaaggtggacacccactatcccctgtcttttctctttccccacatggccatcaccccctccccaacctgccagacgtggctggaccccgaccctgccaacgctccctgtcggtgctcagcccccgccaaccagcccagaaccgaggtactacctattctcaccctgcctaggatctgtgcagaccctgtcscacccagttgctgacagccctcctgttccttctagagtccaccccccttgccagcggaccttcctcattccagcgggctggctctgtgcgggatcgtgtccacaagttcacatctgattctcctatggctgctaggctccaggatggcacaccccaggctgccctaagtcccctgacccccgcaaggctcctgggcccctccctcaccagcaccacccctgcctcctcctccagcggctcctcctctcggggccccagtgatacctcctcccggttcagcaaggagcaacgaggagtagcccagcccctggcccagcttcgaagctgcccccaggaggagggccccagggggcggggcttggctgctaggccccytgaaaacagagcaggggggcctgtggcacgttcagaggagcctggtgccccgctgcccgtggccgtcggcactgccgagccaggggrcagtatgaagaccacattcaccatcgagatcaaggacggccgtggccaggcctccacaggccgggtgctgctgcccacaggcaaccagagggcaggtaggcgccccccactgcctccccaatggggatgagtgcctgcaaccgcacttctgcatgcaggacaggtgctgcggccaggactcagggtgtctccaaagggtgtgctgggagcgagggcattatcaaccttgtctggcactgccctcactccacctgatcctcctgacagccacctttctccccactcagaactgacactggggctgcgggygcccccgaccctactcagyaccagtagtgggggcaagagcaccatcacccgtgtcaacagccctgggaccctggctcggctgggcagtgtcactcatgtcaccagcttcagccatgccccccccagtagccgaggaggctgcagcatcaaggtgagcccctcctcaccccaccagcctcaccatccgtcagcctcacatacactgcttcagggtgtagggctagcagggttcctctgctcctcccctactgcacacacagagaaaccgaggcccagagagggaaggtggctgctcacagaccacagccagtcggtggcagagctaaggccagaccctagcatatcagtccctaagtgtgtcggaagcttactctgtactggcgttaagcttcctggatgctgatctctgatccttagttcgaaattggttggttcattcctggtgaacagatggggaaactgaggctcagagagggtggtaagggcttgctcccctcttcctgtggcagccccagtgcccctgcgcccacccacactggacatcagccccgaggtatagagcagctcatctgctcatccaagatcagcctggcccattaggagattggagattagtgattagcatctgcgtcaacctccctgtgggggttgggcagaagctctgaggggggacagacaggcagaggggcgccaatcaggtgaggcagcagcctagcaggtgccttgggaactgaatacgcagcacccttccattattcattcccaagcccaggatccactagccgggagctcagccgggaaagggatccccaagcgggccacccggctgcccaggtaatgccctctgtgctaaaccagggactgaatgggactttggctgaggtgagatggctagaccagctttgggccttctcaggggagacagggagagagtgagggaaataaagcacccttcctttccaaaaaagcaggatccagctgccctctgacaagggattgtgtggggtggggtggggggacccgctgaggcccttgaggtggatgggaggtgccacagtgagacctgggtctgacaccaccaacttgcctcagtttacccatctggaaccaaaggggacaggtgatgtacccataatgtgcttgctcaaagtctgtggttggacgtgagcaccatgggcaggccagagggcatttatgtaagaccaagacactttttatagcagatcactcaaagtcctgcctccctgtgcctccatttcccccatctgttccagctgtctaaaacagctggagttagggtaaagggtaaaggagtacaggctgtggagtccagcagactgattctcacagctaatgtacatggtggctaggccaggtccattccctgttccctgcctcagtttccccacctgtgaggcatggggccccgatctcagtgatcttcagaacccatgcagtcttactgtgctgcaggcctatgatttctgtagggctatagccaggcctggcgatccgcctgcttgggcaggccccccctcccccactgccccttccacggaggagcccagaataggtttctatttgggctgcagctccagctggctggtggcgggctgggaggcaggggcggggcaggcccgctgcccttgcctttgccctcggaccagctgcaaagactcagacactcagccagagacagcagcccctgccactgccccaccattaccccccatagagtccccaccagcaccatgccgggggtaccagggcctgggcctgagctggccgcagcccttgaggagcagttgggccgggcactggaggagctgcgggcggtggctgaagcaggccgggtggcagtgacccaggcagccgaggtagctgtagccaccgtggagccggtggcccgggcagctgaagagctgcgggcagagagagcagcactgagccggcggctggatgcactgagcaggcaggtggaggtgctgagcctacggctgggggtcccacttgtgtccggccttgagcctgagctggagcccagcgagctgctcctggctgccgccgaccccgaggccctctttcaggctgccgaggatgccgggacccccgtggcccacccacctgccttcagcacccgccgccgctcctccaccggcaccacccgcagcactagtctcgtaagtgcttctgggttggtgggaggggtagttttgagccaggctctgcctcctcttgactttaggtatgtcaccaccttctctgagcctcagtttatctatcttgacaggggactggggcactagtgctctaagactagggcaagagggtgccaggctccagccctgaggcatgtgtggcagctgccttggcagcccctggcatgacccaggccccagcccccagctccctgccgccctgcaccctggccagaccaagcctccctgaaacagctgccacctcagctctccttacccttatagcagacggagaggccctgccaggagaggaagggccataatagttggcttggggccttgtcttcaaggggytagggagatgccctgggagggctgcagggctagagactccttagaggatggtttccagcaggggcgaggcagggggaggtggtacagaggagagcttcatagaggtcttggctcagggcagccccagtcagacacctggtcaggagcctacaggccccgggccagccctcttggcaaggtagcaggcagatggggggcaacatgtgctgcctgggcactggcccaggaggacctaggcctcgggaactggcagcacagagcagagcctgcctgggagggggctgggaacaaagcagcaaaatgaactaaggttcaggagttaggctgccttcagctcagatcccaggctgcatcacacttagagagagactgtgggcaagtcagttagctgccctgagcctcagtttccccttctgkttttttttttttttttccggtcttgttttctttgcaacagggtcttactctcttgcccagactggagtgcagctgcrtgatcatagctctctgcagcctctaactcctgggctcaagtaatcctcctacctcagctttctgagtaggtgggactacaggtgcacaccaccatgcctagctaattttttatttttgtttttgtagagatgcggtctcgctatgttacccaggttggtctcaaactgctggcaacaagtgatccctcccacctcggcctcccaaactgttgacattacaggcatgagccactgcgcccggccttcccttctgttaaatagggacagtaaagtccctagtgtttatacaacacttactatggactggaaatcatcattattatcactatccattgtattaatacaattcggggtacgtgggaagccctacaacaaaactgtcagtgcctcttccctgactgacgctgacatggccatctttgggcaggcaggckggcaggctagtggttatttccaaggcgtgccagcaaccctaggatctgcttccctayccattggagacatgatgagtttcacccatacccctgcttaaagtccatgccctctccccaccctgcagatggaascagagccagcagagcctctcgctgcagcagtggaagnggccaatggggctgagcagacccgagtgaacaaagcaccagaagggcggagccctctgagcrctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagarcggaagctcatccgggctgcacttcgtgagctccgacaaaggaagagaggtagagagccagttgccctaccctagatccagctgccccattccccagctgctcccctcatactctgrggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagayagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctaytccgtattctctagtttctgcctgagtccatcaamcccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaccagcgggacaaggagcgggaacggcggctgcaggaggcacggggccggccaggggaggggygcggcaacacagccactgagaccaccacgaggcacagccagcgggcagctgatggctctgctgtcagcactgttaccaagactgagcggctcgtccactccagtaaggggccaaatggggccggcccagggctcagggtgggaacacatcctcccccagccccctgtgcmtttcacatccttctcatcccctgcccctgcagatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccrtgtcttcaactgtgccgtcactttctcttctctgcctgyggctatcaccacccctccatacagcctcccatcccatctcctgatgtccagcccaggccctcacctggtgccccttccccttttttgcagatggcagtggcagcaccatgatgcaaaccaagaccttctcctcttcctcctcatccaagaagatgggcaggtgagcaccagcacccaatccctgaccatagaggagtcagtgccacaggggacctaactgcaaacccgttttacagaggggtgggctgggcacagtggctcttgcctgtaatcccagcactttgggaggccgaggygggcggatcacttgargtcaggagttcaagaccagcctggccaacatggtaaaacctcatctctactaaaaatacaaaaattagccgggcgtggtggcaggcacctgtaatcccaactactggggaggccgaggcacaagaatcacttgaacctgggaggcggaggttgcagtgarctgagatcactccactgcactccagtctgggcaacagagcgagactcagtctcaaaaataratarataaataaataaataaataaataaataaataaataaaacagaggggtagactgggatgctgggaggtaataggtctatagccagggaggggcaaagtgagagttaaggatcctgctctccttgggatctcattttattctcaaccacaccacaggagaggtggatgctcagggaggccagtgagttgcttaggggctcacatctctgagtggctgcaatagcattgaacacttacagaggcctacctaccacactgagctgcctggtggcactgccacttcccagtatctgcaaaccatgtcccaggtcacacagcacctttataccttagccccatgagaaaggagggtacccccatgtaacagaggctgttggggctggcagaaagcaggaacaggatcagaatccaggatgagaaccaaaggggtccagagactctgaatcagagagaccttgttcaagttctagttccgcccatcacgtcctctgaaatsttaggcaagttactgccagaggtctcagtttcctcacctttagtggaattggtaaggcccctccctgctcttgtgaagtttaaaatggcacacaggaaaggatcaacagagatgaattattattattactattattatgctagtcatcatttttattatcggatagtgcccagaagctgaactcccctgtaacttgagggtacaatgaggcttctcagagaactactcgtgggtgggggagggggaggcggaaacctgttgaaaaccttgctgtcatttgagactcagtgtactcctctaaaatgcgtgtgatgaggacgcctccctccctggcaggcgtttgtggcagtggagatactagtgtgctacaagacccccccctcctcctcgcgagtggtggtccaggctggggagcagccctgctctccctgcctaacatgcgcctccccaacccctagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccgggtgagctgcagaagtgggctgggcagtggggggcggggcktgataggcagtggggggcggggcttgatagttggcccggcagaggcgggaagaycgcgcggctagatctgtggtgcaaaggcccgaaggtcatggaaggcggggcctgggatccactgggtgggcccwccgaggcatgccccttatagtcgtgtgacctggtcctgacaccgcccctacagcagccctggcggaccccgcgcagccgtgcagcgatccaccagcttcggggtccccaacgccaacagcatcaagcagatgctgctggactggtgtcgagccaagactcgcggctacgaggtgagccccgggaggccagggggcctggaggcctccccagaccccagctcaacacctccttcttagcagagctcctattacccagtacacttcctgccactgtgtggcctcacagggaacatggaaaggctcttggggtgaggaaactgaggctcaaagaggacacaaggcaagccctagattccagaatcagtgatgaagtaacagggcctcttgggtggtgggcagggttcaaggccggatcccactcttggagtcccctccttgttgctctgtakgargccctgagtcaatttctctaaatgagggaaggagtgatgaggcatgaccatagccttagctgggtggcgctgggcctctcagtagctctgtcccttgaaattgcaaatatgggagttgacaggctgacttggaggaggctcatgttccaactattcactcattgtgcaagctacggggcctctttgtgcccagtgccctaggtctggaataacagaatgctgaggggtagacagcaggggggagttgcccccaggttcctgaccagtcctcctacggcttatagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagtaagtgtgggccctggccctgctaatgttgctgcacatctggggctggacatcgggaccaggcccagttgccctgagaacccctggagcgggccagccacattgtcagtcagcggctgagacccccttccccagagagtccccgtccttctccatccccacccccccgctgctgagcgtgccaggtgcccgccggaacgaaggagccgcaggccggcctaccagcccgggccaaagcccaccaggtggccctgtccatatcccctccatcctccctctgcccccttctccctctctctccctttctctgtcctgctctcctcccactatcaccagagcttcctgctcccacgggatcccggctggagattccaaaaggaggctcctggcccgggcaccgtgcccgcccagcctatatagtgctgccagaggcttatataggacctcagcaagccctccactttggaatcgttgccccgtctgctcacctcaccctcagcacccttctccatctgtcttcccttctttccccttctctttctggtttccctcaaatttcttcctcctcctccttctcctcttcctcctccccccacctcctctcacgcctccctcaccccctctccccggggcacagccctcctctccaaccttggtgccaacgccatcgcccccaccccgcgttcccgcttgcccctagagttctctgcacctgtgactggtttggcccccacccttgtctgcattgcacaccattagtgatgggtagtgagcggcacgtccacagtggggaggaggcatgcggggggctggcagactgcagcactggaatcgtaattgaactcatgtctctgtgtgtgtgtgtgtatgtgtgtgtgtctctgtttcctcccctctctcttctctgcctcttccctctcttccccacccggggccctggcctcctgcccccgtmccccaccccttcccggccccctaccctccccaggacccatgcggactgcccgcagctcctggatacagaggacatggtgcggcttcgagagcctgactggaagtgcgtgtacacgtacatccaggaattctaccgctgtctggtccagaargggctggtaaaaaccaaaaagtcctaacccctgctcggggccccacggtgagaaacgccgcctctmccacctgccccgtttcaccagaatctgctcagcaaggccagagagggtccagggakgcgggtgggggaagtaaggggggcatttagtcaagccagaggagccagacatagccctgtcttctggcagttcagggcccagcaggtgagaccattctaaatgggcagtgatgacccaggtgggcagcactgtgatgggggaagcccaggggagatgcctgacccaggctgcaggtctgggccccccatctgaaaaaagtgcaaactaagctgggatctgaacaagttcaggctaaaggagggagagggagttccaggcagaggaatcagcctaggcttagcagggcaagagagctggagagcacagcacatcaggaagggaagaaacttgagtctggatatgagggaggagggggccacagttagaagtttgaccttctggccgagcacggtggctcatgcctgtaatcccagcactttgggaggccaaggtgggcagatcacgaggtcatgagttcgagaccagcctgaccaacatggtgaaaccccatctctactaaaaatacaaaaattagccaggcgtgtggcgcacacctgtaatcctagcgactcrggaggctgaggtaggagaatcacttgaacccaggaggcgaaggttgcaatgagctgaaatcatgccactgcactccagcctgggtgacagagcgagactccatctcaaaaaaaaaaaaaaaaaaaaaaaagtttgaccttcctcctgaggacaacaggagttataaagggtttccaaacagagaagggatggatatagcattctaggaccttcctyggatgaggcttggatgagagatgggatggactagatgactggaatagcttaagagctagagagacaggcttcccaatagatctggtttggagagggagagggaaggtcaagaagtctgccaggctcctgtgtgggcactggggagttggtggtgccatactccaaagtggggagctcaggagcaggaccagttcaacaggaagatgtttctggctggggactctggatcctaagccagctgtggcatttcctctctggtcacctcacctcagtaccaaagtaaagaattcagatcctaaactaactaccccattacagacaaggagctcagagagagacgtgggctaagactgtcctgggggtgggagggagagggaagatggttaggtcagagctggggccagaaactgagactccaaactccccacttagtggctgttttccttgccccatcactgtgttcccgcccattttgtagagaggattgaaaatagaggcccagaaggagcaaggggattggctgaaggaatgtgagtcagtgacaggtaggggcacactcagatgcccctcagggcctggagccattgtggggggcagtccacatgtgcacacacacactcagagaaggagcacagatgagtggcggatgggcttggtgctatctccagatcatatatggacttaggagctgctgcccagcaagccagcttggagggagaggggcccagcccagccctgatccagttggaaagtgtgactcagccgtgctgttgctcaagttgcctggtgtttggcctgtcactggggcagcctgagccctgagccctgagccccagtgtaaacaatggctttataaggtctccagggaagggagtggggcgggagggagcaccaggttggagagggcggtcgggatccccaggacgatagccacagctggaagaagcttcagagagaggctgcctttgcatcatggtacagctcgggaaacaagcccagtctgggatagggatgaccctaggggcacgtggcacatcrgcagcagacccagaaccctctcactcatcctaaattcttgtaaggtctcaaatgagatagagaataactgtcctgttctaaagagggggaaacagtcatagaaaagggccttatctagcacccacaactggttagggatacagtctggactaaaacagaggtgttcggtgttctgcctcccaggtttcttctctgaaggagtccaggtgagctgggggtaggcccagccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccrtggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccawggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggmcctgcctgactgggatggggctctcttctgccatctccgcctccacctgcctagctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcrggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagstgccgcccccactctccgggcaccgtytcctgcctgtgcgtccgcccaccrctgccctgtctgttgcgacaccctcccccccacatacacacgcagcgttttgataaattattggttttcaacgatcctgactcctctctgcgtctcctgggggtggggagggggtttgaaccgaaggcagctccgcaaggtctccaactccagcagggatcctcagaggttcttcttccgacctcccaccccacccgcccgcagcaacgaaggagtcgagcctcagttaaggcaggagggaatttagtggagctggggaaggaagaaagtggggttgggagaacctccccaaccccatccctgctggcccggggacgggcatcggctctcagcaagagaagtattcccgggatgctgagcgcttcattctgtctccaggactcaggcaggtaggtcccagctccgccgcgcccccggacctacaggtcagcgtggtccgaagtttcctctgggggcttcgcgggcgcccacacgtactcggggggcacctgcgcgtcgggcgccgccttgcggtagaagccgagctcctgcactagckcattgatctcttcgcgggtcatttcactgagtgggatgcgctgaggcggaggaggggcggggtcagcaggctgggcctcgcctctggcctcgcccccagcccacctcccacggcctcacctctagttcctcstagcggcggcccagcagcacgagctcagggtcggccccagggaggtgtttcatcaccaggttgtgactggaggtggtgttaaggagcggggtggtgggcagagggaggtggtggtttccgcagccttactgatgggaacagcattgcctcctttgctcagagcttactctgtgcccgggaggggccagggtctccgcttatacgtgagaaaattagggttcaaagaagtaaagggccctcctctccattctgtggcagtcatcactagtcaatctctcttgcccacccaacatggagaccacctcagaatcctctgggagccactaccaatcaattcaacttgtcagttgaaaaccatctgccacccctttctgaagttacgtggagattctcccaggtgcccatcccatttcccctcccccagaacagaaggatactagaatggaatgtcctgcgtgacgaaagccttcacctggggaggaaccagagcatcagagaccatgacctcagtctactcgaggtacagacgagacactgaagcccagtgaggtcataaarcaagtcaggtgcaggctagactcycagcctaggctagactctcagcctagggatccttcccccctcccygccccagtcattgggaccatgttgcccactccccaagaggctcagggggaacagagctagggacctcttccttcaaactcacctcctttaggcggttcagctgtcatcccccgcaggtctggagggggataaaatgggataggtcagragtccttcacgtttattccagtcacatccccaaagccatacttccttatccctgagttgggtcgggctgtgagttatcccyggatcagcagttcccaaggtctgaaggaaatgctggaccctygtgggcagaagggggaactgtgtatacaggtggggagactcaggcctagagacaccaggggaaaagagcaaggccagagaccmacagtgtgcctgccagccttggggcctgtacatcctactggctgtggactgactcccaatgcccaggggaaatgatcaccctgctcctcttaagcagtagagacctgggcttggcctttgatccctgaaatctcacagtggaggcagagcagaaggaaacacctcagaatggccctgggggcccccattggagacacctaccatctggtccctactctacacaggcagacctcaccctgcctgccacctgcggcccagccccacagaccatgtggttgcttccctgacatgggaggatgggagggctcctccctgccttccctgaggagatgccaccatccagcaggagtctagaccccaggaccacccactccagccctcctccatcctaccctcagcccttttcttagagacagggtctcactatgtcccccaagctggtcttgaactcctgggctcaagcaatcctcctgccttggcctcccaaagtgctgggattacaggcgtgcaccaccggcacccaaccattctacacccttttgtcrgacagagctgacaaaaagctcagaggcgggctgtgatggtcaaagtcacatagcaagacagggactccgaacgggaatttcctggttgggggaggatgggaggctgctgcagagtaaatgttggcaaccaagttcccaactcggttgcccctccgagttggcccccttccccggatcctgcatatgggaggaggcacccagaaagtcttctttccccccaggagaaggaaaagagactttctggagcctccagccctggaaccgggtcgggggggaattccaggaaaacatgaagtgatgggggatgggaagttgggacaggattgggagtcataggccacgagaagagttaggagactgcgtcagtgtgtctgggtgtccgctgtcggaccgggtagggggagctggggaagggttcggagttccaggccccaaagtcggtgtctcaggcttccacggtggatgctggggccatctggggctagggaacaggagggatggtcccggcgccagggggaaagcagggagactcgcggttcgaggtggtcttggggccgggacggacggtgctcccatggggccgcagggttggggaacgatagtgccggggctggaggccggcgtactcacctctacccgggcgcgggttaggccgctcagacggttccagtccggccggtaggcagtggcggctgtggctggggccacaagcgccgcgagaagcagcagcagcgccagcggaggcaacaggaggctcatcgggacccggccgcagatgatgcgcaagctggaggcgaacctccgagtcgctgcgccacgtctgggccyccaggctggccccgcccccgscccsgcccccactcccgctagaggcccagtcccgctggagaccacgcccccagcgctcggtctccgccccaggactccccgccgttacctcccgctagctcagggcgaggtcctggctcctccctggcgtttgggccgtcactttcccaggtccgagagtgtcgacgctccttttgtcgaccgaggatgtggacgctcccccaggatgcggccaggcagcgccacctcacgccggcagagggtgccggcgagacgctgagggacactggagtttctgagccgaacctgcgactttaagatagggaaactggtaggacatccaagaaaaaaaaaggaaagaaagaaagaagaataaataagggaaactggctttctgaggactcctcgctttggagcgtgggagatgaggagtgaggttcggtggagggggtgcggcttctgggagccactgagacctaccagcgtgtcttcttaccatccacagctactgctgagcagactttctgacctggggtgaggmaaggaatttgctattcaaaggtgggaaratgcaaggagggttacagctgataggccacaacagggtcttaaatcagctgggttaaatttatggagtcaggatttacttttttttttaatgtggctatccaattcaattaaaaatcttgtctttttcattgctactctgccgcgttacctctgttatatataaataggcaaccacggccgggcgtggtggctcacacctgtaatcccagcactttgggaggccgaggtgggtagatcacttgaggtcagaagttcgaggccagcctggccaacatggtgaaaccccatcgctactaaaaatacaaaaattagctgggcgtggtgtgggcgcctgtaatcctagctacttgggaggctgaggcaggagaatcacttcaacctgggaggcagagtttgcaatgagccgacatcctaccactgcactccagcctgggcgacagagactgtctcaaaaataaataaataaataaataggtaaccatataaatatatgggagtctacttctgaatatcataccctattctagtccttcagtgggtttgtctaactacgctgtcttattaactatagctttatagtcagacttgacatctggttgtgtgttggtcctctagctttgttctttctttctttctttttttttttgagacggagtctcgctctgttgcccaggctggagttcagtggcctgatctcggctcactgcaacctccgcctcccgggttcaagcaattctcctgcctcagcctcccgagtagctgggactacaggcacgcgccaccacgcccagctaatttttttgtatttttagtagagatggggtttcactgtgttagccaggatgttcttgatctcctgatctcatgatccgcccgtctcagcctcccaaagtgctgggataacaggtgtgagccactgcgcctggcccatttttttttgtttttttgtttgtttgtttttttgagacagagtcttgctctgtcagccaggctggagtgcagtggcacgatctcagctcactgcaacctccacctcccaggttcaagcgattcttctgcctcagcctcccaagtagctgggattacaggtgcccaccaccacgcccagctaattttgtatttttagtaaatatgggggtttcatcatcttggccaggctggtctcgaactcctaacctcaagtcatccacccgccttggcctcccaaagtcctgggattacaggtgtgagctgctgggctggctatttttttttttttttttttgagacagagtcttgctctgttgcccaggctggagtgcagtggctcaatcacagcctgaacctcccaggctcaagcaatcctcccacctcagcctcctgagtagctgggactacaggcatgcaccaycaygcccagctgattttttttttttttttttgagacggagtttcactctcattgtccaggctggacactctcatgtccagtggcatgatccggactcactgcaacctctgcctcccaggttcaagcgattctcttgcctcagcctcctaagtagctgggattacaggcgtcggccaccacacccggctaattttttgtctttttagtagagacgaggtttcaccatgttgaccaagctggtcgcaaactcctgggctcaagtgatcctcctgccttggcctcccaaagtactgggattacaggcatgagcgaccatgcctggcctgtggcctacattttcctgtggtgagggccatgtgtgatcccacagcctcagtaagccatcgcagtctagctttgttcttcttgaaggttgtcttgactatacttggcctttcacacttccaggtacaatttagggccagctcgtcaacctccacagaaaaaccttccaaatttctatcaggatttcagrttcccactggggaaatcaatgtggggagactctacagctttacattattgtgacttttcttccacgaacatagtaagtccctccatttctataggtcttctttaatttccttcaataatattttgtggtttttagaataaatatcttgcatatctttcattagatttactcctaggtatttaattttttatagcattacaaactctattgtttttacatattcattttcaagttgcttggtagtagcatataggaagacaattgatttttgtatattaaccttgcagccagtgaccttactgaattttcttactctaatagtttaactggatatttttttttattttctacatatgcatattatatcatctggaaataaaagtggttttcttcctttctggtccttataccttggttttgtttcgttgcactgtcttaattttacggtctggggcctctggtacaatgttgactggaactgataattgtctttttccagatatcatctttaaacgatcatgtttgctgtaggtttgttactggtgccttttgtaaaagaaagttttctatttctatttttctt

SEQ ID NO: 13361 - DNA, 14603 bp, Homo sapiens
cccgcccccaccctgtgtgccccccgctgcctcccccttagtgtagggcaggggttggtggagaagggccaaggccgctcagagcccgaggcctttgcccctccctccaccaggctccctattttgccctctggacccactgataacatcccctgggggaggagctggtctcatgtctggggccctccccagcccccaccaggactgattctctcgttcaccttcctgrgttcctcagtggggctgggggaagagcagccctcactgccccctggctgtgggagcaactgggaggaacaaggtctggtgaggagagggcacagaggagttctgcggggagtyrgtggtccaggaggggccgctgacccttctcgrggctgagatgtcccctgggcccacagtgaagccgcagcagggatggcaggatgagggcgcctgtcttccagatgctgacaccttggagccaggacatcttaggcttaaatgatgcctttggcacgtaataggacccaggtcacagagataacatctcagagcctcaattttctgaggataaaatggggctggaatactgattkcccagagtggtgctgaaaaggaaatgagatagagaagtacaaagcagcgkgtccayggagggactcacacctccctctccctcctaacgctgtgcccttcccagacagmagagtctgcaggcagaaggagcctctaacataaaaaatagagctctggcagcaagctgtcctctcagaagtaactaacaccacagtatgaaatcagaggcctgagaaagtggcccggctctgccctcagaattctttatcggtgggtgagacttggaattcctctattagcgatccattcctggctgggcacagtggctcatgcctgtaatcccagcactttgggaggctgggacggacggatatctgaggccaggagttcgagaccagcctgggcaacatggcgaaacccagtctctactaaaaatacaaaaaattagccgagcatggtgatgcacgcctgtagtcccagctactcaggaggctgaggcackagaattgcttgaaccccggaggtggaggttgcagtgagcagagatcgcaccattgcactccagtgacagagctagacttggtctaaaaaagagagagagagagagagagagagagattcattcctttgacttaagactttgttttctgttaaaatgcaaatagaaccctgtgaagtagaygttaagtccattttataggttagaaacctaaggctctaagggctccaagtgcacagcccattagtagtaaggctgggaaccttaatccaggtcttcacacaccccaggcaaataccagayggcttagagcactgagacccctatagaggcatcagtcacacgcccagaacaaacctgtctcaagtctcctgcagactttggtggtggggtagaaggtgaagaagtggtcactggaggatttggtattggggatgccctttcctcttctgctgcggcctgctccatagccccagaggcaaaggcacagtggggacccagatccaggcaggggcaggcaacaaggtctatgggcccgggtgtgctagaatgggctggcggggtcccrtggccccagaccctccaagcctttccatctctgcagagggtctggaggagcctggcctctctctcccrcatggcaacggacccagggaggtcaggacatgtgggtagagagacctggcagggtgctgagctagatgtagcacacctccaggaagcctggtaycttgtctccttccaagggcttggtacctgagaatacctgtggcccctcaccaacagtccaacctgcaccccggcaggggatctcttggtggccagcctgcgctgcccctctctcccatcatggctcccctgggatgaagactgctccagggagaagccagtggtagatgggaggaagaggggatttgaccatccggggccaaaaatggtcctctggggttgggctgtttcaccttgtgtccaggtgaggtttagtacatgagcccccatgctccatgcccttcccaccaggctgggctgggcagccctgattcagacctgttggccagaggcccttgttcatcacacatcatcatgccggaagttcctcctagtatctcacccagctccytcctatggcaacaggagctgtccttcagttctgcccgggggagggccccttgaagcatacgtgaggcacatgtccgtgtgacctgcctgtccctggctggatctgagttktctgctcctgactctgacctctggactgacccctggtttgatccctgtgtggttggccaggaggggtggctgtagctaatgctgagctatcagcctcattgcctcaccaatcattaagtctgcctgttgcacagataaggagaggcttggagaggcgatgtctccctcgagatcacacaggcctttcatgcccactaagrtggacgtccctgactcacaggaccaggcctggctggaaggcagtctgctcttcccatcagctacttgcaccctctaagactgagcacagggggctctcattctctccctgctccccaaaacaaatccatctacagattgatgcaaaacgtaccctcagactttgggaagtaaatacattcattaacaggtcacrtccccgccacgttgaaaggcagsaggtcccctcgcgagcgtgggtgcacgcatgggctgtgccagtcccttggttcttagtgatttgcacacttctgtgaatccacacacactctggtggatgctctcggacatgctcaaatggtgcaggcgctcccagcatgggtgcacccaggcgggcgggtgagacagaagcgcctctggacctctcacatgctagtggcacckgctgctaggactgtaagtcctggaggtcaaactgcggctgaggtgtcattygtgactcagtctcctcctcccctctggcctggggaagggacaggggcactgagtactgacctttgctcccgctgcaagctggactgtgcctgattcaggagcagggttgggaccgatgggttccagggaggtgagccttgcaggrgtaagacgtggctaacatttagtgatcacttttmctatgtgccagacattgttgcaagcactataagatcatctcagtgaatcctcacagcctaggaggcaggtacaatggttatgtctcaccaaggtaactgaggctcagagaggttatgagacttgcccaaggacacacaggcagtacgtgttggagcctggatgccaagccagggagtggactccagcatctgaccccaacaatcayrgagagatggcacaggctgcatcaaaaaggaggcagcatggtagcgtggggaccactacagggcagtggggacccagcagaaggggtgccagagtcaggaggtcatttgactgcctttgaccctaggaaacattaagccacttctggaaactgaaaaaatgaacacaaagcaaattagagttagtacaattgtggtctactctgatggcgttcatttttacaaataaatgtagctcactgttgtcaggcactgcactcaccgacaggagccaatagtgcaacgtgcctggatgtcacctcatagtcactaggagtggtgtggtccrgcagagggacccatgctgacgtggtgtgtcaccttctcagtggatgtttgtgtgtgattatgcatgcagcctcatttagagatccaatagacatctaagtagaagacctcctgggcaccaccaccattgccctccatcccccaatgggaggtcycctgagagcctcaggtcccaagattctgctcaagccagctgctcctgcccagggagtgtggctggggggcaagaagggcaggagtcaggcctcaggctggtcccacccatcaccctgcctctggcccacctggcgcccctcagagggctgagtctcaytctgccactctcactagaggagggagcactctgctaccctccctgctttgctccaaatcaggaacacagtatgattattatacagtatgattattataataacagcaactatttttcagagcttactctgtgccaggagctctataggcagccctctgtatccttggtttctgtgtccatggattcaaccaaccttggattgaaaataattttttaggccgggcrtggtggctcacgcctgtaatctcagcactttgggaggctgaggcgggcggatcacgaggtcaggagatcgagaccatcctggctaacacggcgaaaccccatctctactaaaaatacaaaaaaaaaaaaaaaaattagccgggcgtggtggcgggcgcctatggtcccagctacttgggaggctgaggcaggagaatggcgtgaacccgggaggcagagcttgcagtgagccgagatcgtgccactgcactccagcctgggtgacagagcaagactccatctcaaaaaaaaaaaaaaaaaawatatatatatatatatatatatatwtwtttttttwaattgcatctgtgggccgggtgcagtggctcatgcctgtaagcccagcattttaggaggcagagattggaggatcacttaaggccaggagttggagaccagcctgagcaacatagcgacaccccatctccattaaaaacaatgttttaaaaaaattgcatctgggcagggcgcagtggctcacgcctataagcccagcactttgggaggcccacatgggaggattgcttgaggccaggagttggagaccagcctgagcaacatggtgaaaccccgtctctgctgtaaatacacaaattagctgggcgtggtggtgggtgcctgtaatcccagctactcaggaggctgaggcaggagaatcacttgaacctggggggcagagattgcagtgagctaagatcgtgccactgcactccagcctgggtgacagagtaagactccatctcaaaaaaaaaaaaaattgcacctgtactaaacatatacagacttttttggtgattacctcctaaacaatacagtataacaaccattcacacagcayttccgtcgtattaggtattataagtaatctagagatttaaagtatgtgggaggctgtgcttaggttatatgyaaatactatgccattttatatcaaggacttgaacatccatggattttggtatctgcagagggtcctggaatcaatttcccatggagactgagagatgaccgtactacccacttcgcaagcaatgtcttctttaatgtactgaaccatcccattgttcagaggagaaactgaagctcagggctttgaataactagaccaaggaggcacagcatgggagtgggacatgaagcactctacaattaaccctttcaggacaaggccctgtctcccacacccatctgcccaaaggctctccagggccccctcctcttgggtgtaccttgacaagagacctagattttagctcactatgctgtctgcagtcctggatggtcccactccagtgtctggtgctctgagatggagtcagcattagtggcggatgtggagactggggggacctgtcttcactggggtagacagaggagatgtggactttgccccccatgagcccggcacaaacccagagccgccagcagggcctcraggcatcagtcccgggctcatgggctccctsaggtgtttctcctactgttttccgttcccctcctcccttccatgctgaggttggtggggtgggggtgggggtgcccacgcacggaacagccaccayttctaactatcgcytgagccctgatctgctgtcagcttccacgtagtctcagggtcacaaaagtccaagaggcctcttgggaatgtgtcaccttccagcgtggagtcacactgaggaaggaggaggggagggcagccaggggggtggcgatagggagasagtttaaatgtctggctggctctgagcttcagtcagttcccactgcagcrcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggtgagtagaagctgtctttggatggcactcctgggctgctgctctgagtagtgcaggatggaggctgagccaaagcaaaaggacacttctgagtgcccatcagcccccagctggacatgaggtctgcctggctgccaagtggctcacaggagagctggcccagtcccagtggtgggcccattggcattggtgctataccagtttcacatatycctgtggcttccaaaaagctaagctcagacrgggaaaatggcaggttgaggcacccccaccatcatccagtctgcagctcagagctggagcagaggggccacacaggagacggggcctcatgaattgctctctgttaccacccaggagccagggctgaggtcagtgctgaccaggtggccacrgtgatgtgggactacttcagccagctgagcaacaatgccaaggaggccgtggaacatctccagaaatctgaactcacccagcaactcaagtaagagggactacagtgtgyrgtggtgacggggaattcttaaaggccatgcaatgtactggcaagggttgagcttagagacaggagccctgagmttaggatacccactgccctgccactaactggccgggcctctgaacctaggatccacatatgtaaacyggaagtttggaccgaataatccctgccatgtccttttgctttgacrttcyagagtttgacaaatggccacatcctatcattcaggctcatggaagagagggagggaggaaaatgycaygtgagctgatttctaatacrtttcagaaagacaggccccagtggaatcaaggggagggaggtgggaatatttgggaggcccctgggcacaggcaaggaaagcagcaccttgtgccactggaagaccccagcagaggtcaagaagacaacattgtgttacacaatgtgatcctatggcccagaacaytccctctgggaaggacctcaaagtcccaccctctgcagacaaggaggggaaagcaaactgctggaggtgacatggtgggtagattctgagacaaastatgtgggagatcctgagatagaaattcagcatcgtaacttagtctgtgacacccatcctctccaatctgcaccaccatagrgagggtgaactcggtacctctgagcactcacctgtcytagcacgtgtgcataaggcgagtggtatacaagcagacaaagtcttgccgtgtaaatgccaaatgtaacgtggcctccttgtgcccttccccacagtgmcctcttccaggacaaacttggagaagtgaacacttaygcargygacctgcakaagaagctggtgccctttgccaycgagctgcatgaacgcctggccaaggactcggagaaactgaaggaggagattgggaaggagctggaggagytgagggcccggctgctgccccatgccaatgaggtgagccagaagatcggggacaacctgcgagagcttcagcagcgcctggagccctacgcggaccagctgcgcacccaggtcarcacgcaggcygagcagctgcggcgccagctgaccccctackcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccraggagctcaaggccaggatctcggccagtgcygaggagctgcrgcagaggctggcgcccttggccgaggacgtgcgtggcaacctgargggcaacacygaggggctgcagaagtcactggcagagctgggtgggcacctrgaccagcaggtggaggagttccgacgccggstggagccctacggggaaaacttcaacaaagccctggtgcagcagatggaacagctcaggcagaaactgggcccccatgcgggggacgtkgaaggccacttgagcttcctggagaaggacctgagggacaaggtcaactccttcttcagcaccttcaaggagaaagagagccaggacaagwctctctccctccctgagctggagcaacakcaggaacagcakcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacayatgtccagtgggaggtgagaccacctctcaatattcaataaagctgctgagaatctagcctcaactggttgccggatgaatcctccttgcagctggggaggtggggaggtaaccatgactgggcagagcttagcagcggcctggcaggagacacccaggattggggagatgagactgcaggagaggtaagggcctggtggactggaggcgagtacatggggagtcctctaaggggaggcagaaaaagatgtcacacattatcccaagacaaaatatgcaacctacttatattcatttagccaacaaatatgcattgaatgcctccgatgcgccagtcattattctaggcaccggacaaccagcaaacagcttttgtgcagccatgtgcccgactctgcctcacactgagggggacacctggaggcgagcagaacagggtccctggccctggggggctcacagtacactgggggagatggttcctccttgcacgagatcttcagtgcctttaacttattcatgtagtgtcatttaacccaccccaccccagttccattatgaaagcgattcatgcttatttcagaactttcttgactgctaaacctgtggtctccatccagaattggggattgaggcttggggaccgagacgagtctggggaggaggggcagagcaggtgctggagcctgcggggccctggtctgctctgtccaggggcctcctgccaggtggcctgccagtttggggctgagtttgcagccactgggrttaggggcagagagtcagggggcctgagcagtctcatcagcacagccagctgtgggcagctgcagccttggagtggtctttcaccccacccttagagactcgaaaacctcacaaggaaagagccagttcaagcrtttgtctcaaacgactccacagcctgttacccgtggaccccagccctgcgagtctagccacctccctttcctcgccacagggggatgcaggcccttcagggctttcctggaagaggcctggaacatgctaaggaggagggggaagtccccttggagggtgtcctggggcctcctccttccctctcaaggtgccctcagggtagtggcccccagcatggtctggcccaggcctatacccctctggcccctggtgctggcctggtgggagggatgtatgcttgggaatcagacaagcctaggtttgaatcctggctttttgaccgactaccgggtgatgtggggcgaataattgagcttcttttggaagacatgggtaatgacaatcctctgcttagagaggagttgtgctgaaggtttgatggagcaacggagtcaagcacttaacatcaggcacrgaataaccgtgcaatagctggtgctgcagtaaatgtgacttcctcatcccgctcacctccaggccacactctattaatgagaccgccacagctggccaagggtagacccccgggtctcccctgccccagctgctctcgctcctgcataccaggccagtaaggctgctgcggccactttgatacctacccccactagaagcacaggaacctatggggaaacaccttgacaaacccaccaggcacctggaggtttactggatggctttaggaaagggccaatgaggccaaacagagcaacgagtcaccaaaaggaagtgagatgcagggtgggccgggttccaagagggtctggaagcttctgagatgctctcagacctcacctgagggctgcctggtttagtgctgactccagaacccctgggggcctcagtgtctcccagaacttggttcttaatatgaaccctgggccgggcgcggtggctcatgcctgtaatcccagcactttgggaggccgaggtgggtggatcatgaggtgaagagatcaagaccatcctggccaacatggtgaaactccgtctctactaaaaatacaaaaaattagctgggcgtggtggtgggctcctgtaatcccagctacttgggaggctgaagcaggagaatcgcttgaacccaggaggcggaggttgcagtgagccaagatcgcgccattgcaccactccagcctgggcaaaaagagagaaactctgtctcaaaaaaaaaaaaaaaaaaaaaaaaaaaatatatatatatatatatatacacacacacatatatattcatatataattcatatatatattcatatataattcatatataattcatatatatattcatatagatattcatatataattcatatagatattcatagatattcatatatattcatatagatattcatatattcatatatattcatatattcatgtatattcatatagatattcatatatagatattcatagatattcatatatagatattcatatagatattcatatatagatattcatatagatattcatgtatagatattcatatatatattcatatatagatattcatatagatatattcatatctatatgaatatatatatgaatatatctatatatgaatcctggattagacccgtgcacctctcccaccacccttagggccatcctgcaggtctctgagggtcctgccacagtcctcgtcctcctggatgaggaatgccttctctttcctgtaccaagatgtctcatcaatcccctgggtctggcagaggtctcttggtagtaactttgcttttggctgctgcagtgaactgaatgtttgcgtccccctaaattcctatgttgcaattctaatctgtaaggtgatggcattaggagagaagrcatttgggaggtgatcaggtcatgaagggggagccctcatgaatgagattagtgtccttataaaagaggccccacagaaatcccttgccccttcyacgtgcgaggacacagcgagaaggtgccatttatgaaccaggaagtgggccctcaccagacacgggatatgctggtgccttgctcttagacttcccagcctccaggactatgaggaataaatgtctgttgtttgtaatccacccagtttttggtgtctcgttatagaagcccaaaagatctaagacactttcccagcctctgaagctctcctgttttgtttcgaaagtgtctcgctgatgagttttggtgggagtcagaggctgcctccattacagacactaacaactccagtcgcctgccttctagcctcgcttacctccagcatgggacatgggacctatgctcagcaaatcagatgtaattgccccagactggtgtaaagaaacagagacagtggagaatcttttctggggtgggcaggaacagtgcggcagcaacaggcagcttgcggccaggctagagcctcaggccagggaccaggcgtggcagtggctggtgggcaaactgggctgtccccatcctggctcagtggtgacagcacagccgtccccatcactctagttctgtggcatgagcatggccatgtttctccctcagctccccttattcttgtttattttccaaaccaagtactccagctttcctagacatttccttgaaattcctggaaatatgtcagtaagttcatcttctgattatgtcttccagagtaggtttctgtggctagcaattaaaaaccttgattgaggccaggcgtgatggatcacgcctgtaatcccagcactttgggagactgaggtgggtgaatcacctgagatagggagttcgagaccagcctgaccaacatggtgaaacccccgtctctactaaaaatacaaaaattaactaggtgtggtggcacacgcctgtaatcccagctactcaggaggctgaggcaggaaaattgcttgaacccaggaggtggaggttgcagtgagctgagatcaggccattgcactccagcctgggtgaaagagcaagactctgtctcaaaaacaaacaaacacacacacatcactttgattgacacaccccacacaccccttccctcttagggatgtttctcttgctttgggccttggaagacacaccctcatctctggccygttccagttggtcaattggtttgtctgagatacacttattagtcctcattagggttggtcccatcttccaaggaaagcagccttcctcctgttctgagctagcaggtggacttagtccccctgtggccagtcagtcctctgctcctctccagcggctgagctgactggggacctgggcaacagcctctacctgcccttctcagagattctctaacagctggtctcagatctctcatgaggtcctgagttcaagcaaaacactctggtttggtttggggaatctgtttatttatgggaagatgtccaagatattttatgaaaaaaaaaaaagcaaggtttcaactattatgtactttacaaccyggtcaaggaacacacatacatattggtatgtgaacgtgtaaggaagtgaaaatcctgttagcttaacagttagacctagaatacctctgaaagagagaatgtcattgacagtgcatgctagctgttgaccaggacacccagaggaactggctggaaagagaccacaaggcagagagatggagtcaattgttccgtgcattccctgcactggcatttgaggtggtaatgaagagtaggaaaggaggggaggtcacagaagggaaaacagggaatacatgaggaggtgaaagccccctacaaatgatggccaataagaaatgcccagtggcaacggttgtagagcttttcaatgcaaggatggcaattcattgctgactgcaatgctggtagtgtgaggtgcttttaaaaaccaccttatattaccatattggctcatataattctcatgatcgaccatcacatcaaagacacaatagatgaggaagaggcacttcagaatggtgaggtacattacctagcaagtggtggaatgggattttttttttttttttttttttttttaccagcgctttgggaggccraggcgggtggatcacttgaggtcaggagttcaagaccagcctggccaacatggygaaaccccctcctctattaaaaatacaaaaattggctgggctttgtggtgcgtgcttgcaatctcagctactagggaggctgaggcaggagaatcgcctgaactcgggagacggagatttcagtgagccgagatcatgccactgccagcctgggtgacagagtgagactctgtctccaaaaaaaaaaaaaaagaagagaaagaaaaaaatatgccattttaggccaggtgtggtggctcacacctgtaatcccagcactttgggaggctgaracaggtggattgcttgagcctaggagttcgagaccagcctggcaacatggcgaaaacttgtctctacaaaaaatacaaaaattagccaagtgtggtggtgcacacctgtggtccaagctactcgagagactgaggtgggaggattgcttgagcccaggaggttgaggctggggtgagttgagatcatgccactgcastccagcctgggcaacagaggaagaccctgtctcaagaaaaaaaaaaaaaaagaagaagaagaaaagaaaaaaatgccaccactttagtattacttttataacataaaatttaccatttaaactatttataggtgttcaagtcagtggcattaattacatttacaatgttgtgcaaccaccgccaccactatttctgaaaatcttttcatcaccccaaacagaaaactctatccattaagcaattgtgaaaactgccgctatgaatgggggtgtacacatatctttccagtccttgctctcaattcttctgagcaaatatccagaagtggaattgctgggtcacacggtaattctatatttaaattttggaggaaccgccaaactgtttttttatagtagtggcaccatttcacattcccactggtgacgcccagggttccaatttcttcacagcctctccaacgcttgttgttttctgttattttttggttttgttttattttgtttttaacaatagtcatcctgagagtagtacttttaaaaccagaaataagtaagaaaagaaatattcc

SEQ ID NO: 13362 - DNA, 15357 bp, Homo sapiens
acaggtccccccagtctccacatccgccactaatgctgactccatctcagagcaccagacactggagtgggaccatccaggactgcagacagcatagtgagctaaaatctaggtctcttgtcaaggtacacccaagaggagggggccctggagagcctttgggcagatgggtgtgggagacagggccttgtcctgaaagggttaattgtagagtgcttcatgtcccactcccatgctgtgcctccttggtctagttattcaaagccctgagcttcagtttctcctctgaacaatgggatggttcagtacattaaagaagacattgcttgcgaagtgggtagtacggtcatctctcagtctccatgggaaattgattccaggaccctctgcagataccaaaatccatggatgttcaagtccttgatataaaatggcatagtatttrcatataacctaagcacagcctcccacatactttaaatctctagattacttataatacctaatacgacggaartgctgtgtgaatggttgttatactgtattgtttaggaggtaatcaccaaaaaagtctgtatatgtttagtacaggtgcaattttttttttttttgagatggagtcttactctgtcacccaggctggagtgcagtggcacgatcttagctcactgcaatctctgccccccaggttcaagtgattctcctgcctcagcctcctgagtagctgggattacaggcacccaccaccacgcccagctaatttgtgtatttacagcagagacggggtttcaccatgttgctcaggctggtctccaactcctggcctcaagcaatcctcccatgtgggcctcccaaagtgctgggcttataggcgtgagccactgcgccctgcccagatgcaatttttttaaaacattgtttttaatggagatggggtgtcgctatgttgctcaggctggtctccaactcctggccttaagtgatcctccaatctctgcctcctaaaatgctgggcttacaggcatgagccactgcacccggcccacagatgcaattwaaaaaaawawatatatatatatatatatatatatwttttttttttttttttttgagatggagtcttgctctgtcacccaggctggagtgcagtggcacgatctcggctcactgcaagctctgcctcccgggttcacgccattctcctgcctcagcctcccaagtagctgggaccataggcgcccgccaccacgcccggctaatttttttttttttttttgtatttttagtagagatggggtttcgccgtgttagccaggatggtctcgatctcctgacctcgtgatccgcccgcctcagcctcccaaagtgctgagattacaggcgtgagccaccaygcccggcctaaaaaattattttcaatccaaggttggttgaatccatggacacagaaaccaaggatacagagggctgcctatagagctcctggcacagagtaagctctgaaaaatagttgctgttattataataatcatactgtataataatcatactgtgttcctgatttggagcaaagcagggagggtagcagagtgctccctcctctagtgagagtggcagartgagactcagccctctgaggggcgccaggtgggccagaggcagggtgatgggtgggaccagcctgaggcctgactcctgcccttcttgccccccagccacactccctgggcaggagcagctggcttgagcagaatcttgggacctgaggctctcaggrgacctcccattgggggatggagggcaatggtggtggtgcccaggaggtcttctacttagatgtctattggatctctaaatgaggctgcatgcataatcacacacaaacatccactgagaaggtgacacaccacgtcagcatgggtccctctgcyggaccacaccactcctagtgactatgaggtgacatccaggcacgttgcactattggctcctgtcggtgagtgcagtgcctgacaacagtgagctacatttatttgtaaaaatgaacgccatcagagtagaccacaattgtactaactctaatttgctttgtgttcattttttcagtttccagaagtggcttaatgtttcctagggtcaaaggcagtcaaatgacctcctgactctggcaccccttctgctgggtccccactgccctgtagtggtccccacgctaccatgctgcctcctttttgatgcagcctgtgccatctctcyrtgattgttggggtcagatgctggagtccactccctggcttggcatccaggctccaacacgtactgcctgtgtgtccttgggcaagtctcataacctctctgagcctcagttaccttggtgagacataaccattgtacctgcctcctaggctgtgaggattcactgagatgatcttatagtgcttgcaacaatgtctggcacatagkaaaagtgatcactaaatgttagccacgtcttacycctgcaaggctcacctccctggaacccatcggtcccaaccctgctcctgaatcaggcacagtccagcttgcagcgggagcaaaggtcagtactcagtgcccctgtcccttccccaggccagaggggaggaggagactgagtcacraatgacacctcagccgcagtttgacctccaggacttacagtcctagcagcmggtgccactagcatgtgagaggtccagaggcgcttctgtctcacccgcccgcctgggtgcacccatgctgggagcgcctgcaccatttgagcatgtccgagagcatccaccagagtgtgtgtggattcacagaagtgtgcaaatcactaagaaccaagggactggcacagcccatgcgtgcacccacgctcgcgaggggacctsctgcctttcaacgtggcggggaygtgacctgttaatgaatgtatttacttcccaaagtctgagggtacgttttgcatcaatctgtagatggatttgttttggggagcagggagagaatgagagccccctgtgctcagtcttagagggtgcaagtagctgatgggaagagcagactgccttccagccaggcctggtcctgtgagtcagggacgtccaycttagtgggcatgaaaggcctgtgtgatctcgagggagacatcgcctctccaagcctctccttatctgtgcaacaggcagacttaatgattggtgaggcaatgaggctgatagctcagcattagctacagccacccctcctggccaaccacacagggatcaaaccaggggtcagtccagaggtcagagtcaggagcagamaactcagatccagccagggacaggcaggtcacacggacatgtgcctcacgtatgcttcaaggggccctcccccgggcagaactgaaggacagctcctgttgccataggarggagctgggtgagatactaggaggaacttccggcatgatgatgtgtgatgaacaagggcctctggccaacaggtctgaatcagggctgcccagcccagcctggtgggaagggcatggagcatgggggctcatgtactaaacctcacctggacacaaggtgaaacagcccaaccccagaggaccatttttggccccggatggtcaaatcccctcttcctcccatctaccactggcttctccctggagcagtcttcatcccaggggagccatgatgggagagaggggcagcgcaggctggccaccaagagatcccctgccggggtgcaggttggactgttggtgaggggccacaggtattctcaggtaccaagcccttggaaggagacaagrtaccaggcttcctggaggtgtgctacatctagctcagcaccctgccaggtctctctacccacatgtcctgacctccctgggtccgttgccatgygggagagagaggccaggctcctccagaccctctgcagagatggaaaggcttggagggtctggggccaygggaccccgccagcccattctagcacacccgggcccatagaccttgttgcctgcccctgcctggatctgggtccccactgtgcctttgcctctggggctatggagcaggccgcagcagaagaggaaagggcatccccaataccaaatcctccagtgaccacttcttcaccttctaccccaccaccaaagtctgcaggagacttgagacaggtttgttctgggcgtgtgactgatgcctctataggggtctcagtgctctaagccrtctggtatttgcctggggtgtgtgaagacctggattaaggttcccagccttactactaatgggctgtgcacttggagcccttagagccttaggtttctaacctataaaatggacttaacrtctacttcacagggttctatttgcattttaacagaaaacaaagtcttaagtcaaaggaatgaatctctctctctctctctctctctctcttttttagaccaagtctagctctgtcactggagtgcaatggtgcgatctctgctcactgcaacctccacctccggggttcaagcaattctmgtgcctcagcctcctgagtagctgggactacaggcgtgcatcaccatgctcggctaattttttgtatttttagtagagactgggtttcgccatgttgcccaggctggtctcgaactcctggcctcagatatccgtccgtcccagcctcccaaagtgctgggattacaggcatgagccactgtgcccagccaggaatggatcgctaatagaggaattccaagtctcacccaccgataaagaattctgagggcagagccgggccactttctcaggcctctgatttcatactgtggtgttagttacttctgagaggacagcttgctgccagagctctattttttatgttagaggctccttctgcctgcagactctkctgtctgggaagggcacagcgttaggagggagagggaggtgtgagtccctccrtggacmcgctgctttgtacttctctatctcatttccttttcagcaccactctgggmaatcagtattccagccccattttatcctcagaaaattgaggctctgagatgttatctctgtgacctgggtcctattacgtgccaaaggcatcatttaagcctaagatgtcctggctccaaggtgtcagcatctggaagacaggcgccctcatcctgccatccctgctgcggcttcactgtgggcccaggggacatctcagccycgagaagggtcagcggcccctcctggaccacyractccccgcagaactcctctgtgccctctcctcaccagaccttgttcctcccagttgctcccacagccagggggcagtgagggctgctcttcccccagccccactgaggaacycaggaaggtgaacgagagaatcagtcctggtgggggctggggagggccccagacatgagaccagctcctcccccaggggatgttatcagtgggtccagagggcaaaatagggagcctggtggagggaggggcaaaggcctcgggctctgagcggccttggcccttctccaccaacccctgccctacactmagggggaggcrgcggggggcacacagggtgggggcgggtggggggctgctgggtgagcagcactcgcctgcctggattgaaacccagagatggaggtgctgggaggggctgtgagagctcagccctgtaaccaggccttgccggagccactgatgccyggtcttctgtgcctttactccaaacaycccccagcccaagccacccacttgytctcaagtctgaagaagcccctcacccctctactccaggctgtgttcagggcttggggctggtggagggaggggcctgaaattccagtgtgaaaggctgagatgggcccgaggcmcctggcctatgtccaagccatttcccctctcaccagcctctccctggggagccagtcagctaggaaggaatgagggctccccaggcccacccccagttcctgagctcatctgggctgcagggctggcgggacagcagcgtggactcagtctcctagggatttcccaactctcccgcccrcttgctgcatctggacaccctgcctcaggccctcatctccactggtcagcaggtgacctttgcccagcgccctgggtcctcagtgcctgctgccctggagatgatataaaacaggtcagaaccctcckgcctgtctgctcagttcatccctagaggcagctgctccaggtaatgccctctggggaggggaaagaggaggggaggaggatgaagaggggcaagaggagctccctgcccagcccagccagcaagcctggagaagcacttgctagagctaaggaagcctygsagctggaygggtgccccccacccctcatcataacctgaagaacatggaggcccgggaggggtgtcacttgcccaaagctacayagggggtggggctggaagtggctccaagtgcaggttcccccctcattyttcaggcttagggctggaggaagccttagacagcccagtcctaccccagacagggaaactgaggcctggagagggccagaaatcacccaaagacacacagcatgttggctggactggacggagatcagtccagaccgcaggtgccttgatgttcagtytggtgggttttctgctccatcccacccacctccctttgggcctcgatccctcgccsctcaccagtcccccttctgagagcccgtatkagcagggagccggcccctactccttctggcagacccagctaaggttctaccttaggggccacrccacctcyccagggaggggtccasaggcatggggacctggggtgcccctcacaggacacttccttgcaggaacagaggtgccatgcagccccgggtactccttgttgttgccctcctggcgctcctggcctctgcccgtaagcacttggtgggactgggctgggggcagggtggaggcaacttggggatcccagtcccartgggtggtcaagcaggagcccagggctcgtccakaggccgatccaccccactcagccctgctctttcctcaggagcttcagaggccgaggatgcctcccttctcagcttcatgcagggytacatgaagcacgccaccaagaccgccaaggatgcactgagcagcgtgcaggagtcccaggtggcccagcaggccaggtacacccgctggcctccctccccatcccccctgccagctgcctccattcccacccrccccwgccctggtgagatcccaacaatggaatggaggtgctccagcctcccctgggcctgtgcctcttcagcctcctctttcctcacagggcctttgtcaggctgctgcgggagagatgacagagttgagactgcattcctcccaggtccctcctttctccccrgagcagtcctagggcgygccgttttagccctcatttccattttcctttcctttccctttctttcyctttctatttctttctttctttctttctttctttctttctttctttctttctttctttcctttctttctttcctttctttctttcttttcttctttctttctttcctttctttctctttctttctttctttcctttttctttctttcyytctcttyctttctytctttcyttyttcttcttttttttttaatggagtctccctctgtcaccyaggctggagtgcagtggtgccatctcggctcactgcaacctccrtctcccgggttcaacccattctcctgcctcagcctcccaagtagctgggattacaggcacgygccaccacacccagctaatttttgtatttttagcagagatggggtttcaccatgttggccaggttggtcttgaattcctgacctcaggggatcctcctgcctcggcctcccaaagygctgggaytacaggcaygagccacygcgccyggccccattttccttttctgaaggtctggctagagcagtggtcctcagcctttttggcaccagggaccagttttgtggtggacawtttttccatgggccagcggggatggttttgggatgaagctgttccacctcagatcatcaggcattagattctcataaggagccctccacctagatccctggcatgtgcagttcacaayagggttcacactcctatgagaatgtaaggccacttgatctgacaggaggcggagctcaggcggkattgctcactcacccaccactcacttcgtgctgtgcagcccggctcctaacagtccatggaccagtacctatctatgacttgggggttggggacccctgggctaggggtttgccttgggaggccccacctgaccyaattcaagcccgtgagtgcttctgctttgttctaagacctggggccagtgtgagcagaagtgtgtccttcctctcccatcctgcccctgcccatcagtactctcctctcccctactcccttctccacctcaccctgactggcattagctggcatagcagaggtgttcataaacwttcttagtccccagaaccggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggyggtgctgtttgcacagaaaacaatgacagccttgacctttcacatctccccaccctgtcactttgtgcctcaggcccaggggcataaacatctgaggtgacctggagatggcagggtttgacttgtgctggggttcctgcaaggatatctcttctcccagggtggcagctgtgggggattcctgcctgaggtctcagggctgtcgtccagtgaagttgagagggtggtgtggtcctgactggtgtcgtccartgggkacatgggtgtgggtcccatggttgcctacagaggagttctcatgccctgctctgttgcttyccctgactgatttaggggctgggtgaccgatggcttcagttccctgaaagactactggagcaccgttraggacaagttctctgagttctgggatttggaccctgaggtcagaccarcttcagccgtggctgcctgagacctcaataccccaagtccacctgcctatccatcctgcsagctccttgggtcctgcaatctccagggctkcccctgtaggttgcttaaaagggacagtattctcagtgctctcctaccccacctcatgcctggcccccctccaggcatgctggcctcccaataaagctggacaagaagctgctatgagtgggccgtcgcaagtgtgccatctgtgtctgggcatgggaaagggccgaggctgttctgtgggtgggcactggacagactccaggtcaggcaggcatggaggccagygctctatccaccttctggtagctgggcagtctctgggcctcagtttcttcatctctaaggtaggaatcaccctccgtaccctgccttccttgacagctttgtgcggaaggtcaaacaggacaataagtttgctgatactttgataaactgttaggtgctgcacaacatgacttgagtgtgtgccccatgccagccactatgcctggcacttaagttgtcatcagagttgagactgtgtgtgtttactcaaaactgtggagctgacctcccctatccrggccmcctagccctcttaggcgcacgtgaagggaggaggccggatgggctagaggttggagtaagatgcaacgaggcactattcttggctccaccacttgatatcagcctcagtttcttacatgtaaagtggatacaaccgtaccccctccaccgtaggtttgccgtgagattgaaatgagagagcgttcgaaccgtttggcacagcacctgcacgtaaagatgcttgatcaatgttgtcatgattacagttgagctgactgggcccttgggaccyggactggagtggtggggggcagtgtcctgggaccaaaaagaagcacaaggtctccyaatagaggctgcttcctttgtgtccccaccacccgaaagatgtcaggtcagagagcccgagagctgcagatggcttgagtagggctccactcttcagrtcaaaaaactgtggcccggagaggcgaaggcacttggccagcatcacagagccagcacgtggcagggccagaccttgagcccaggtcagctgcgtgtattctgctcagttggtgcagaaaacagttttgtcactcctatgtcaggtgttagggactcctttacagatctcagtggcatcagtacatccagccccacctggagactgctttctctctgaaaattccccagggcttctctctgggctgagagatctcagcacccgtatctagaaaatgttcccacccagacctggctggatgactgctgttgtagctctggaaggttaggaactaaaaagcccactcctttacctagggtagctaagatacactggagatggggacatggggatggggccgattatccaggggcctgcawgagggggcaaaaggccctgcagagagagggtagggaaggcactgcccagatctgtgaagccatgtgcgtgcacgcgggkacattcagacatgagtgcaaggagggaccgtgagcagggaggtcatgtgagaatacacaggcatgcctgcacacccatgtgaacttgagtgccaggccacacactcyttttttttttttttttttttttagctggagtcttgctccgtcgcccaggctggagtgcagtggcatgatttcggctcactgtgacctctgcctcccaggttcaagcgattctcctgcctcagccttcctagtagctgggattacgggtgcaagccaccatgcccagctgattttttttgtatttttagtagagacagggtttcaccatattggccaggctggtctcaaactcctggcctgaagtgatacgcccacctcagcctcccaaagtgctgggattacaggcttgagccaccgcacccgacccgcrcactcttttcaataatcatggatggccaggggtgcagggtctaaaaagcgckgcctagcccatcctgctgttcactgggcaagcgacgtcacaggtccaggcttcagtgtcctcatccatgctctgcgtctgatggcaatctagccaggatgtggggaagggaggatgcagtgagagcacagatatgagagcatcttggaaataaaaatgtacctgcaagaggtggtggtgaattttcttactcaggccagcttctgccagggctggcagaaagagggggtggcatggcatggagccgcagggggtggaggactggcttccactgctgtgcctgaggaagccgcggctgtttctgggcgggatgggagtagtgggagggggatactggccttgtgagaagaaaagggaagtgtctgtttgagaggtttttgaattagtaaaggaggacaggcgcaaactccaagcgcttcacttgcacccgggaccaaaccccaatcccagtggctggctccctgaggccgccccgctccgtcccgccccgctgacagcggctgggctggagaaggctctatacggacacacctctggggacggggaacccactgctcccagctaaagcaaccctgtttcctggcccgcctcagacagggctgcaggccttgtttgagcccctttcagggcacctggccttggattgtctgtggctttgcctggtccgctgtgacttcctttctacttgagccttgctaaggcagactctactccctcactcgtaagcagccaggcgtccagcaggtcctccaacgtcgatcttggccctaagacgtccwgtctgggcacggagttgttgagatccggcaggaagtccctgctccagggccaaaggccccwcccgggctcccccggatgtccccgcacccccctctattctcccaaaagaaagaagctgcttyccactttggaaacgtttattctgagcaccgggaaggggggcggcggcgggcgcctcactgggtgttgagcttcttagtgtactcctcgagagcgctcaggaagctgaccttgaagctctccagcacsggcagcaggccttggcggaggtcctcgagcgcgggcttggccttctcgctgagcgtgctcaratgctcggtggccttgssgtggtactcggccagtctggcgccgccgttctcyttgagagcctcaaggcgcgcggscragsgctggcgcagctcgtcgctgtagggsgccaratgcgtgsgcrgcgcgtccacatgggcgcgcgcgcggtcgcgcatctcctcgcccmgtgggctcmgcttctcttgcagctcgtgcagcttctggcgcgcgccctyttggagctctgcgcgcagcggmtccaccttctggcggtagagctccatctcctcctgccacwtcttctggaagtcgtscaggtagggctgcaccttggccttcacctcctccrgatccttgctcatctcytrcctcaggccctctgtctccttttccrggttatcccagaactcctgggtcacagggccgagctgttcgcgcmgcttgctgaaggtggaggtcacgctgtcccrgttgtcaaggagctttaggctggagggtgagacagaagggttgagggctggcctcccagcgccccagcctatcaggggtgarscctgggtgacacctgtccgcggaggtgcagtggcctagcatttccagtacactctcaaccaacacccctgccccgccaggccatgccccgttgtgcagctggaccgaggcacagagaggagctaaaaaggagacagagctgggackrgtgcccagttacgttggtctccaaagtgggcccttgaaggacctcgcttctatgcctccagcrcattctcctctccgaagacagcccacagtcttgctgggcaggagcagagraggtggtgaagaagggaaaggggcttgctacacttgcaggcacaatgtggctctgtgatcaygcatcgggcagccctggtctgtcctttkcaggggacatgggctgtgaccctgcctggagatcccattccrgtttctccatccagaccatctgtggggcccagctcatcagatattaggtgaggactcggccagtctggcttcaacatcatcccacaggcctctgccccctrcccctgccctcaaccccaggctgggtccttactttagctgttttcccaargyggagccttcaaactgggacacatagtctctgcsgctgtctttgagcacatccacgtacacagtggccaggtccttcactmgatccyaggggctctgggggggttcatcttgctgccagaaatgccgagcctggctccctgagggtgggaggggagacccagatcaggccagctgtgggctgagatctgagccgaaaggccaagcttggaggtgggggagagggggccagtgagaaacctgctgcctctgcccaggagggtgggccacggggatttagggagaargccccccgatggttggctccctaggttaggggacacctacccgtcaggaagagcacggccaaggtcagcaccgcagctttcatcctgaagggccgtgggggacctggaggagaagaagggcctggctgagtggggtgccttcagcatgcagaagccccgtgctcccccactcattgcagccaggtgaggagaagrgcacagagcgggagaagacctcaggtacccagaggccyrgcctggggcaaggcctgaaccttgagctggggagccagagtgaccggggcaggcagcaggacgcacctccttctcgcagtctctaagcagccagctcttgcagggcctatttatgtctgcagccagggtctgggctgggaggctgataagcccagcccyggccctgttgctgctcactggtcctggcaatgtggaacttaagagttcaaggatcagctctgtccctgggrctgggcaaatagagtgggcaaacagcaagctgcggggsstgcagggcaggggtcaagggttcagtgggggcgggaggggagtgtctgcaggcttgcaggtctcccgggtggggtcggggttccctgcactcatccccttcccctccatgggagtgtgtgggcagttgccattgtccatkgtgttggcagaggaggggaggggagggacgctgggactmctccaccaaggagactgcctcccccaccaccagcattccagggagactacttcactcccctcccccttcccccghcctgtcctcccaccagtgctcttctttagtccccagcaggtcctccaggcctctctccaagcctcccaaactggtaaacctggggagaggggagagccctccgtggctcccagactgaggtttcggagacctcttgcatttcaaaacactccagagatcaattcggagctgccaacttttaattttgtcatgtaaagatattgtccgcctccaaaaaaccctcaccatctacagtgaccatcacttcaaaaaggaaaggctttaacaaaaaagggcataatctcagaattacattacagaattgaagccccttagattgaagacgtctccctttgcattgttcacacttatatttgatcacgcacaggtgtgactggatctcagcccttgggaagccctggtgtggggagaagacctctgggcaaaggaagtggcaggagacctgctttctcatttcacttggcctccatcttgctggaggaagatcgtgggcaagttatataatctctctgagcctcggttttctatctgcaaaatggggcaagaatggtcagggttgttggaggcccctgagacagcctgtgaatgtaaagtgctgtgtgtccgttggtgtttgcagcaccatcttgtcaggtttctcctggaaggcccagacctcccycagcaggttactgataggacctgagtcctagagcctgtgatgcaggctgagaggaactgtgacatcactccagcctctccccatgccaccatctcacagatgaagagactgaagagcacagagggactttgcccagaggctgtcatctctcagggagttagaagaaaggctggacytagaacccagtctctggacttgggatgcagggcagaaatgtaccctgtaccatcactccaggaaactccctaacactagaaaccaggctgacatctctgtttaccagatcagggagtggtcggcctcatgcctttcacttcagagaagattctggagccagaaaacctcaaatctaa

SEQ ID NO: 13363 - DNA, 15584 bp, Homo sapiens
tggccttgcagataagaacacaggctctggggtctggtaaatctcattcaagttgccagctgtgtgtctatggcaactctcctagcttctctgagcttccatttggatatctacaaatagggttaataaagattgttgagggggctgagtgagatgatatatataaagtgcttaataagttatcttgtgcacaggaagatttaacaaattctaatgccttaaggctccagtgtaatccagaacaacagttctcatcctcccttaattagatggacatcaatgaattggccacagcaaagggtggggagttgggggagtcccatagtctctgagaaatacaggggcatgtctcaagtaatggtggactatgccaatgggaggatgtgaaattccatttacaaggatagcccagattgttattaaccaacaacagtgaggaaagagaagtgagaggaaggaggaaagaaatagatcctaggtcttggagctcagagaaaactgtgtggggccacacagggaacagtagcttccaagggcagcagacacagggtttgctcaggcaggatgtgagggaaggggtcctgggttccccttccacggagagaagacccaaccgaaggacagcatcaccagtggggcttaccccatcatgcttacttagaaagtagtgatctagaaataactacttgattaggaaattagcacttgaggattctcataactagttacctcttggctgcttggagtaaaaggcagaacaggttttacttggaaatgcagtgccttttttttttttttttggtcattttatgctgtgccttcctagaacacataaccattttgttttattcctagagaaataatccatgacatatgagcttttatcacaaaataaaaacatcaaactttatctttggaacaaaataaatggttgatcattgtcttttgtcatttattgtaaaatatgttayctatgataactcttggtatgcatctcactctaatcttgatatttaaaataggtgagtaattgatttctgagcgtggtgtatttgctctgtagcttatatgcatacttacattttgatactgaaagaaatcctaggagttaaacctcaaaagtcatagactttgcctagataaacatctgctgttttaatggtattttgaactgcagagctaccgtttaacaaccctgtattcttttcttttttataactgrgtgggtggggaaatgggaaagaattctaaagaaccagtcacctcacctgtctccttctctctgtttcatcctttgcagaggagctcctgcaccacgcatgccttcctcatgcagttagtataagagtccaaagaaagaagcggttgaaaagcacttcagaaattctcaaaccctgcaccaatgtaaggaactacagaactgcaggaggctttactcccttgttggttaatcacttttcaaatgtgttccttgttcaggtaaatgtgacatctgctttttgtttgttacctgtctactgggaaccatgtgttggtcatttyatcagtaacacaaatttaataaatgttcacaaaattaaatgtattagtcatttattcatttamccaggaattcctgagcactctgtatagactatgccctgggaatagtgatgagcaagagagtccgttgtagtgtccattgtcatggaactgacattctcctgggagaaccagacactgaaagaggcacaggcagatggcagtgattgctatggtcagagaaggtcttgctgaggaggttgtagttgagctgaaaactaaatgatgagaacaggtcacgtagggaggagctgaggaaggagccagcaggccaagcttagcaagggtaaaggcctggaggatggaaatgaaaagaaactgatgtgacrggagggtagtaatgagggggtatcaaagagcgaggcacctggaccagaccagaccacatttccaaacagaaacatgcctcattcctgagagtatatcccaaatggagcactcctctctttcatgaggaagggctgggtgaaggcttacattcctttctctaagtgagtgagcactgggggtgcattggtgcatggaaagggtaagtaacctgcccaaggaacaccagtggccatggatcacttgaccctgagccagctcctgagggtagcagggaaggtgggtgacccaaggcctgctggtcaagccaagacttaacttgttaattcattcacttttctcctaacttcaaaatgtgggacttttcctagtaaaccagagcctgcctgagatatctttgctgcagctaccgggtttcattgagagaagatctttggttcattggaccagcgagctcactccacaaaaagcctcaggaaatggcaggcccccaacacttcggataatctggcagtctgtggcccaggtcccctgctcccttccctctgtacagatacctgacctaaataaccagatggggaaagggagaagagacacctgagcaaccaacccctagctctacccttcccaggactggaggataatagttgatgtcttcagaaaatgtggggtggggtgtgggaactcagccagggggtggccaacttttcctgtaaaggggccagataataaatgtttaggctttacgggctacatacggtctctatcacacatgcttgtttttatttgttaattatttctttataaactttaaccctctgaacccttaaaaaggtaaacactgttcttagcttgtagaccttaccttcaacctgaaaagtggattacagtttgttgaccgctaacctcggctgctttgccctaacaaacttcaaaccggatgccacttaaaccaagttagggatggagcagctgtttcttttaatctctatgggagtaccctgaggggagccttcactgacaactgcatccctagatccccattcccactttccacatcaccatcctcacttacgagtgagtgagaactgacaactgcaactgcatccctagatccccattcccactttccacatcaccatcctcacttacggtcaggaaatggaagctgggagaggccaagcaatcccccaaggccatggagctagcaagtgatagaggcaggacttgaactcaggcattctgattctagagtcaccggtcttaaccactgcactgtactatcccctgctagaaactagagctgtggctttctcttcttgggcaaagcccccatctgtacaacaggaggggtggggtggtgttttcctcaatatgaaaggcatacccgatggcaggtgaaatgatttccacggttcacacagagagcatcagataatattgattcacagaatgaaaagatgattgccttttcacatctctctcaagtcttccaataatgtcagggaaggaggtttagtctgatggtaatgtatctttaaaatctctccaaagcatgctaattttcttttcttttctttttaaacaagaacaggttttataactcaggatcctcagtaggcagtgatagctagctagaattttagtatcactgttgtactattattattacttctcttgttagtctcatggttttattttttattgcctttctgaatatttgctatttatgaaaaatgttagtgttgccattgctgtaattctcttgtccatttcttcatmgttataatattgctgctgaagctcctgccatcacacccaaattggaattaaggggaaagacagggttcagccacttttgtctcctattaccaggaaagcaaaataattttacatactttgcattgatcraaacatgctgcatggctacakgtagcagcaaaagaggctgaaaatgtgggtgtttggctggatacattggtaccccaaactaatcagaattctaccatcaagaaaaaggcatacatccagtgctttgtaacaaaagtgtttgccacaggctgggaatcctttgagttttctcttcagtgtctgcaaagagcagggatggaagtcagagatgtgggatggcttaagggaatttagcaaaayacctgtttctctttaccttgtttaccaccaagacactcccttccccatagtgcagtggaacactgacgagccatcatcactcctaagaaacaatacaaaatgaaaaaaaacagtattgccatactcttacagtggaggcgaggaaatcttatgagtttgtccccactggctattatagttcagagtgctaagctaaagaacccctcaccttttcaatctactgtgtagaagctatatttacttacctgcacatacctccaaatatgtatcctagaaatcagatttgaaatcttataaatcccagaagtaggaagttcgtatttcaagaactacttttcaaattagtgttttaattcaacaagcatttagtgagtgcccacagttccccaggcacctccttaagtgctgagaatataggggtgaactggacccataaagccctggagtatatatcctggtgggagaggcagataaaagatctgcagaaaaayaggagttcaggaggattaagagctgaaatcaggaggcagacttctgggcttgaatacaaattctgcrgcttcctggctttgtggttttgggcaaattacctgcctctctatgcctcagtttctccatctgtaagataataagaataattatagtacttcatagagttacactgagattgcttttttgactcatagtgattaaacacagccatactgaagggccaggaagctaagatgtagacagtgttttaaagggtaaaaaatggtgatgacaaattactccccacctcatttggcagccgagygtattacatggcttaatgcatgtaaagtacttagaaatgttgctagtatggtcaggcmcagtggctcaygcctgtaatcccagaactttgggaggccaaggcgggcggatcacgaggtcaggagttcaagaccagcctggccaacatagtgaaacctcgtctctactaaaaatacaaaaaattagccgggcgtggtggagggtgcctgtaattctagctactcgggaggctgaggcaggagaatcgcttgaacccgggaggcagaggttgcagcgaacctggattgtgccmccgcactccagcctggtgacagagggagactctgtctcaaaaaaaaaaaaaaaaaaaaaagaaatgttactagtatgtagtaagttctcagtaaatgttagctactatactctttcaagtgctgggtttttacttgatgtcatacagtgttatataagatctccaaagatactgaggagtcctcaaggccaattttaacaagcatggttgccgcattcttgtgcttatagttgaacatttcttctttcagacacttgcacaaagggatacttctaagatgcatttgcattaggtggcaaacttcatcctgggtatgaaaaacattgagatttgggaataaagcatagtaagactgaggttgcaattactaaaggaaaaccccaacagagataagtgaagttctgcaatatcatgcaccctcccccaacccgctctgtctccccaggccccccttcgttagaacacccatgactggctatattatatcagcatttcccataatgtaaaaagggmvaatacagacctgggcgttcatggaaagtattctaactctcacaaccagaatccctgtctttgaattttttttcttggtttttagatctttaacttttccttcagcatttcagtactcaactttttgaaaatcatcttttctgaggaatgatatttcctggcacagcatcatctctgtcaagtgactcagtttgatttttttgtttgttagtataaagtggccccaacttacagagaaaaagtgggctcttggtatcagtttgatgtcagggtttttccgtgtttgagagggagctttaaataccactcgatttgaaggtgtctgcaagcgagctccagtccgctgtcaagatgcttctggccatggtccttacctctgccctgctcctgtgctccgtggcaggccaggggtgtccaaccttggcggggatcctggacatcaacttcctcatcaacaagatgcaggtaggctgcagggggagcccatgggaaagacagctactgacaaagtgaaatatgtatgaggatgaaaaaactcggggctgactaaaggttcttatctctctatctactttaggaagatccagcttccaagtgccactgcagtgctaatgtgagtgaatgctctttaagaactttccaaattaattttaattttcacrtctggaatcttcactctgaaatttcccttgcaggtgaccagttgtctmtgtttgggcattccctctgtaagtatagtgaaataacataatgttgaccttggatttttttggtttgttwttaagtaaaaataagttgctttatttaatatttaatgttatacattgttgcttaatttaattgttacagattagtattccctgttaaaaccacattgttacaaattattcccttttaaaactaygatcttgaaatcctatattatgaacatttctttgtatttaattaactttatgcctcttgagaagtttgaacacttttcaacattaaaaaaagaatcctgaatatctttttagataggtggccatgtgcacaattaaataaaactggaactaaggatataataattgctgtagctcatatcatattgctttctaactcatttactgataactctagagttgtgaaacaatgtaaataaaatgacaactccttatctttcatctgtcatgaatgatctatgcgctatacctccccctccctgcctcctcccttcctccccaccaccctgttgtctgtctagctgattagagtgactgttggtttgaatgctgccctctgggcaggtagaggatctgaggttgtgagtggaaggagggcttccagagggccactgcccactayggcaggaaggatgggtggcaggaaagttctgattcctaattcaaactcctggttagggtgaggaggaggcacttctccaaggtgcagtgctttattctttctcatgcaaggcctgggagaatctgaagaatctgagcttcttgccctggctagggtaagacatcgcacccatcgcggtccatccattagatgagaagaggatagagtgccttctgggcagkaaccaggcagacagcacagcccctgtcccttggagtacmgtccatgtttttagctgctgctgaaataccagctgcattcaattgtcacatcccattagctggtgtgaaaaggcttttcctcactctgcactttcagacttacaagccttgaagccgggaagcacccrttgaaaagaacattcagagccgactatttcagggcccasagccctcatgtttcctggatgtaacatacaggaagtctcctccaggggatgtcactgtggaaaaatggcatcccctttaaatacgggagatcacttcctacattgrcaagggacctgtctaaaaataatgcaagtttgagtaatgktgattaaataaaaatcatctctattatattgctctttgtgatatatttccaaagctgtcctcagaatatttctttgaataaatccttactatttaccaggacaactgcaccagaccatgcttcagtgagagactgtctcagatgaccaataccaccatgcaaacaagatacccactgattttcagtcgggtgaaaaaatcagttgaagtactaaagaacaacaagtgtccagtaagtttgttttcatatgtgatatgttcctgttggtgatttctatgtgaatggtgatgccaaccctgtttgaacrcaaaaggatgataaagttggaattggtagttcaaggttgataaaagacatctaagaattttaatcagaagtaatataattaaagtgagatccactgaaacaatagaattaaagtgagatagatcattgttcctgacgaggccatttacttctctctactatggaataatgaaagaatcctttctgagtgtaattagaagctacaatctagagaatcagggatgtagctcacataatactaaattatcctagagattcaatgtactaactgaatggatgttgttaacagggatttttttttcctgttggttaaggaggttttgttttgttttggagacagagtcttgctctgttgcccaggctggagtgcagtggtgccatctgagctcactgcagcctctgcctcccgggttcaagtgattatcctgcctcagcctyccgagtagctggcattacaggtgcgtgccaccatgcctggctaatttttgtatttttaatagagatggggtttcaccatgttggccaggttgctctccaactcctgaactcaagtgatttgcccgccttgacctcccaaagtgctgggatgacaggtgtgagccaccatgcctggcctgcattaaggaggtatttaaagggcaatgcacccaggtcaaggtggaagcttgctactcatcctgaatgcccatccacacattcttttcttcagcatataccctagtycctgacagcagactgggatggcaagttgggtagaggtgacctccctctgttttttgggtattagcatctccacacaagatcctagaaggctgaaagccctgagctcagctgtttagctgcatgcgtttctaccatcaatggcatctagttctaagtgcttaatayatgctgtctcactgaataaatacataccttagggacaattattcaatttattactctcagtgaggttaactaatttgcctaaggctgcatatttgataagtggcagagctgagatttgaactsaggcctatatgacctcagagccccactcttagccattgtactgtcaaatgaccttggaaagacaacctaaaaggataatgatacaattttaggcctcaaagagtccccagaaaaggctttctctaatgcagagatttagggccacttaataggggtgtktgtgtgtgtgtgtgtgtgtgtgtgtgtgtgtgtgtgtgtgtgtaaagacccctgaaatccaatttgaggtcaaccacmtatgctgtctttacaccacatgagctagcctggacctgcccacctatttgctctgtgtctcaagccacttcccttcccatccccacaatcctcaccaccgactctggctcttggcaggtaggcttctggggctgcttggctctacatcatttgagtcactctgtccttatcaactttcatccccacagtatttttcctgtgaacagccatgcaaccaaaccayggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaatacatatgtggaaaaaacaacatgagctggtctcttggcaattattcatttcttgctgctcagaacaaagaaagctacaagtgttgttaaggggaagaatagatcagagactcctgtaggagtctctgtgataagactcctgatrctgaatacagaccctcaggctcataggctgtggctggagctgcaggagggctgcagggagcagttacaaagaatgtctatgaggaccatctgagggttgccactaggggaggctgaaggcatgtctgacactgctaagagggctagggtcctgagaaactggccttgtgcctgaaagaggagaaggcagcagcttggaagtgggagactgctcaagaatgtgggcatgcagaataaatgcttaataattaagtgcttaacccactagttatggtaggaagtagatattattattatgcatttctgttttatatatactgaaaccaaagcttagaaagtctgcatggcattcccaagatcccacaggtggtgagatttagaagaaggattcacccctcgtgctctctgcttccaaaccctttgctgtttgcattctgcccctttcttattctctttataccaagggtgtgcattgtgcttcttccaaccacagcctgagggtaaaatagacccatcataattccagtccacactctcatatccagaaacctagggagtcaggtttcagaattcaagctttttagccttttagaaagttaaaacaatccacgtgccatatattacataacacccacagcagggcctggggcaagtttccataattaaacatatcaattctgcaacagtcactgaaatggtcaggttttgcagccaaatgagtcctaacaaatcttgagttttcgcagctgtttggatttcagaataatgataagaaattagtaagctgcattaacaaaacagcctttctctagctcatgccctatttaacaagggaggtgggggtggggggcactcttacgaagacattttatgtggggctgggctgggtgtctccaggagggataaaggtttctgtagcttcctggacagccagccacatggagttccagatcacagctgaagggccttctcttctcctctcctccatgtgggttttctgaatgactggcgccagacatagttgaatcatgtgacactatgtggtttaccacctgtggcatggggagacaccagcccaagcaggatcccagcagggacagatactgatggttggtgatggtttcagaatataactcggaaatgcaatgtcttgccagaggagaygggcagagacragcttccactcactgatgcagattaatcaccagcatagcttggtgctttccctaggcttttctgcaaaagtcacataacctgcagtgttcattcctgcaggcaagctccaaggagggttcacttacagtaaagtgtgctataattaccatcttctctgtgccaggagagttgagattcatcaagaagccaccctggagaaaggagaactaatatttattgtttactctgtaccaggcagtcctctaagcctattttgtagaatatctggttggatcctcacaacaaccccrtgagatatttatataattgttgtatgtaatttttcccactgcacaaatgagataagtaggcccaacgaggttgcataacttggccagaagcacgttgctcacaagcagtgaagttgctaccctctccaggttgccaggccccaggcagagttgtttccagcagattccagatcaaagcacacactgcargccaagatgtggccagccataaagctagcttgcccatctatccatccatccctccctctttacatccacccagtttgaagcaggaagatgctgtgatgttcaaacctcacaattcctctcctcccattgtcacattgtcactctgcttcattgaccccagaccaagacctccctttctctgcaaaggaaggcctcagcagaaactcaaagaggacctaaaggtcttcattctttatttttatcactttaaaaacatggctttagctaggcacagtggctcatgcctaaaatcccagcactttgggaggctgacgcaggctgatcacttgagcccaggaatttgagatcagcctggtcaatatggtgaaacccagtctctatgaaaaatacaaaacttagctgggtatggtgacatgcaactgtagtcccagctactcggagtctgagatgggaggatcacttgagcctaggaggtcgagggtgcagtaagccatgattgcaccgctacactccagcctgggcaacagagcaagatcctgtcttaaaaaaaaacaaacaacaacaacagcagcaacaacaacaacagcaaacagatggcttcattgagatacgcttcatataccacatgcaatacaattcatccatttgaagcgtataattcaatatattttagtacattggcaggttgcacaaccctcactttttaaactgtgtcatattatctgtaaatagaggtaactgacttctttttttccaacttggatgccttttctttcacttccttggctaatttctggctagaacttccaatacaatgttgaatagaagtggtgagagtacacattcttgttttgttcctgattttagtgggaaaggatccagtcattcacgattaaatattaatatgatgtgagctgtggacttttcataaatgctcagtatcaggctgagaaaattcccttttattctcagtctgttgagcacttttatcatgaatgagattggactgtgtctgatgtattttctgcacttattggtatagaggttattgatacagaagttaattcttggctttagagtttccagtggtaaccttcctagccctgggatagaaagtaactccttggactatggaagagaagtccgagaggagaggatgatggcagacactattgagttccctggagaagagctctctgcctggcccccagcagagcctcggggtagagggcagaactcctggggagggtagaaaaccaagagtgaagggcacatgagctgtatcccctgaatggcctgggagatgacacgaaaagagaatgcctcttgccaccacacctaaggtgtggtatagggaggaccacccactggccctaggaagctgggcttgatgcagccccctgaatagtttcaacggagaaaccaaagattttcacacagggcagagaggggcactgatgtgtcttggaggatggtaaggctggagaggccttgggatgggcacatatgtcaggctcggaccacgggacagggaccaaatgggactgaagatgcttatacagaagccaccctggagggaaagccatgcccaggactagccaggaagaacaccagggtaggacagagcacctcccaggaccctgaagcctctccctaaatcccaaacctcccagatctaaagtcaaccccaggggaaggtggagaaggaaaaaatcttgaactgggcatttaacttggaatttcgaagttttaccctgaaatggcaaaattatttttttctgtcatcagcttgaaaaaaatctcaatttagttaataaaaaataaagaaactttcatttatttgctgcagacctgaggatgtgatttaatcactcaacagacactaataagtgcacagtgaggagcacgcactggactcagcgtgcggtgaggaaggcgctaccgctgtcctcaggatccacgggtgcaggagcggggaaaaacctggtcggtgctgagaggagactggaggcacggggacgtgttacttgagactggagggagtggctgagcccagagctcactggcccctccccatcctcagacagaggagtgaagcaacgtttctctgggtggtttctggctccctggtgctcatggtcaggacttctcagctggaccaaacatttcttggaaagctctttgatgccagcctagcagagtgggcattggggatcagaaccttggagggcttgaatcagtgactcatgaggcatcccaggcatcagaagggccacgtcagtgtctgcaccatcctagcccacgcttgctaattgatgtccacttggaggtccaaaggccaaacatctgcagctctcagggcttcacatgcagagatgaggcccagggaacactgtagtcatcctgtgttcacctcctggaaamagcaaacaacccagactcagagaagaaggcaggcaaagaacagaaaccagaaaaatcacaccaggccaccccttcctctaacccctatgttttgcactttacagtttacaaaaacacttttgcacttgattcttgtggaagctgtgcaaagtaggtaagggagaccagtgtggccattttacagatggctcagggggcactgctgcctgcaagagcacagggggcactgctgcctgcaagagcacaggtggctgatggcctgcgtgaaactggaacccaaggggaaggcctccctaatgtgaagttcttgccaccacagagaaggaaaagggcaacgccaagggagatggtgagacccaggaaacaggaaaagaagtgtcacggggcccaggtgttctcaccacagggccaagatcgtgcactcccagacgcggattcctgcggagggtttagttgacctctactgccaccaagtggtggttctgcagggtatcagcctttgggcgagggatatgtatatacacacatatatatgtgtgtgtgtgtatatgtacacacacacacacacacatatgtattttttcccctgtagggcagcagttctcaaagaggacccacgaggtcaaaaccactttcatagaacactaagatgttatctgctcttttcaatcttatgttctcacaagcatacggtggagtttcccaaaggctataatgcaagtgataacccatagactaaaagcaaaagcagacagaggaacacaattgccctctgtttaagccagacttcgccgcaaaaacggaaaacgcaagtcttctcgttaattatattggtttagaaagaatcgttattttcatagaatgttatttatkttaaaatgtcatgggtttattattatacctaaatggataaatatttttgaaattctgtttgaatttccagtaattgttggtaaatatataagcagttgttcttcgaggtccttaataattttcaggagtgaaaggggctgctgttgaggactgctgctgtatggtaatgatttttgttcttcttttcatctttcctggtaaggcaaattggccaaccctgaagccccccaactccaaggcacagacaccaaaactggtgcttggcttggaattctgttttgttttcatccttcttaaaaataggattccatttgtttaaagactttcctgaccatgacaacagaaattaatgcctgatactaagctccctgagggcagggtccctgccattgtcacccaatgcctgtaacagcactggccacagtcagactacacacacacacacacactctctctctctctctctctctctctcwcacacacacacacacacacacacatatatatattttatwtatatatatatatatatatatatatatatatatatatatatatatttggttaaatagaaccataatgtgttgatggaggaagactcacaagctgttggcccaactattccacaagattgccctctccagaaaaatctaagaggaagcagatccattgctggctgacccctcccagatctggctacctcatgagatttgtttgggctggagctgagtttcttcaataaagccgagtttcattcattgcagcccaggtgctcctgrgtgggagtgaaggtgcagaagatgtgctgaggcattgtctgcccagcatggaggagggcggggggagggggtgtggcaggggctgttactcagagctgggctgaggctgggcagcgaggaagagcca

SEQ ID NO: 13364 - DNA, 86361 bp, Homo sapiens
  misc_feature (1)...(86361): n = A,T,C or G, or insertion/deletion polymorphism (see Tables 1-2)
gcagcaaagggaagccaagccttagagaagcctcatggaagggcccagaacatcctgcacccatcagttactcggaagtaaggggacaagaagcagctggaagagagctgggtgtgggggctgggaggagtgctggagaaatttccccatcagaaggcccctcactgggcagtggaggcagggcagtgtggtrggactgactcaacagacatagtttcatctccaccctgcccttctcaggttgtgtgaccccagccacatggacacccgagtctgtgaactaaagggctggtccatggcattaacagtggagggtgtccaggttcttgatgtcttgaacaaagaattgggcaaaatgcacaaagcaaggaaggaatgaagggttttactgagaatgaaagtatactccacagcatgggagagggcctgagcatagggactcaaggggcccgttacagaatttttgggagtaaatacccactagaggattccattggttacttgaggtacaccctatgtaaatggaaaggatgaagtaaatttacaaattcatttacagcatataccctatggggaggatattccctgttatagctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacctccttcctcctgggctctttcctctaataccgtcatcctctctccaacctggttaatcctgtcctttctgccctcaaatgggcaccttcaaagaaacaaatagaactactccactcgctccctctctccctccctttactgccactattgattgttatagtcacttgctccaggaagtccacttgctgagtcttmctgcagacagagcccaccccctgagctgtaaaggccctagggcacatgtttgtccagctgcctcttgcagctgggattgttaggtcactatagcgctaccaactgcatataccactgtgggagtcgtgctggtggcggtagtggtcacaggtaccaggggcagcagtgaaggggtggctctaatgccaagtccagtgaccagtgccagggtgcccagtggtggcaacagtggtgttttcagtgtgatcttggacattgctcctgtctactcagctgctagtctgtgagctccctgatatcctttaagacagcgttttccagcagcggcactattaacgtttggggctaggtaatcgttgggkgtgtgagtgtgaagagggctgtcctgtgtgttgtaggctattttagcagcatcccggcctctccctgccaggtgcctgtagcagtcccccagttacgacaaccaaaaatgtgtccagacattgccagatgtccactgggagggaaaacctctctggtccacagcccttctccttattccagtcccacatcttcctccccttccccatcactgtcctcagagagatgctgttgacagctccttgaggtgattctctcaggcttgttgttgtagttctctgctgtcaagtctgagctgactctctcttccggattcttctttcctcacctgcccccgtttgcatgaagttttttatggagctgtttctattttctttttgggcagccatactctctaagacctaaaagctgaatactcgcccggttactacctgataattctcatcgcttatgtttccaaaaccaaactggttatttccctctctaaccccatctctgtgtcaaacagtggagtacatgcttttggttaatccaattggaaggcttcctagaggaagtaatatctgaactgaatcctgaaagattaggggaagaggaagaaaaggacaggtgctgtgggaaaaaggggaaagtgtcagaggaagtaaatgaaaaaccatatacaaaattatcttctgtgacccgtagcacatgcccaatccatggtagatatcgaaacatagtggttacccagtctaatccatcccttttctttctttctttcttttttttctttttttttgagacaagtctcactttgttgcctgcctggagtgcagtggtgcgatctcggctcactgcaacccccgcctcccgggttcaagtgattcttctgcctcagcctcctgagtagctaggactacaggtgcttgccaccatgaccagctaatttttgtattttcagtagagatgggtttcaccatattggccargatggtctcgatctcttgacttcgtgatctgcctgcctcggcctcctaaagtgctgggattacaggcgtaagcaaccgtgcccggctgtccatctcttttcagatgaagagctcaggttctgaggagtgacttgtcaaaagctgttctacctctcagagccagcccttgtcctcctgctagccagagcaaggtaccacctggaagagatgttcagttacatgggatccagggccagagggaaaatatcagtgcttcctgaggttcgggtccagccacccttcttccaccatttctactgagccttcagttgtaccccttcagtccacttggcgaggcatcacgccctctgggcaggctcagtggggaactatgggagcaggtgctgtgtgccacctctggagggggtyactgaggttctgggttgtggggggtgccctgggccagagtgagttgtatgggagttgttgctgaatccccccagagtaccagtcacacaccagtgtgaggggccttgcaagagccactgggcagcacagttgaaggtggcaccttcctgctcagtgctgtgtccagagcagggtttagttttctgtgtctttcagggtgagactggtgtattctataccagcctccctgtgtgtgaacaatgacgagaacaatgttgtcttgctttcccaaaaaataagacactatctatttctcattagttatacacgttcattataaaacgtaatttaagcaatactgaaatgccaaaaagaaagtaaaattcactccaaaagtaaaattcaccccaaatctcactactcctgtaactatgtctgacagccagctgttgggtcttccatcgtttttaaccttcaggtgagcacacagatccttattttttcttttcttttctttyttttttttttttttttgagacgcagtctcctgttgcccaggctggagtgcaatggygcgatctctgctcaccgtaacttctgcctcccgggttcaagcaagtctcctgcctcagcttcctgagtagctgggattacaggcatgcaccatcacgcctggctaatttttgtatttttagtagagacggggtttcaccaagctggccargctggtctcgaactcccgacctcaggcaatccgcccacctcagcctcccaaagtgctgggattacaggcgtgagccaccttgcccggactctctttgtattttttctttcttttttttgagacagagtcttgctctgtctcccaggstggagtgcagcgacatgatctcagctcactgcagcctctatctcccaggttccggcagttctcctaccggttagctgggattacaggcatgcgccaccacacccggctaatttttgtatttttagtagagacggggtttcaccatgttggtcaggctggtctccaactcctgacctcaaatgatctgcacacctcggcctcctaaagtgctggaattaccggtgtgagccaccgcgcctggccagatccttattttttcaattgcaatacagcagtatgcaaggcacttactgtatgccaaagcttatgccgagagctggctgccagcagctcctcctgcctcgaggcctttgtccatgtcatcatttcccctttggctgtaacagctgcagttctctcataattttaggtttcatcttaaatgtcacttcttcagaggcttcttgacagcacaagtcagggcccttgttagtttcatcacatccattacctttccttgatcacttgtaccatcatctgtaatttatttttatgtttaatacrggtgtgggatttctgattttttttttgctagactggaagctctcagagggcaggaaccatttgtttccctgccacagagatgttcaataaatattgtcaattgaatgtgcaaataatctcacttaaccacagctatgagggatgctattttatccccattttagagatgactaaactgaggcttagaacaattaacccaaggtcacagtgaattagtggatccatgtgtctgcctccacacagcctgtgtgttcttaattattgatcactaagcaacagctgcctctcacaaactggcaggaaacttcaacttttcccttttatcaatatattgtgaacgccttttcttgctaataaatatacayttgtgtgcgtaatttttaatgatcccatggtattccatcgtgtggatgtaatttacatattcatttccttattctcacttcttcctagttacagcacttctttaagcacttgtaatttttattcctttggataaattcctagaagtttacaacacgaccagctgcaagatggggcagtgaggtgcttgaagsagtgggtgggctgcacttcagaatcccggtggaactttttcaaaaaactcgtgcccggggcccccctctcaggaggccgtcggtgggcctgggcactggcgtggttttcaggtcctcagtggttccgaggtgccagagattgaggaccactggagtaagcgcgaggtcacggcgggtgcaaagcagaagacgtaaaatcctgaccgccctgggacaatctgcaaccttgtcaagcctccgtgcccgcctttgtaaggaggctgggagaagcgggacttggatgacccggactcccgtcccgagcgctggggtccaggtttgactccgctggctttctcaggcgggcagggcgggggtaggcagctgggaagatgacgtaatgtgctcccagccaggcctggaggcggccagcggtcgcaggtggagggtggcctgttaacccttcactcccaggccagtggacggacttgcgtgtggcgcagatccaacggagaaggcagcggctcctttaaacaaggcggagaaggttaagatgatgaccggacggctactccaggcattcgctccgaggccgcggggggagggacctcactatgcaaatctgagctgctgatcgatgacgcgccatcaccccacgcaccgcttcgctcgcccattggctgagatgagcctggtcccattgacaacaaacaggggggcgcgcggcctggaggcggggccgcagggggcgcgggctggggcgggggaatcccgccccgccctttctgtgcggcgcccgggcgcaacgcaaacatggcggcgggtggcacccgtcggtgaggcggtgccgggcgggggttgtcsggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacggtgagtggtgggtgggtgggagtgcgggggccgcgcggggaggaaggggttacggcggcgcgcccgggtgcgcgtgcgcccaccccccgacagccccggttcgcgcgggaagaaccccgtgcgcacggtgcccccggcggtcctcaacccttccggcgctgcgagcgtgagcccgacccagctgcgccgctccgggaggycgtgggatctggggcgccgcggggccgaaagcggcgcgagggtcgcgggttccagagcgcggggctagggacgtcgcgggggcgtctcagggagcggcctaaggagagcgcgtggccgccgcctccctcgcgcgcccacacgcggtttccgtggtccgctctcccgccgcccgcgaccgcgcgtcgcacctgtcactcccttcctggccgcggggacgtctttgggattcccggggcccagcccccagtctccgcgccccgaatccctgggcttctcaggattgaccgacggccaggtcgccggrtgctccgcgaaactttgggcagcgactgcagaagcaagttgctgatgaagagagcagtggcggcggagtgtggacacatctctccgggatggagacccgggcgctcctgctgtcmcgctgcaaggggaattgagcagaagaaattttgagttgtggcccctcgggtacgggctggggagcgggtggcctttgttccagcgccttaacagcggagtggaagagctggtaggagcccagggatccactcttaaaatactaattttgcgaccacgggaacaacgatttggagagggtcagcggcttgctcaaggtcacccagctggttagagcctagttcttgcagttccttggccagtattggtttttttatacccctcctttcaagaaagagtccagttgactaggctagtaatcttattaactggatagttgcactcttatgtttaggccccaaaatgctttgtattatttcacttcttcctmaacaatcctgtgagatactcttattacctctattttaatacggtaattaaagaagccgaggccaggagatgttgacttatctaaggccactcaccttagagagcttaggcagaaacacaggtgcattgtacttttcagttttcagaatgctttcatgtccaggatctcactacagccttgcaggcatgtatgatggctacatccccgttgtgcagatgaagaagcagaagcagcaraagattctcttttgggggaagagataaatgcagcagctaattgaaaaggatctgtttgccattttcccattttgcttttgtaatatttctccccttggtttgtccttgatttccattttggtcatgtgggcagtgtgataagacccttaattgaagccccagttctaaccacagactctttgctaagtgcttctaaatacagaaatgggttaacaaatgggggatggggtaggtgggggttgggaacatagcaagggcagctaacatgttttgagaacttctgtgccagacggtgttaaacagttatacacgttaatgttctcaatcttcctaacaaccctgtcaggtagagagaactgttatacttgtcatctccctctcactgatcctgaaagtgaggcccagggtggttcattaatttactgaagattacacagccagtagaaagtactgtatgtctatagctgcctacctgcaagggcacagaaagaaattcatgtgcattttgcattcctattccatgatcaattcctatttgtcttattttgtttatctgatttttaaatttaaatttttatttatttagttattttttgagacagggtctcattctgtcacccaggctggaatgcagtggcacaatcayagctcactgcagccttgaccttctgggctcaagcaatcctcccacctcagccgggaggctgggaccacagaacgcatgccaccacacccagcaaattttttgaattttgtagagatgaggtctcactatgttgccaggcacaaactcttaggctcaaatgatcctcctgccttggcctcccaaagtgctaggattacaggtgtgagccacctaaattttttttttttttttttgagatggagtttcgctattgttgcccaggctggagtgcaatggcgcgatctcggctcaccgcaacctccacctcccgagttcaggcgattctcctgtctcagcctcccgagtagctgggattacaggcatgcgccaccacgcccggctaattttgtatttttagtagagacagggtttctccatgttggtcgggctggtctccamctcccaacctcaggygatccgcccaccttggcctcctaaagtgctgrgattacaggcatgagccactgtacctggccgagccaccgtgcctggccgagccacctaattttttttagagacagtgtctggctgttgcccaggctggagtgcagtggcacaatcatagctcactgcagccttgaactcttgggcttaagcaatcctcccagctcagcttcccgagtagttaggactaaggcatgtgccaccacacctagctaatttatatatatatggtagagccagtctcactgtgttgcccaggctagtcttcaacttccaggcacatgcagtcctcctgtcttggcctcccaaagtgctgggattactggcatgagccactgtacccgaccctgtcttaatttgtaatgagtttaaattacctagtggttaatactgtctttatccccacagatttctgaataaaatggaaactaccaccctctggaaactaccacagtggttcagtggcttcataggtccattaggtttgatcccagtggaagaagattccatttctctgtccttccagaagacctggtttataacagtgcataaggctttttctcaaaatagttatataccgcacaaggaagaggtgtggctgttgtgtcacaggagacctaggggccaggtttgggaaaagtggttccatgtcttcagttgatcaacaagtattcaagtgctggctgtggtttctgagctgtaaggaatcrtgaaagatagcatagaattttatggcttcatggagcttgagatgagaaactctagtgccagtatggaacagcttaaaattgcacagcacaacaagtaaaagtcagcagtgagggtagcttggtaaaggctggcttagcaggaagaccacaccaaagaggtggctcttgacctgggccttggaggacaaaaagagttgggcatgctgaaggtcagtggtctgaagataaaattatcccttgattctcacccctgtgttcccattactgaatgttagctccttgaggyagagaccttcgtttcattcccactaaattctttgaacctagaacagtgcctggcacagtgagagtgcccattaaatatttgtggaatgcctgagtgatccagtgatcttgggctgggcaggatactaattgtcttggacatggtttggagttggattagatcaaggaaatagccagcctggatgcttctaggagccggtcaggtgaggaaggggagaggcaggcagggtgagtacatttacttcctttgtatgtgtatggtggggataaggggtggatgcaacctagagagcctccaggaggtgcaggcaggcaaggatccattcattccacaatgtctgctgtgttccagtccattggtacccttcaaggatatgggctcagggaggccacattcatttactcattgaatggcttctaagtattcatgatggacaaaggataacttgagcgcgacagatcatgtgtcttctctctcacgaagcttacattcttgatggaggaaatacaagttgagtaaaataaatgaacagtttaggcagggcactgtgagcaaaataaaattgggccatattatagagtgtgactgggctagcctacttagattcggaagtccagggaggcttcttggaagagaggtatcagtgtctgtttttcaagagatgccgaagtctggatttttatttgaaatacccagatttttggccgggcacagtggctcatgcctgtaatcccagcactttgggaggccgaggtgggcggatcacctgaggtcaggagttcaagaccagcctagccaatatggtgaaaccccatctctactaaaaatacaaaaattagccgggcatggtggtacacgcctatagtcccagcaacccaggaggcagagacaggagaatcacttgaacctgggaggcagaggttgcagtaagctgagatcatgccactgcactccagcctaggcaacagaatgagactcygtctaaaaaaaaaaaaaaaaaaaatgctggacacggtggctcacacctataatcccagcactttgggaggccgaggcgggtggatcacctgaggttgggagtttgagaccagcctgaccaacatggagaaaccccgtctctactaaaaatacaaaattagccgggcgtcgtggcacatgcctgtaatcccagctactcaggaggctaaggcaggagaattgcttgaacccgggaggcagaggttgcagtgagccgagatcgcgccattgcactccagcctgggcaacaagagcaagactctgtctcaaaaaaaaaaaaaaaagaaagaaagaaagaaatacccagatttttatatgttggctcatttaaaaaaaaagtactataggcacccaataaarcatgtgtgctagttgatctctggggtcttgtactactgcagaacgtcctgttgtcccaggcccccaggtttcccataatagagtaagtctaccatttcattttgtgttatatatctctattttgagaaagggcctcatgtgccattacacaccaggtcttctggaagggcagcaaggtgggatcctcttccactgggatcaggaaagaaacagtcatggaggtgacctttttgctgggtccaaatagatgggtggcaggagcagcctgacaagtatgtgggaggagttagaacaagctgcctttggaaatgaaagtttactagagatttcttggaatatagtgtgtgtgaggaaacagtagaagatgaggtctgagaggtgaggtggagctaaattgtactgtagatgcaaggtgttttatggaagatagggaattgttgaagattttcaagtagggggtgacatattaatcatgggtttttaagaaaattgaattgtgggctgggctcagtggctcatgcctgtaatcctagcattttggtaggccgaggagggtggatcacccgaggtcaggagttcgagaccagcttggccaacatggtgaaaccccatttctactaaagatgcaaaaattagccgggcatgatggtgggcacctgtaaccccagctacctgggaagctgaggcaggagaatcgcttgaacctgggaggcggaggttgcagtgaacccagattgtgccactgtactccagcctaggtgacagagcaagaccttgtctcaaaaaaataaaagagaaagaaaagaaaattgaacggtggtgataggcaaggaagattggaggcagggaggccaattaggaaactgtagccatccaggtgtgaggtgatgaagggtgacaaatttggatgggaagtggccctcattcaaatacctttccatggcactgacttgggcctctgcttgcttctccctgcagaaayccagtttgacagagtaccctgcagtacctggcactgactaggtgttctgtaaaggtgtgtctgatgaggaaaggaaagcacctcaagttcagtctgagtgttcacaccattgggaaggttggagtggccaactgggtgagcaaggagtgagtgttggggatgtgacaggacatgtcctcactgaaggcttgtccctgaaggcagagcagagggagaattctaagatcccattaagactttgagcctggagcactgggggagttaggagtcagcagaaagagstggttaggggaaatgatgaaaatttatcttaattgtgctgaaattggggtgcctgggggtcatccattaggaaatgagatgtagatacttaggagaaggtaaaactgggatggagattgaagagagtcactgytgagtcaagaggagagaactgggagattagaggttaggaaagtgttagcttttcaaggagtagtctgtagatggtggagacaatgccacagagaacaacaaggatgacaaggccatgcaaggagtcgtgggacttggtattaggaggccaaaccttgccagaacagtcagatgagggaatccaaggcagaaaggaagcaggggtgagtgggagatgggcaggtggaagcaagtagttctctttggagaaagtagaataattttttcaatgagctgatctactttctgtcttgatgagtttgcctgttctggacaactcataaatggaatcagacaggtagcataatattgcttaggttcatcatgttgcagtgtagtgttccattgcatggacacaccgcattctgttttatctactcttcagttggtggacatttgggccgtttccactctggctacattaygaatgaagctgctacaaacttgtgtacaagttgctgtgtggacatatatgttcatttctcttgggtagatcttctacattttttgttgtttatgttttccaagagcttataataaatagtcccatttattcacatgcttagtttctttttttttttttttttttttgagacggagtctcactctgtcgcccaggctgaagtgcagtggcgcggtctcagctcactgcagcctctgcctcctgggttcaggcagttctctgcctcagcctcccaagtagctgggattataggcacccacctccacacccagctaattttttgtatttttagtagagacggggtttcaccatcttggccaggctggtcttgaactcctgwccttgtgatccacccgactcggtctcccaaagtgctgggattacagacgtgagccacygcgcccggcccacatgcttagtttctatgttcctgtaactaatttgccctaaatcttgtgacagaaacttgcaatgtggtggtcarttcctttctttcctgtcccatctgatggctatggtttaggtctgctctcccttcacttatcttgggacaacccctaaccatcacccttgggggcaatgttgaarctcttctttcccagttcttgatttttactcacttattttagtggagcacatcctccagtggcttcctgagaaagagtacatttaggtaactcttcgaggccttgcctgtctaaaaacatctttctaccaacctcattccactttggtagtttggctgagtttagaattttaggttggacagagttttatgtcagaattttgaaggcattgtctgattatcttcttgcttctagtagagaaatctgatgccatttccattcttgatcctttgtgtgacctgttttcttctctggaagcttttgggatcctgtctttatgttctgaattccatgacaacgtgccttgatgtgactgggccgacagtcactgtcccaacttgttggggctctggagagctgtgtctgatacctgaattcatgcagtccccctgccatcagcctccttgtcacctgagcctgcagaggaacttccagtacctgagcctttccatggcactgatttgggcctctgcttgcttctctctgcagacacccagtttcatctttggcagagtatcctgcatgcagtacctggcactgaataggcactctgtaaaggtgtgtctaatgagggaaggaaagcacctcaagttcagtctgggtgttcacaccattgggaaagttggagtggccaactggctgagctaggagtgagtgttggggatggttgtggtcagcacacccctaggaggtggaggtgggagaagagtggaaactgacttcacatttctccagggagggatgctttggaaaaactgctcagtgagatgaagcacagatctgcttttcatcccttttgtacctttttaaagacataaggtatgttttgacactggagtatatatgagggttgctaacgtttgggttgaaagagctgctgttgtccacagcttatttattttccacccatttttgtctcctggtctcatccagttacatttcctgggatatgtttttggaggttgctcagatcacggcactagagtccctttgggtttctcctccctcctctgtctatttggcctcgcccttgacaaacattccccacattcacacccaggcctttggcctaatgttcttgaatgytgcttgcctctcattgaataggcttttatgtagctctcatattcagttcatattttggcattttaaaaaatatatatttttgcttctttctcaactagatcatttcactcctcaaatttgtaattaaaaaaaggaaattctcaagcagttttattcaattagaactttgcaaatatcaaattgtccgtatccttctggattctygtctgaacattgcttatctgcgtacatatcacagtgttttcacatagggattgctgtatgttgaagtagttgaggtgtaatagccatataatctaatgtgatccatctgaataggcaaacccttgcacacctgtgtacctgttgaacattttcatcatttgcagttttttcttaacataagcactgttctgaatacttgtgaacaagtcacttgggagtttgttcatgggcgtgtatcttccaaagaggagtcttcamgttcagctgggtaacacactatcagctgtagccctttcattttaaaaacatttccagtgctgcaaattactatggtgattgggaattacaacttggaaatatttttatttttttaaaagatagtacattcatatgaatcaaaataaaatacataaaaaggtactatgaaaagtcttgctcccggccctacccactatctgcgtagtcccaccgctccctcacaagtaattaaatttttagtttcttttacctgcttcaaaatgtatttgttattacaaaagaagctaataacaaatattgattttagtttttgctttgctttcctttttgactgaaaaagttagcatgctataagccctgttcttctgtgccttgccttttcctttctgcttaccaatgtatcttatagatcatcccagactttttcactgctgcatggttttccatttgatgatgccctgtaatttattcatccagtccttttttgatggacatctgaaggtattttcagtcttctgctattaaaaacaatgctgcgaatagctttgtaaattcttcctttcacacatgtgcaagtctagaggcaggagcggttaccagaagtgggattgttggatcaaagccagggtggtgctgtctccgacatagttgtcgcaagaatccagttaggtaaaacataagaggggctggtcacagtggctcatgcctataatcccagcacttggggaggccgagccgggtgaatcatggggtcaggagatcaagaccatcctggctaacatggtgaaaccctgtctcgactaaaaaatacaaaaaattagccgggcgtggtggcatgagcctgtaatcccagctacgtgggaggctgaggcaggagaatcgcttgaatccaggaggtggaggttgcagtgagctgaaatcgcaccactgtattctagctgggacaccagagcgagacgtccgtytcaaaaaaaaaaaaaagattataatggagctattgccataccatctaggtgtgtgtaagtatactctgtgatgtttgcacaatgaagcagttgcctaatgacacatttctcagaatgaatcctgttgtcaagtgacacatgactttatttgataatgaatacaagaccatttcatcttgatcccagatagatacattgagatgcattgatgttctctaagtgaacgtgactcatcctgttctttattagttattgactgtttccgtagtcacctctactttttgatcgttcaccaggttttgaaatcactgtgtaggcagcacccactatgcagttcaaaactttatgtaggcctsttttgtactgggctccaggttcagtgctggcaaataaacaagttccttgttctcacagaatgtgtatggccttgggtgccaggcaccgttccatgccttaacctacattcgtctcataatacgtttttgcatgcaatcttttcttcaattctgtggtatgctgcaggtgaagaaactgaggcatagatcacgtagcttgtaagtgatggaacagtggcctaaatccaacatgtgcaactttagaacccatgtatttttcctctgtcccatgccctgtctgatgtaagcaggcttytaagttgcaaataccaggtggtgtggtgtgctttgaagctatttattcaacatgtgtttatcaagaagtgtctgtccaggcgcagtrgctcatacctgtrrtcctagcactttgggaggccaagatgagaggatcccttgagcccaggagtttgagactagcctgggcaacatacctggacaayatagtgagaccccatttctgtaaaaaaaaaaaaaatacaaaaattagccaggcttggtggcaccagcctgtagtcccaactacttgggaggctgaggtgggaggatcactygagcctaagaggctgaagatacagtgagtcaagatcacaccactgcacttcagcctcgtcaacagagcgagaccctgtctcaaaaaaaaaaaaatacayacacacacacacacacacacacacacacacaygtatatgtatatatattttttaaattaagaaaaaatgtctgctctatgctggacacttaaagtgacttcccctgggtcctagggtactttctgagccttaatttcctctgtaaggtgggggttgggtaccttagctcacttagttcttgcagcacctatgatgtagctaaggtacaaaaaaggaagaggacaggacctaacctcttttggctctatttaaaaatgaatgaggaactgaatgaacttcagtttgcacattgatgtaggactaggggacctgtttttagaatatgtttggaaatgtttattttttccttttgaaatggcttttgtaggtgtggtagtgggacacagaggagcagtcacagagtgtggtgcaagtgaccacaaaattaagggttaaactttgttgacatgatggaattttttagagtagcagaatcccagagcctgtgccttaaggtaaggctccctggggaactttgtttagaaatgaatcctaaactatcgaagggcttgcaaactagaaaatttctgcatatctcaggccttgagaattgctaatggatatgtatctaaatgtcccttacaagcttgctcctccacgtggccctgtggaacaggtctgttgggttcaggatctagtttggaacagtgatgaaatttcgagctgctgaaccagatatggaactgctttgctaacctggtgtctgcccagcttaagcccyctccatcccacagctgtgaaaggaaatcatgcttcttcccaagtgctaacattcctgtgaggccttacactttacccaagtcctcctgatacatttgtcttcctaataagtgctataaaattgaggcttgatttccacccccaccccccacccccacaagagtcctgctctgtcgcccaggctagggtgcagtggcacgatctctgctcactgcgacctctgcctcctgggttcaagcaattctcctgtctcctgtaatcccgagtagctgggattacaggtgtgtgccactatgccaggctaatttttgtatttttagtaaagatgaggtttcaacatgttggccatgctggtcttgaactccttacctcgtgatccacctgccttggcctcccaaagtgctgcgattacaggtgtgagccactgcgcctgcccatggcttgatttttatgcccattttccatggacatagatgaaggcactgagacagagaaattagatgatttgccaatgcttcctatgctgatgacggggaatgaacttggattttctgatgtgggattccatattcttcrctgtcctatgaaaatgaggtgggagatgccttgattcaggaagcctgtctgtctaggagccccttctctggtcaaaagttgtttttaaaaaatccttgctgcatttcaacgtgaatgagtatccactgtattcatagcacagtgctagaagctgttagagttgaatgaaatggcctctgctttcagggagctaacatgtaaacatccagtcataatacatgggaaaatacaacagaggctataacagaggaacaactctaaatctttggaggactgaggaagggaattagaaaaatcttcacaaggactttggcatttgggctgaattgtgaagggtgagtaaataggattttagaaggtaaaggagcaggcatggtgtttatttagatagatttagacaaagttgggaataatttggcatgctctaggaatatgtgtgtcasagtactgcataggacagaggttctcaaacttgaatgtgtctatgaactcccagggtatacccccaaagatctgaatgtggaaggtctgggatgttgtccaacaggaacacctaactagtggagggggcaggatcagaggagccttctcagggataagctgaggtcttaaagggtggaaggagagagcagctgtgttccaggctgagtgaacagccattttgaagggcttgaccagtgctggtgctcgagtgtctgggttttgtgtagaccacactcttgataactgtgctgttcgttatcttccacaaacagggttttggtcaggtgcctccttgcttcagtgtgttctttatcagtcaggattcttggtgataagcagcagaaaccgcttctatctagcttgaacagaaaaggatttgttagaagggtggttcttggagtgactagaaaagctggagagccaatttggaaaatgggccagaaccaaggaggctcctgcttagtactcctccgccttcatgatctgtatattgtctctgctttcctgggtcattccctcaagggtcgcactcctggtgggaggatgcattaatcagagctgactggcaggaaaccttccctcacatgaggactgcccaatggggattctccaaaggaagatcagggtgctaatgggagggtcgggtctgatgatggacaaatggaacaaaagtggcaaatgcccaccatgtattctgtgcctttccttgcctctgaaataaaagcagtttctgccgccaaatatacatggtagcattaagtcaggcctttcacaggcagctccatctctccattttgcaccgtgctgtctctacttcagcagctggcaggacatttcctgatactgtggttttgctcaaactatttcctttgcctggaatacccttccctctctctaatttataaacccttttcatccgttaagctcggttttcactgcctgccaggatggatcagtcctttctctgctctctgacagccctttctttgtgaggcacttgtctgttcttgcccttgtcgcagtttatggagttggttaggtttctctttcttctctgtgagcatgggagatgggaagaaaacgaatacttttcagtctttgccctgtgcggagttccacacaaggcacataggatcctccagctcccagcccagagtacatagygtatgcaaatttgagtggatgtttgtatttgtagcgtgatttgataacctgctttgcaagtattctttttctctttagttttagggagatttgggggcatggtaatggatggaagggtaagatggtgggatgttggggtctttcatttttgcctgaatggtttaagggctgaaaaaggttgagatctcttgctttgtagactctgcccccaggaggaggacagttcaggtgaagtggcttgtgcctgattttgttggcagtgggtcacctgaaatgtgaaatgtgagggcctccttttgcagaacagggtcatgcaggatcagttccttggagtctcactctgcatctcactcaattttgtagtctcctgctaaaagagagtgaaagagggaacagtatgatgccagggcagcagcaggtgaagagctgggagatacaggaaagacctgggatgacacatccttctctgtctgagcttggggcattcactctactcattcgtgaatgaagcacttactgagcacctgtccagtgtcaggctgtctttggtgatatccgtatgatgatagaaccaaagcatctgcattatgtggtagcyaagagcttgactttaaatcccagctccaccacctgctgactgggtgacattagacaagttacttagcctctgagtgcctcattttccttacctgtaaagtggagatgataatggcatctacctcaaagtgtcattgagattaaacgaaatttgtgtaaagtgtttaattgctgatacatagtaagagctcagcaaatgttaattcctgtactttttaaaaatyattactactaatttgctcagtttttcttcttgattgttgttctcaaagtctgtttcttttatttattttcattattattattwttwtttttttttttgagacggagtctcgctctgtcgcccaggctggagtgcagtggcgcaaactcggctcagtgcaagctccgcctcccgggttcatggcattctcctgcstcagcttcccgagtagctgggactacaggcgcccgccaccacgcccagctaatttttttttgtatttttatttatttattattattatactttgagttttagggtacatgtgcacaatgtgcaggttagttacatatgtatacatgtgcagtgctggtgcgctgtacccactaactcrtcatctagcattaggtatatctcccaatgctatccctccctcctccccctgtatttttttagtagagacggagtttcaccgtgttagccaggatgatctcaatctcctgacctcatgatccgcccaccgtggcctcccaaagtgctgggattacaggcgtgagccaccgcgcctggccttcaaagtctgtttttaatagagcagtcatttaaaaataataagtgggataagagagacagcctttcaaacatgggatgacaagaatctgatgtctgtgttttagcattaggcaaggattggagtccctggctgcagcaagggtggggctcttgcatgggtcgggactctggttgattgcagcatcgtagagcctaactgctgggaggtggggcaaccccagcgagaaactcctaggaggaagcacctccctgtggtggttggggcaacttgtggagcagggtgcttgagaaaagagcacagggcttagaggaaggagtaaggctcctatctctgtctgctactcgctccccacctgcctgagatggtgtgcaggtcaccccctctttggacttggacttttcttcctgtgtaaaaaccaccaccaagaccgcttttcaagcacttactgccaggcactcactatcccaggtgatttacatatattaactcacttaaaacagtgcttgaaatggctacctcacagggtgattttgaagattatataacacagtgtgtgaaagtagaagtgttaaaaggaaaaataagggagccacagtgttaatgaagttattttccagtaaaaaaaatcatgtttaaactttgtatatgaatatatacatacgtatatatacactgaagtaaatagtactgaaaacagcaacaacagctttttaagcaacattccagcaggttcctcttgtaccatgtatccctttttatcctaacactttgcatgcagtcctggcagatttattatttatttatttatttatttattttttggagatggggtctcactgtgttgcccaggctggagtgcaatggcgcgatctcagctactgcaaactctgccttccagattcaagcgattctcctgcctcagcctcccaagtagctgggattacaggtgcttgccgccacgcccggctaacttttgtatttttagagaaatggggtttcaccatgttaccaggccaggctggtcttgaactcctgacttcaggtgatcctcccgccttagcctcccaaagtgctgggattacaggtgtgagccaccgcacccgccccaacagatgtttttacagaggttttctaccataacatgtgcctcttgaaggcatttatttttgtatctggcacatagtaggatctcagttaatgtttcttgaatgcgtgtcttaagggatgtatcttttattaaaatgtatacttaaaaagagagagattgttctagaaaacagcatcttgtcaaggcatatggtctcatttgaagaataatttaataatttggataggaaggtatacttgtaaaatacagccagtcaaaaataycttttccccattccccttgatgcgtccattacatacatgttcaccctgagattgatcttccatcagcattgaaatgaacattgaaagtaataagatgggccgggcttggtgactcacgcctgtaatcccagcactttgggaggcggaggtgggtggatcacgaggtcaggagatcgagaccatcctgactaacatggtgaaaccccrtctctgttaaaaaaatacaaaaaattagccgggcgtagtggcacacacctgtagtcccagctactcgggaggctgaggcragagaatcgctttaacctgggaggcggagtttgcagtgagccgagattaccccactgcactctagcctgggtgacagagtgagactccgtctcaaaagaaaaaaagaaagtaatgagatggggctgggcgccgtggcttacgcctgtaatcccagcactttgggaggccgaggcaggtggatcacaagggcaggagatcaagaccatcctggctaacatggtgaaaccctgtctctactaaaaataccaaaaattagccaggtgtggtggcgggcacctgtagtcccagctactcaggagggtgaggcaggagaatcacttcagaaccagggaggcggaggytgcagtgagccgagatggtgccactgcactccagcctggcaacagagcgagactccatctcaaaaaaaaaaaaaaagtaatgacatgattacctaagtgcccctccacacagccccaaatctcctttgttgtcactcsgagtctgtcttacagcttttccccaagttgtgawgagcataaatgtaaaatccaagaaatgtttattttgtaaggggaaaaaagtgtgggtagaggagagactcagacaaacctaaatatagatataaattcaaatctcagttcagccactttgtagcttatgtagggggctttggcaaattatctaatttctttgaatcttagattcctcacttttttctttcttttttttgagatagcctctgtcccctgggctggagtacagtggagagatcttggctcactgcaacctctgcctccagggttcaagtgattctcctgcctcagcctcccgagtagctcggattacaggtgcccaccaccacgcccagctaatttttgtatttttggtagagatggggtttcaccatgttggccaggctggtcttgaactcctgacctcaagtgatccgcccacctcggcctcccaaagtgctgggattacaggcgtgagccaccaagcccggccagtttcctcacttttaaaacataataatattggtctcagggttgatataacgtactaagtgggtatcagtggtagctacttttatgttgtcctcatggaggacatgaatgaatttaatttcagtaatattaccttctgtactggtaatatttattctgtaaataaaatataaatatgctttctacccagaaaataagtttattagctttgtcacttcattggttttgttcttaaatatcaatagtgcaaccactggcttttattcaaaggtttaattggaatctaacctggggattttcccctttttaaatktatrtttaaaaaaaaaaactatggaaagtcggcatggtctgggctgcttgggagcctgaggcaggaggatcacttgagtccaggaatttgagactctcctgggcaacatagtaaggccctgcttcttttagtctttttgtttgtttgtttgtttttttgagatgaagtcttgctcttgtcccccagtctggagtgcaatggcgcgatctcgcctcactgcaacctccacctcccgggttcaagcgattctcctgcctcagccttccaagtagctgggattacaggtgcgtaccaccacgcccagctgattttttgtattttaagtagagagagggtttyaccctgttggccaggctgatcttgaactcctgactgcaggtgatccacccgcctcggcctcccaaagtgctggtattacaggcatgagccaccgcacccagccaataaggccttgcttctaaagacactttaaaaaaaaaacaaagcggccgggcgcggtggctcacgcctgtaatcccagcactttgtggggccaaggggggtggatcacaaggtcaggagatcaagaccatcctggctaacacggtgaaaccccgtctctactaaaaaatacgaaaaattagccgggcatggtagcggatgcctgtagtctcagctacttgggaggctgaggcaggagaatggtgtgaacccgggaggtggagcttgcagtgagcagagattgtgccactgcactccagcctgggcgatagagagagactccatytcaaacaaacaaacaaacaaaaggcaaacctatggggacctggcctgggagtgaaggagggagggaggcagggagggaggaaggaaaaaaccagaaaaaaaaagtgaaaaaattaaatacattttattatgtgcttgatgtatttttctgtgtattgatatatatccatcagtttggattattcccatatttacaattaagtaactgagtctcaaggaaattaattaatttttcaaagatagcacagtgattacattattggagtcacagccacttctctttgaatttaatcgtgacatctccattcagtttggccttgcaaaacgggccttggtttagctttttgacatcttgcctttctccttaaatctgatcccttgtcactctttttttatttttttgttttttcctctcctgactttcatctgaaaccctgaaccctacaggccatgggagatgacctgtttcccagttttggtcactttttgggccatatttataaccaaaactyttatttaaccagttttcagaaaattctcagcttcttcatcaattgatgaagttatctgactgactttttattccagccattctcatactctcagaatgattttttttttttttttttttttttttttggggtagatggagttttgctctttttgctctttttgcctaggctggagtgcagtggcacagtctcagctcactgcaccctccacctcctgggttcargkgattcttctgcctcagcctcccaagtagctgcaggcatgtgccaccatgcccagctaatttttwtatttttagtagagacggggtttcaccatgttggccaggcttgtctcgaactcctgacctcaagtgatccacccgccttggcgtcccaaagtgctgggattacaggcatgagccactgkgcccggccagtgattcttaattagttcatgatattttggagttctaggcaggacagcagcctctgcctcctcaaccccatgtaaaccagaatgagcaactgctgrgctggaggagctctccttcttagagcattgtgggacaacttgctatgagttctccttcmttttttcatttcaccaccatgagttgtagggccctttgtgctttggcccctaacaacttgcccagtatggtgccctgcccatcacccattgtcttcaacaacctatcatgcagctccatgtctccctgccttggctcttgaggttccctggcctagactgtactttgcatcctgatcagccttcaatccaactccttcagggaactattgacttgctggattctgtgattttgtcatgttccctgtgtctctttggtgtcttgcagatgcacatctctgctgtgacaatcttcacaaaccatattgtgatcctttcactaactctttgaggtcaaggactaatttattatctctgtgcctggtacacagtggatgcttaacccgttgaaatccttctgtatttacatacttacctccctaaaagtgaaagctttgcagaaattacatagatctgtccagattttccaggctagtctaacttttaaaaatatcttattccattatgaggtgaaacatcccttctagtttctggttcagaaagcatgatcggtcaggtgcagtggctcacgcctgtaatcccagcactttgggaggccgcggcaggtggatcacaaggtcaggagatcaagaccatcctggctaacacggtgaaaccccgtctctactaaaaatacaaaaaattagctgggcgtggtggcgggcgcctgtagtcccagctactygggaggctgaggcaggagaatggcgtgaacccgggaggcggagcttgcagtgagctgagatcaygccactgcactccatcctgggcgacagagcgagactccatctcaaaaaaaaaaaaaaaagaagaaagcatgatcaccatttttataagttgcatgaaagttgctattgagagcatttcagtgagtcagtgccagtttttttgttgttgttgttttgtgttttgtgtttttttgtttttgtttttgttttgagatggcgtttcactcttgccacccaggctggagtgcagtggcgcgatctcgactcactgcaacccctgcctcccaggttcaagtgataactgcctcagccttccgagtagctgggattacaggcacccacccccacactcagataatttttatatttttagtagagatggggtttcaccatgttggccaggctagtctcgaactcctgacctcaggtgatccacccgcctcggcctcccaaagtgctgagattgcaggggtgaaccaccatgcccggcctggcttttgttttttaataccagtatgcttggtgcttgaagcggtacagggaaaggaacattttctccatgcactcatagaacacaagacataagaaaaacatctttaagatttatttatttagaatccgggggtggtggctcattcctataatcccagcactttgggaggctgaggcgggcagatcacttgaggccaggagttcaagaccagcctggccaacatggtgaaacccggtctcaactgaaaatacaaaaattagccgggtttggtggtacgtgcctgtaatgccagctactcaggagcctgaggcttgagaattgcttgaacgtgggaggcggaggtggagccagaggctgcagtgagctgagatcacaccactgcactccagcctgggcgacagagtgagactctgtctcaaaaaataataaaataaaatttatttatttagtgaccttgtctcactttgttgcctaggccgaccttgaattcctaggttcaagcgatcctcccatcttagcctcccrtgtagctggaccaacaggcatgtgcagcattaaaaaaaaaaaaaaaacttactatgtgtaatatagcaaagttttttaaaagttaaaaacatagccttgaactaaaacatcatgagcacatgtcagaaatttattaacattgttaatgaagataacaggatgacaaatggatcaaaggagactgcaagaaactgatatttacatagaaaaaagaatgcaggaataagattgcaaatttaaatacaaaactagggccagattccgtggttcatgcctgtaatctcaggactttgggagactgargcgagtggatcacttgaggtcaggagctgaagaccagcctagccaacatggttaaattaaacttcgtctactaaaaatacaaaaattagctgggtgtggtggcgggcacctgtagtcccagctacttgggagactgaggcgggagaattgaaactgggaagtggaggttgcagtgagccaagattgtgccactgcactccagcctgggtgacagagcgagactctggctcaaaaaaaacgcaaaactagttaatgtcctacagtgcaatgaaaacaaaagcttaaaggttttcttttctaccagacagaaatgattttaacttaacaattttctgcaggctaacatctaactttacagaatgggagccttaatcggtagtaaatagaaagtcaaacaaggtgatggttccatagagcatcagataacttttaggcaggcagcttagacagtgctgtagtatamctttttttttttttttttgagtcaggggtcttgctctgttgttccaggcttkagtacagtggtacagtcgtggctcactgcagccttgaactctggcctcaagtgatcctcccacctcagcctcccaagtagctgggactacaggcatgtgccacgaggcctgaccaagtttttttattttttagagagatggggtctcactattttgtccaggctggaatgcagtagcatgatcatgcctcactgcagcctcaaactcctggccttaagtgatcctcctgccttagcctcctgagtaactggaattttagtataactttaaagaggcatataacgtttttttttggtcttatttccaagttttagttaatttttctttcctgttttcttgagacatggtcttggtctgtcacccaggttggagtacagtggcacaaactctgctcactgcaaccttcacctcccaggcttaagcaatcctcccacctcagcctgccgagtagctgggcctacaggtgcgtgccaccatgccccctgctaaagtttgtattttttgtagagatggagtctcgctatgttgcccaagctggtctcaaactcctgaacttgagcgatctggccacctcagcctctcaaagtgctgggattacaggcatgtgccaccacacctggccaataattttctttaacaaaataaatcacaattgagttcaagaactaaaagatgactagatcatctgaggtggaaaagagtccctggtaaaagtaattttaaatagttttgaagtagaattgtgaaattcagagtttggagaaaggaagagggtggtsacaagtagaaaagagaagacatggcacttacattcaaagaaagattgccctaccccacccctcaaaggcatgtgcagaagagggagtgagtacttttccagggtggatgatgaactaaagtgggtgggaagtgaaaacctttggaacagaagggagcagttcataggaagcttggaagcttgtgttaaagaatttgatttgattaagggccgggcacggannnnnnnnnnnnnnnnnnnnatttgattaagggccgggcacggtggcttatgcctataatcccagcactttgggaggctgaggcaggtggatcacctaaggtcaggagttcaagaccagcctggccaacacgaagtctctactaaaaatacaaaaattagctgggcgtggtggcaggcggctgtaatcccggctacatgggaggctgagacaggagagttgcttgaacctgggagacagaagttgcagtgagctgagatcatgccactgcactccagcctgggcaacagagcaagactctgtctcaaaaaaaaaaaaaaaagaatttgatttgatttaaaaggctgttggatgaacaagatactcaaagaagatgttcgtcactgggtaggaggctatggttgaaattaaggcagagtgtggacgggagtgaagaggtaaatccatgatgctaaggaaggagacttgagtgaacttaaggcaggaggaaaaagaaagagcaatggaaagtggagctgcagatccctctcctgttcaaactatgagagctggctcaggtcccctgctatagtgggccagaaaagcctggacttccactgctttttcctgcagagctgagtccctccagggctgccatgagaggcggggagagagagcactagacagagaagaccagaagaccatttgagaattcctttgggtttccttcatgattcctttttcttctcattctgaattgttttattttattatgtaatattcggtatatgcaaaggaatatatgacacctttgtgtgtattacaaaacaagcatttgagaatccgcacctctccacccaatttttctttgtggtttctttgccagtaaaagagttcactcatctgttgcttaaaatataggatgcttgagtcaccagcttgccatcctgtgtcattcaacacctcctccagactcttcgcagraaggtgacccagaaaccccttgaaggacatgatacygtccctgtgctctgatgtgccccctggtgtttgagtggagtgatttttagatagcggtttgcctgttaaaaccttccctttgttccctatattattgcttgcattttagggcttctcagttgaaggatgtggttgaaagagcccagttcctcagctgctcctctgggtgactagagtgtgggtaactgatgttttaggtcctggagaaagcagtgatgatcacaaatagtagaatggagaaatggttatctcatattgatcttcaggtttgttactagtctacatttggttttttaaataattattagaaaaaaacattgtgggtggggagataggatcattatgatgaaacagttctgtacattcaatcaggatacttgttgggaattagattttgcatttacctccctcactggtgtggtccatctcattttcagtggcctacacacatcacacaccattattatttccatgttcttgtacttgttgggcagctctaatatgaaagataaaatgaacgaaaagtacaaatgaagaaagtttaggtgactattcctctgatcttgaggatgarggtttttcttaagcgttacacagaagccatgtaatttcactatacaatgtaaaaatggtgtatagtcagttctgctatagttcatcatgtgcatttctaaaaatcatgccatgcgaaatcatgcagtaaaaaacacggagtgggcatgttggctcatgcttgtaatcaggaggctaaggtgggaggatcgcatgaggcagggagttcaagaccagcctgggcaacaaagcaagacccagtctctcttacaaataaaaaataaaaattatctggacatggtggtgtgtgcctgtactcccagctacccaagaggctgcagtggaggatcccttaagcccaggaggtagaggccacagtgagctatgatcacatcactgcactccagcctgggtgacagagtaagaccctgtctctaaaacagaaacccagaacttactgtgaaatggagggttaaggatcacaacaataaaaaatctcataggtgacsaaaaaaaggaaaagatttattttttaaaaaagatagggacctgccgggcacagtggctcacacctgtaatcccagcactttggaaggctgaggcgggtggatcacgaggtcaggggttcgagaccagcctgaccaacatggtgaaaccccgtctctactgggcktggtggcgggcgcctgtaatcccagctactcaggaggctgaggcaggagaagtgcttgaacccaggaggtggaggttgcagtgagccgagatcccgccactgcactccagcctgggcgacagagcaagactccgtctcaaaaaaaaaaaaaaaagtggggggacctaataaaacagtcacacagttttatagaccagaaaaactaagaaatatataaataccacaatgaaaaggcactttggcttgaaaaacacctgaggtttgcttgtgggaagtaagtgtcattaggttacagcttgggagttatcaggaagtggtggaaggagggctgtctgaagtccaatggaaagttctgacatcaatgtgatgaatgtgattcataacacatgcagtgacctgatgaagctggtagatgtttaaggtgcctgtgtatgtgtgtgcacattttgtgcattcctgcatggctcatttcagccgaatatggttttctgcacttcctagtgtttttctcatgcataagcaaatgcaaaatttatrttatgctcagattgtttctggatgtatctgatgcatttgaacaaattcacattttcaaagtaagagttaaagcaaaagtgtcaaaaaaaaaaaacccactatgaataatgtgtactarctaatactaagtgccaggcatggtgccatagattccacatgagttatctcatcaatccgtgagttagctgtaattgttagccacaatgtacagttgagaaaaactgcagctgaaagaggtaaaacttgccccaggttccaaggctaggatatggtgatyctttttttttttttttttttttttttttttgagacggagtctcgctctgtcacccaggctggagtgcagtggcgcaatctcggtgcaagctccgcctcccaggttctcgccattctcctgcctcaaccgcccaagtagctgggactacaggcgcccgccaccacgcccagctaattttttatatttttagtagagacggggtttcaccgtgttarccaggatggtctcgatctcctgacctcatgatccgcccrcctcggcctcccaaagtgctgggattacaggygtgagccaccgcgccaggccgacatggtgattcttaattgctatgtcattctttttttctgaacatattaaaagagaaataacaaagtgggggaagtacttgcagacatttaagaagaataagtatctataatatctggaagttttttaaatcagtgaaaaaaaaaaaaagacaaaatagcctgatagcaaaaatggacgaaggtcaagagcaggcggtttacaaaggaagaaatgcaaatgctcaataaaattgggactttagaaaaaaaaaagactttcagcctcagttagtactcagtcatgcaagacaaaacaattccatgttggttttttccactatcagattgacagaaatggctgtgaggaaacactagcaggagcatagatttttgaaacctttccaaagcatgtatagtggtcctttgacccagccatctaacttctaggaatttatcctaagaaaatagagaagtgggggaacaaaagagttgttaataatgccgaataacttgctgggtgtggtggcacacgcctgtaatcccagcactttgggaggccaagtcaagaggatcgcttgagcccaggagtttgagaccagcttagacaacatagggagactctgtctccacaaaaaaaagatttctttaaagttagccaggtttggtgatgcatgcttgtagtcccagctactcaggagtctgaggtgggaggattgcttaagcacaggaggtagaggctgcattgagccccaccactgccttccagcctgggcaagagagcaagaccctgtctcaaaaaaataaaaaaaaaagataaggctgaaaaatttaaagcaatttttcatcattaagttaaacaaattttaatacactggtacagtacaatggcacacagaatgataccgtgggactctgaaaaggatgatgttacgtctgtaatggttgacactgaatgttcttcatatttattaaccaaagggaacagggtgcaaagtagcatgttcagtgtgatctcatttttgtaaaacaatttgcatgcatgtgcatgcttaagtgtgcaagcaagccttgtagaggaagaaatctggaagggcacacattaaaacattgacaatgggccgggcgctgtggctcacgcctgtaatcccagcactttgggaggccgaggcaggtggatcacaaggtcagcagttcgagacgagcctgtccattgtggtgaaaccccctctctactaaaaatamaaaaattagctgggcatggtggcacgcacctgtaatcccacctactcagtgggattacaccgggaggctgaggcaggagaattgcttgaacctgggatgtggaggttgtggtgagccaagatcatgccactgcactctagcctgggcaactgagtaagactccatttaaaaaaaaaaaaattgacaatggatgactcaagaatagtggaactgctggatgatttttatttttgttcttttcatttatatgctttctaaatttttctttagtgaatatattacttttatgattttaacarattattaaaaacagggccaggcgcagtggctcacacctgtaatcctagcactttgagaggccraggtaggcggatcatctgaggtcaggagttcgagaccagcctggccaacatggtgaaaccctgtctctactaaaaatacaaaaattagcagggcgtggtggtgtgtgcctgtagccccagctacttgggaggctgaggcagaagaatcacttgaacccaggaggtggaggttgcagtgagccgagattgcaccactgcacgcctgggcaacagagcgagactttgtctcaaaaaaaaaaaaaattattaaaaacattgtctaacacaaggtgcataataaatacaaaatataagaataaatgacctttgtaaactaggtttcccagcccctaatagggctgggtaacaaatacctrttaaaggattattgactgaatctgtaatttggagaaactgtaaccctatttggaggcttcacattctttattcttgaccagaattaatttaaccagatttcaggttacctcattctcaggtagatgctgaaggctgagctgagcaaagtgatatttatgttacctccaagccacaagctccataaagttcatgtgaactcagggtctctttgtgagtcatggrgctgcttgcaatgcacggatgataacaggaacctctaattttggttatttgcttttagagaccasaacccagatacagtttcctggggcctcacctactttgttaagcaacttagctataagtttacaaagcagctaaaaacaggagcaggggagtgagatgagcttgagcgtgccagcctagctcgtgggaggcctgtctctggccctgagctttgtggcctgccgtaggaactggagcttcattttcaaagctccataaaactcgccttctcccgggcctcccttttctgagtttcatggctctctgtggaaatgacagcctgtgtaatcacagaatgtgaatgatcagagcagggaacagtgaggagccattaggacattcccatgggtgtagctcacagttacaaagcacaactacaccctggttctccaggcctcctctttcctggcaccgcagaccagatggggtcctggagaggctctgcgtgcccttctggagcttcccatcactcctttctgcagatgttcatcttaacagcccctctgtgccactcagcccagtacccggctgcccggctgactggagatggctccactggagctttttgtgtgtgggttgaaagggacttttttattttaatttaagtagtctcattccatctgcctacacactcttacgcttcgtgaactaagctttctgacctgtgtaggttacttcaccacaccagcccatatctttcccacaaaagggtttcaagagtacttgacaaaatgagatcagtgcacccacatgcctgtgtagtgggtgctctggaagtaccgcyaacattgacctgcataagggtctacccttcaccaagcacttcggataaattatcttattaatcctcagggcaaagaggccaagtgtgtattttcaaagcagccttttgtagtgaggaaaccaaggcttaaagagaagtatcttgcccacgctcacaccactgattaggtgggcctccagagactcacacctaggcctgactaccaccaaagcctgtgcgcatctatgaggccaccctggccttctgccctccttagctttccatggatggaaactgtcggccagtgtgtgatattcttctggctctgtgttacagccctctgtattgatttcttacagagttgggattttgggggaattctaaaaggttcaacaaattcttagatttctcttagtcattttcttaaagcattttataatcttgtacttggagtgtgtcagcactaaattatgttttgtttaaatgtactgaatttgaggacatttctcagtttaatcatgtcacggaattggaattggttagtacaagctgcaatatctgtagcaatctgcccatttctccctcgcacaaggctgagtgaggacagagcttagtgtcaagatgttggtaaataataccactatgtaggaatgtagtctggtgagatgctgtttttcccagcaggtttaactgactgaatacttaaggtgcccagattgaaatgcaaagctccagttatcccatatggagactacactagaaagccccagcagctttatttatttacatttatttatttatctatctatttatttatttattttttgggacrgagtcttgctctgttccctaggctggagtacagtgacgcagtcatctcggcttactgcaacctctgcctcctgggttcaagcgattctcctgcctcagcctcccgagtagctgggattacaggcacccaccaccatgcctggctaatttttgtagtagacaggggttttcaccatgtttgtcaggctggtctcgaactcctgacttcaggtgatccacctgccttggcctcccaaagtgctgggattacaagcataagcyaccacccctggcctatttacatttaattatgatttatttttcctatccttctgcaagcatatatatatatatatatatatatatatatatatatayacacacacacacacacacacaaaatatcaaaatatatrtatatatrtatatrtrtatatatttttttttttttttgagactgagtctcgctctgttgcccaggctggagtgcagtggcacgatctctgctcactgcaagctctgcctcccgggttcactccattctcctgactcagcctcccgagtagcttggactacaggcgcccaccaccacgcccagctaattttttgtatttttagtagagacggggtttcaccgtgttagccaggatggtctcgatctcctgaccttgtgatccgcacgccttggcctcccaaagtgctgggattataggcgtgagtcaccgcgcccggcccaaaaaatctttgtgtttttttgtttgtttgttttgtgttcagagaagggatctggctaggtgccctggctcatgcctgtaktcccagcactttgggaggccaaaccgagaggttgcttttcaggagtttgagaccagcctgggcaacatggtgaaatctcgtctctacagaaaatacaaaaattagccgggcatggttggcgcacacctgtggtcccagctactcaggaggctgatgtggaaggatcgcttgagcctgggaggtggaggctgcagtgagctgaaattgcaacactgcactccaacctgggtgacagagcaataccctatctcaaaaaaaagagagasagagtctcgctgtgttgcccaggctgttctcaaactcctgacctcaagtgaccctcccaccttggcctcacaatgcactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtggtgtggtggtttttgttgttttggtgtctaaatcagagcatcacatggccttgaaggtttggaaaggaggggccatagttcaagaacaagcagtagcttcttgggaacgtattggagagagaaaagagaaaagaatatggacaatgtagagaattgtaggtctgaaactatctgggacaaagctgaggctcctgacttctatagggaccagtcatatgaaaaagaagggagtcgtgagagatgatggggtagttgtgggttaagttgggttttggaaagcctttgggaagattgaccagggaagaggccctggaagtaggcttgagaccctttgggctgggaatttaagggtcccagctacttggaacatgatctagaaagggaagcgaggtctccaggtggacaaatccctttggacccaagactccttgcccagagaaaaggggcacaaccagacaagggctagcatgggccctgggaagcacggagttcagggtggggcaggcttgctgtgtcctggcctggcaacatacctgcactgtgttgtggtagaagaacacaaagctgggaggcagagaactggttctaatcctagctgtaccctgacaagctgtgtgaccttggccaagttactttcctctcctggacttcatatatggtttttccattctttgcatccctgaagctccatgacttaggggccatcaacttggttgtccctgagtgtttccaagaataccaacagtgcccagggttttactcagcttggagaggaggcctagagcctccctgtggtgaggaggaaagaggttagagcaagtttgggtctgcagtgctaggattagaggtggcctcacaagccaaaaccgctatactcacagccttaggacagtgactccctrctcgctgcctcagtgtttccagctgtaaaaaaggacccttggtaccttcgacagaacagcacccatctagtacaaaggtagttccttttatgatcaaaacaatcaggaaaaagagagaggctgggtgcggtggmtcacacctgtaatcccagcactttgggaggctgaggtgggtggatcacctaaggtcaggagttcgagacccacctatcaatatggtgaaaccctgtctctactaaaattacaaaaattagccgggcatggtgccgtgcacctrtagtcccagctactcrggaggctgaggcgggagaatcgcttgaacccaggaggcagaggttgaagtaagacaagttcgcgccactgcactccatccagcgtgggcgatagaggaagactccgtctcaaaaagaaaaaagaaagaaaatgagagaaagggcctggaggtgagtgtgaggagggaaaagaacatcaaacagataaagtcctgtcctgttgtcctgggaccttgggcagccatcttggcccagatgatccccacaagaaagaggtaagggtttcctgacccatttctgccatggtcttaggaaagtcattgagttttcatgccttagtttcttaagcaagtttgaaagttcactttttggatagcaataaaattactccttttcttttgttcacagagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaaggtgattcagaagttagaatggtagtggttggttggttccaatgtttatgtgccagtttgcagacactgtaaatatttctgtcgtcttcaggaatggcaggtatatcaatatggtcctgtctgaatgaggttctggtaactggcaataagaactggtacaggagcatgtcacattctgcagcttcaaataccttaatatctattgcgcctaattcaaaaatacttggttaaaaaatccagcaagcggccgggcgcggtggctcacgcctgtaatcccagcactttgggaggccaaggcgggcggatcacgaggtcaggagattgagaccatcctggctaactcagtgaaaccccatctctactaaaaaatagaaaaaattagccgggcatggtggcgggcgcctgtagtcccagctactcgggaggctgaggcaggagaatggcgtgaacccgggaggcagagcttgcagtgagcagagatcgtgccactgcactccagcctaggcaacagagcgagactcccatcttaaaaagaaaaaaaaaaatccagcaagcatagtagacacagggccattctgataactagtggtggagacttgaataaggcttgaaattggctaggcggcagccagatctcagctgccacagttgagaactattcattcagcaaacatctgagcatccactatggtgatgaatatgacttttaatataggtgcagcagcttcaagtagcaagcctcatgctgggcccttagtatgtgttgagggaatggatgactgaaaggggcctgttctttctgtgatgtgctgcatcccagtgccttttcatcatatttccctctgactctgtggggagcccagggtaagattagtattgctttgaatttcaaagaatcttatagttcttcaatggagttcaagaattgggacaggtgggggaatgtaaaggcaaaaagctgagacagtcctcccaaagtgcacttkccgtccagaaaggatggaagaaaatgaagccccagggagttgttgattctcaacatctgttaactcccttgctgggtgcagtcatttgctgattagcttccctttcccccaccctggcacccagagtaataaaacaatttgtactcgttccctcagaaattgatgcagcccttatgggatgttcttgttgtctaagccaccttgtaaatggctgtgcacatcatcttcagcagtaggtggggagttggaatcattatgagatactccatcctcaggtttctgctgcagctgcagtgacagaatgcattcctcatctctgtgccttctttctcctcttctcccaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcrccacaggtgcagcaggtcccggtaagtggctggaaaggattcagggaggcactggttggggctgttaactggtccttggttgaagatgtggtctacatactaagaaggaccaaccagagtgtacacaaagcarcttgtagggcgccaggatgcacctgtgagcagcgtatagtgacctggctgagtccatatctgtagatagacactggcactcaggaaaggctggtgcagtcacttacgtacacatgtaatgggcataaaactggaaagaaatgtgctaaattggtatttcccagataattttctttttcatagttttgtgttgtgtttttttgttgttgttgttgttttgagacggagtctcattctgttgcccaagctggagtggagtggtgtggtctcagctcactataacctccgcctcccgggttcaagcagttctgctgcttcagcctcccgagtagctgggactacaggcatgtgccaccacacccggctaatttttatatttttagtagagacgggatgttggccaggctggcttgaacttctgaccttgtgatccacccgcctcggcctcccaaagtgctgggattacagacgtgagccactgcccttggctttcatagttttctgttctccatattttctgctrtggatcctgaacatatattgggttggggggagggggggcatgtattattaatcttttttttaattttttttttttkgagacagttttgctcttgttgcccaggttggagtgcagtggcgtgatcttggctccctgcaacccccgcctaccaggttcaagcgattctcctgcctcagcctcccaagtagctgggattacaagcacctgcyactgcacctggctagttttttgtatttttagtagagatggggtttctccaggttggccaggctggttttgaactcctggcctcaaacagtgcatcgatctcggcctcccaaagtgctgagactacaggtgggagccactgtgcccagctgggggacgtgtattatttttataatcacaaaaaacgtctttatgttatatatcatcgtggactatatcctcttttttctttttttttttttgagagtcttgctctgtcgcccaggctggagtgcagtggcacgatctcggctcactgtgcaacctcagcctcctgggttcaagcaattctcctgcctcggcctcccgagtagctgggattccaggcacgcgccatcacgcccagctaatttttgtatttttagtagagacagggtttcaccatgttggttaggctggtctcaaactcctgacctcatgatccacctgccttggtctcccaaagtgctgggattacaagcatgagccaccacatctggcctatattttcttactaacaatttatcttaaaaaaatcaggtttattatttttgcttctcagccatgtgtctggctttcctgagtcttttctctcctctctgccatccaccctacccatctctgctctgctcctgctgggccactggcaccaccctcttgaaagtctttcaacctaaaaacccatgacctggctgagcaccatggctcacgcctgtaatctcagcactttgggaggctgaggcaggtggatttcttgaacccaraagttcaggaccagcctgggcaacatggtgaaaccctgtctctacaaaaaaatacaaacaattagccaggcatggtggcacacacctgtagtcccagctactcaggaggctgaggcagcaggatcacttgagcccgggaggtcaaggctgcagtgagctgagattgcaccactgcactccagcctgggcaacagagagcaaccctgtctcagcaaaaaaaaaaaaaaaaaaaaaaagccaggaccctcattagctagcccctctttctccacctgaacccggtattcaggctgtacaaaatagccggcttttgaaatggcctctatgaaatttcctgttcatttttttattctcaatttcataaaaattatatcatttctcattctttcttggaaggtctatgcagtaagaaaggaatgcataacagaaggataatgctatcatccttttacttttcttccttcttcatccaggtcctggtccagcctcagatcatcaagacagattcccttgttttgaccacactgaagacagatggcagccctgttatggctgcggtccagaacccggccctcacygccctcaccacccctatccagacggctgcccttcaagtaccagtaagagctgccttctcccccaccctcctccctccccctttattcctggaggtgttagtcttcagagatgttaaatctctatatgctgagtaggtatgggagggtctatagcacaaatcagtcaaattgtaaatgtcacccctcttagttgtttttygctcgaaaaagtattagcaatgtgtgttcgatgtgggagtactggagtctacaaggaggtagaaaagaatagcagaaggaccctctattcttggstaatagctccacacaagaccattcacctcttagatcctgctgatgacttctgaaggaccctagggccaccaggcagggaagggctccaaggtgaagaacatggaaggtaccccatccttcagttgtaggttcttagccactttcagcatcctatagcatgagaatctgatagagtaaatggtgattaaaatttagaagcactagctttattcataaaatccaagaactggaagcaactcaaatgtccatccacaggaaaataagcacattgtgatatattcatacaatgaaattatgcctagcaattaaaaaamagaactgctgacaggcayggtggctcacgcctgtaatctcagcactttgggaggccaagaggggtggatcacctgaggtcaggagtttgagaccagcctggccaacacggtgaaaccccatttctactaaaaatacaaaaattagctgggtatggtggtgcatggtgcatgcctgtaatcccagctactcaggaggctgaggcaggagaattgcttgaacctgagaggtggaagctgcagtgagccgagatcgcaccactgcactccagcctggatgacagaacgagactgactctcaaaaaaaaaaaaaaaagctactgatgcatgaaacaacatggggctgtccctcagaaatagtgtgtcaagccaccgggcgcagtggctcacacctgtaatcccagcactttgggaggccgaggtgggtagatcatgaggtcaggagatcgagaccatcctggctaccatggtgaaaccccgtctctgctaaaaatacaaaaaattagccgggcatggtggcgggcacctgtagtcctagctactcgggaggccgaggtaggagaatgtcgtgaacctgggaggtggagcttgcagtgagccaagattgcgccactgcactccagcccgggcgacagagcaaatctccrtctcaaaaaaaaaaaaaaagaaatagtgtgtcaagccaaaggagttcatgctaatgagtccatttatatgaagtttaaaaagaggcaaaatgaagctatggtgctggaattcagagcggtggtgacaaggaggggaggggcatgcggggactttctgagctggtagaaatgggctatatcttggtctgggtggttatatacattgtgtacatatgtaaaattcatcaagctataaacttaagatttgtggtttttattgtgcatgacgtacttattggcaactaatgaaattgggcacctttttatttatttattggctgattagatattgaggccattatttaagaaattaaactaaaattggtccaggcccagtggctcacgcctgtattcccagcattttgggaggytgaggtgggcagatcacctgaggtcagtagtttgagatcagcctggccaacatgatgaaatyccatctctactaaaaatacaaaaatgagccaggtgtggtggtgggtgcctgtattcccagctactcaggaggctgaggcaggagaatcacttgaaccaggggggtgcaggttgtagtaagctgtgatcacgccactgcactccagcttttgggcaacagagtgagactttgtctcaaaaaaaaaaacaaaaacaaaaaaacaggacgtggtggctcacgcctgtaatcycagcactttgggaggccaaggcgggtggatcmcctgaggtcagcagtttgagaccagcctgaccaacatggagaaaccccgtctctactaaaaatacaaaattagccaggcatggtggcgcatgcctgtaatccaagctactcgggaggctgaggcagcagaatcacttgaagctggraggcagagtttgtggtgagccgagatcacaccattgcattccagcctgggcaacaagagcgaaactccgtctcaaaaaaaataaaataaaataaaataaagttagaaaaaataagaggagaaaacagagatgaagaataaaaaggggagacctccatggttggcctatttacttaatcaaatggctcttattgagagtgtcacttctgcccttgagctttttgatggcaaaattgtataaagaaatgcagtaatttgcttaattgtcatttgagaggaaaaaatgtgtcatacactaggagaaagttttctctggtgccaactcgtggttcaccgtgtacaactttagaagtggttaacagtttgacagcaaagcagaaatcatatgacttgtttctggcataygtagatcaaaacttaaaacatatttagccaygttaatcctcttgtggtgtagtttatcagcagtgattcttgaagggaggtagtaaccaaggttcygtggctcctgagacttcttggggcctgatttgattaacccaggaagagtctcagacctcatgaagtactgccaggtctggcagcacttggccaaagcgggcaggtctgtgttgaggttgctttatgcagactaacaaagggatcattctgctgtgtacctgtccctattctagaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtcttctagaaagtaggagattttatttttaaaacctatctatgtttaaaccctattttgaaagaaaatttcattttccttgcctacaaatctgaaagctgtacatcctaagtaaaaatctatgccttaagataactgtccaggctaggcactgtggcttacgcctgtaatcccagcactttgggaggctgaggcgggtggatcacgaggccaggagttmaagaccagcctggccaacatggtgaaaccccgtctctactaaaaatacaaaaaattagccgggcgtgctggcaggtgcctgtaatcccagctacttggaaggctgaggcaggagaattgtttgaacctgggaggcagaggttgcagtgatctgagatcgcgccattgcactccatcctgggcaacaagagtgaaactctgtcttggaaaaaagaaaaaaaaaaagataactgtccaacaatgctgtggttgtttttttcatttgttttcgttaaagtttgttatggtgctaggattattataagaagtgggaacaatagctaatatttattgagtgtcaactatttgccaggctcagggctaagccctttacactcattatctcatttagccctgctgcaagcctgtgattcacgcgctttcattatctctgtgctaatgaggaggaaagtgaggttctgaggtatggaataacttctcccgagtggcacagctaatcattgggaggaccagcatctgaacttggtttctcctctcacagagccatgctgtcatcccaagtgctagggctctgctcttttcacactgtagcctgcactggtctcactgtgttttcactcatcttcctacccagatgcacaagtctggcgttctgaggaaggccattgattacatcaaatacttgcagcaggtcaatcataaactgcgccaggagaacatggtgctgaagctggcaaatcaaaagaacagtaagtgtgctgagaaaaggcttgtcagccctggcccaggtggggctttgtaaaagcagatcattttcaccaggtggggttttctttgcagagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtacagacttttgaaatctcctgatccctggaatctttcccatttcccctaagaagatagctgggaggtcacagttatgaggccaggccgcatgttaagagggcctagcctggagaaaaacaggaattctgtgaaattagccaggtcctggagaataaagaaagaaaaaactgactccggggggaaacagtccctcaggtttaactggtccttgccgataggccccgtcagagaggaatgagtgccagatccagaacgagaatgcagagtagctgttgtgggggcgttgggagctgctggaggcacctcattgcttcactctgcctttaatgggcctggcaagaccactttgggaggctgatcagttggtttaggatgaggctgcctctgggtcctcttttcagaaatgattacaatttgcagtctaacagataacattttacctatgggcctttaatcgtcaaagcccctggcaatggtagtttaatggaattacttaagagacgctctgagcctaatgatcttcctgggaacctgtagagaccactgggttttgtactgtattttgacttcggcagtttctgactctgaaagcacaaagttccctcctagtgtttgtttttgactaagctgtttattgtatcatatacttaattttactaaggaagctccatttttgaaatattcttataaatgtggwtctgtttggcaacaacaggctgtttgacatataaattgaattagctgggcttctgagtcatcagaagaaaatcttaaatggttttaaaatattgaaaagaaatgacatgctatatacacattggggcgcaggggagatctggcttcagccctcctgctgtaaaatggagagtggggtgggtgtagacaatgatacagttttagaacaggtaaaatcctttagatagattcacactaaatacggtctttgatcaacttcattgaggtgtaatttaaatgcaataaaatatacctactttaaaagtacagtaccaagagttttaacataatgtacagtrctatgtaactgtcactgtaatcaagatatagaacatttccatcaccccaaaaagctcttttgtacacctttgcaggtagtttcccacacccctctccagcctcagacaatgactgattcattggtttcctgttactttagattcattttgcctgttctggaattatacagaaacagaatcatacagtgtgttctcttttgtggtagatttctattttaaaagaaaatctcttctacctttgttctttggaacatgtacttttctcagttagcaagcaggtgaatgtgccaatgtttgagcagcagttagtgaattataggcttctcagttcccatctggccttagtcctgagttaatcgacttgaatttaaacctcataaccatttctcaatatatatatatgtatttataaagtgctgtaaaaacctatgcagtatttattccaacctcgaggccttgttttgaaggtcaaagatgagccagactctcctcctgtggcgctgggcatggtagaccgstcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggtaggtggaggccccttgccccacctgggcatggctrgaccactatggcaggagaaggaccctgtgtacaaacttcttggcttggctaccaggtcccaaagggcttttatagtgggcccccacctgcttgcttctgatagggactggcataagttccattttagaagtaacaaggcaagcccaagttcagtcagaatgagcaaaacaaatcagggacccacactactctaaataccctggggtggaggggtggtacctatttgaaggaggatatcgtgttttttatctgaggttgcaaaaccaatgcctcaaccctttcaaaacaaagatttttatggcactcagctccataatgagaagggctacagtcattagccctgtttagattatagaattatttgccctttcttctgaaaatgaggtagaagactctttcctgtgatagtgctggggtctgtcaggtgcctggctgctccgcaaggcctttcctagcagactctgctgagaygctccttcttaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagagtgagttctgtgtccgcccttccccatcctcccccagacttgacaaataattcagcaactcgtgtcaaagaaagtcctatgatagatgcttgtggtgagaggaaaaagggaccctgctgctgaatagtcacagggcagtggagtgggcgcctctgcatarataattaattccagggacatgagatgatctatgtctccggtatgacaggaataatgaagttgagttctgagggaggggttctagggcttgagcggggctgccaagagtaggaaggaagggcagaggtggcagaaggaccttccaacccgaacacatgaatggacaggctgtttggagactggcaggttccagggtgtgttgagtgtaggttatgtcagagagagttgaaggcaaaggctggtagtgtgtctaggcccaaattggagagggctttcactaggaactgatttggggctttattcccaattctctatagaaccaggaaaggtttttgagcaggaaaactagctgaaagttttcatttgaaatcaacagggagtttacggaaaaaaatctggggcaactcacagcattgaggaagagttaaacatccacatttcaagaggaacaagaaccagaacactcctcagcagcagtgagccatgggcctgccctccccacctctgcaagctgcagggccattagtgagaatctgattggccatcctggatctgtcagccttgctggggctatgggtctcagaatatagatgtgattttgagaggcctgttccttgagtataacatcccaagatgtatatcctagaggcaggttcaggtgtgtgttttacaagcatcattatggtggctgtgaaggataggtaggagggagatgtgaaatgcatggaacatggcaacaagttagggtgctcttttttaagtaaagacaaggtctcactgtgttgcctggctggtcctgaactcctaggctcaagtgatcctctcaccttgacgtcccaaagtgttaggattacaggcatgagccaccacgcctggctgagtcagggggctctatgaaatagactgagtaagagatgatggcaaggacctggaattaaaaggaaaggtttgaactgaataagtatttgaaatgtaatatttggaagggaagtgattagtgacgttgactcaaggataagagaggctccaagatggagtggactccatctaggccatgttgcctggaaaagctggaagaggcccctgtagagtgagcagtgattgagaggcaggccatggggactgagcrggggcggggccagagtgtttgggaagcatgtctgtcagcagagggttcttakggagaattggactggggagtcaggaggggtaagagccaaagactgggacttgggaatagcccatctttgagggaaaggcaggggaggagccagggaacacctgcctcctttggaatctgcaaatgcaggtccttctggctggaaagatagaggcaccttagagactgttgctgtgaggacatcttttcttttcccttgtccagtcctgtaatgatgtgggaaacaaagcacagatagtgtaccagctgcccaatagaggaaaataggagaatttactttcatttcccaagactatatagcctgtcctctagkttccagcagtgagagagagaaagcgagcggtctccagtacagtgccgtagactctccattagaccctctcaggttgacaaagattagttcatctgaatcctagagtagggtagtttagctgtgagtttgcctaaaaccatggttctcaaacttcagcaggcatgaagccgggtgctgtggctcacactgaggtggggggattgcttgagcccaggagttcaagaccagcctgggcaacatagcaaaacccccatctctaaaaatgaaaagaaacgctttagcagacatggcatgagaatcacctagagggcygcaataccagagattctgattcagtagccctggggtaaggtccaagtgcttgcatttctaacaagctcctaagagctgatgctactggcctctgggggccacactttgagaccctgaaagcctaaaggatcatgcagttcatctaaatctgtgtcaccmccttatgtctaaaagctactgctggccgggcatggtggctcacgcctgtaatcccaacactttggaaggccgaggcaggtagatcacttgaggtcaggagttcgagaccagcctgaccaacatggtgaaaccctgtctctactaaaaatmcaaaaaaaaaaaaaaaaaaagtgctactctgagggaactctgaccagcatttgctcatagaacaaacgcacgcagtacaatctcaatcgagtaaaaagtctgtaaggaaatacctcagaatgtcagcagggattcttcctgggggatgagattataggtggttttgttttactttcttgtagctttctgaagtttccctcgtttttatgagtgtgcactaattcctctgataattgggggcagggggagtagaagtctatatcaaaacaaaaagccggagcaaggccagtgaccattaacaccttttgatactttgtagggagattttgcarctgctgccgscaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatcacaggtgagggggcagctgctgctgcctggcttgctgcaaggcatctcatgctacctctcctccttagcttgatttgccagttctgcaccctagctgaagtccctttaacgctactcttttagagtggctagaccaagcttctacctgttttcacagctgtaaggttggctctttgctttagctcatcagttctcagatgcacatgttttcacaataacatcactatactcaggatgtgtcctataaacagtggcacattgtagataagttggcagtgtttttctttagtgatacttaaattaatggtgagacttaaaattgctgacatcttakagtcaatgaaatatgatcatctgtttcattcagtaagctcctgctataataggcagagaggtcaacaaatgaatgacagttcagcgtgagtatgttagacttagcagaaggaacatgttttcgttgggagggagtgggtacccgtttggagggtttcaagaaaggttttctggggaagtagagtcttggctttgcatggaaggatgcatagaggtcaccagctctgcaggagatgagcctctgggcagagggatgttcccaaggaggagccccacctggggtggctcttgagaataagccttcagtggtcctagagggagccagggcacaaaggcagtactcagaccatgaaggatttggatgccaggctgaggatcttgtagtgtatcagtaggattcagtgaagagcattaggaaaatagtgatatgatcaggtttgtgcttctcaagtttagaagagtcaggctgggcatggtagctggctcacacctgtagtcccagcactttgggagactgaggcaggaggatcacttgcactcaggagttcgagaccagcctggacaacgtggcaaaaccccatttctacaaaaaatacaaaaattagccaggcttggtgatgcacacctgtaatcccagctacccaggaggctgatgtgggagaatcactggagcctgggagatcaaggctccagtgagccaagattgcaccatagcactccaaaaaaaaaagtttagaagattcactctgatggcagataaggagtggatcccagaggatcaaggctagagctagagaggccaaatagaagctgatgcagattaaagatgagagttgctgaaaggacagatgagaggaaattagaaggtggaattgactggactggggactcattggactgatggatggggacagtagtcrgctaagacggttccctggttcttccttgggagtttgggtgagcgatggtgccaccaacaaaggtaaagaaaatagaasgaagagcaactttccaggaaaagggtggtgagttcccttttggacacttgcctgtgagatgtggaggtgagctggacatgcaggatctacagcccaaagaagactacaggtgagagtgaaaagcaagggagcctatgagagtggataggtgaaaaggagaccctcagggccattcagaagaacaccctcatctaaagaacagataggccatcgcggtggctcacacctgtaatcccagcactytgggaggccaaggcaggtggatcacctgaggtcaggagttcgagacctgcctggccaacatggcaaaaccctgtctctactaaaaatacaaaaattagccgggtgtggtggcacgtgcctataatcccagttactcgagaggctaaggcaggagaatcacttgaacccaggaggtggaggttgcagtgagccaagatggcaccactgcattccagcctgggcaacaagagcaaaactccatctcaaaaagaaaggataaaggctggcacagcagttcacatctgtaatctcagaactttgggaggtcaaggaaggaaggtcgcttgagcccaggagtttcccatcagcctgggaaacacggggagactccatctctccaaaaaaaattcaaaaaattagctggtttttgtggtgtgtgtctgtggttccagctacttgakaggccaaggtgggaggatcacttgagcctgggaggtagatcgaggctgcagcgagctgtgattgtgccactgcacatgcatgcagagatgaacagatagaggatggggagtcaggggcagaggctgcctgagaggagcagttggagaggtctgaggagacactgagatgctaagtgttggaggagcaaggtcagagagttgaggaggggagattgttgctgggacacccagtaagatgagggccaggaataacagtaggatgtggtaactggaaggtgttagataccttgatggcagtaaggagcttcagccaaaagtggaacagagccaggcaagtgatgtaggagtgaccaggagatgagacagtggggccattgtgcagctttaatatgtgggctcatggtagaattttagcagaaggtccctatctgcaaatttgccccgctgttatcttgtctgttcctcagtgtgcccttgggacagaataagcccatactcasgtctctgatcaggctgtgtcctccttgctgccaaattctggagaattccagctgagaagctttacgtcactcattccttccatactcactggcattccctgtgtgaggcactgaggggacagaggtaactacagtatggttgccacrctgccctctcacctcccttcctgtgtctcctgcaggaggaacacctgaggccagtacagaatggagtgtggaggctgagatctccctaggctgataaaaagacagggaggcaaggcagcccaggagggggaacacagggctggatgagcacgggaagcctggctttgccactgtctgcaccttgacatgggcacttcctcccctgaggcaaggagactgcttgcccttgtagtgaggaccaaagccagcaacagtatgaaagcctcacgagagctgtgatgggcccttgtgcctgtgcaaggatactttgttccctgattaggggatcagccccagatgggccactgtgcacctctcataggggagggtgtggtaagccttcctggcctcccacccactaacccaacatgtgttcagctgtccttgctcagtttacgtcacttccccctcaaacgggtatgtgtttgtgtattgtgaaggcrggtttttttttggcttttttgggggacagagtctcgctctgttgcccaggctggagtgcagtggtgcgatctcagctcactgcaacctccgcatcgcaggctcaagcaattcttctgcctcagccttccaagtagctgcaattacaggcrtgtgccaccacgtccagctaattttttctatttttagtagagatggggtttcactgtgtttgccaggctggtctcraactcctgatcttaagtgatccgccggccttggcctcccaaagtgctgggattacaggtgtgagccactggcacccagccacattgtgaaggttttttaatgaaaataaattcaaatcagttcatctaaaaaaaatttcattacctctgttgaatgtttggaaacacacagtgtggctgtgctgctgacattgttatgttgcactgtgcgcctctgagtcctatacaacaacctgcaattgtgacagctctgggtgygacagaaatgggtgccatgttcccagctaccctgtgaggtagacaggaacacacagccagtatatcacagagcctggcatcccatcctgtgatcaggcctgtctgatcacaaagttcacctcgcttctcccctggttcctctcttactttgatcgtgctggagagagcaggaaaaagtttggttttggggctccatcaacaatagtgtctgtttctgcccaccctagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccgtgagtacccttcggttcccttctgtaaacctcccctgagcacttacctagccaggagttaagatgcagaagcagttatgaacccccttccccatcaggtgctgcccacctggaggggtaggcaggcattcatkcagtcgctcatttcaccaggactcccagcaaccgataaaacagaccaaaattcctccccttgtggccttaataccataagccttgtaggcaggacattttggtccmctgaggtaatatgaggtaatatgaagattggttcagcartagcagagctactgtacttgggggttaatatgcaacttttctgttcttcaagtggtcataaaaattcttagaatcccctggttatgtctcatggttctttcatttactcagaaggtatttattgggcatcttgtrttgatcacagcactgtgaatccagaaataaaagccagtgcctttgccaagctacagagttaaagaaaagaaaaatgaaatgaataaaagtaaaagaaaacctgtgcctgtctacaaggagctcaggtcagacgagggcagggattgtggctatcaagyacctcccatatgcctagctaggagccaggcttgggaactctcaaatgggtaattcccggtccttgttatcagctagctcacaacatgctgacctcaggctttctcttactctagcagaaacaggtatgttttactttgtgtcccactatggatagactgctgaatacatcaggtatgttcaagcattaccacatctctatttgtttccgtatctcagtaacagcagagatgagctgagaatgaatcagaacgtgccctgtagtgacattgatatatttcctgaggtacatcacgatagtctaggggacaaagggcgcagggaagcccagtgtactctttatgtctacacttgatcttagccagaaggctgagaagtgatactttttatgtcttacctctgtttctggtgactacagataagagactcatcccttgattcactcattcagcaaatatgactgagcaccgtctctaagcaggacatttgccttgtcctcagggagcatagttggcaaggaatctagacagcagcccttcttgagcttgacattgatcttctcatgaggaggactgggctccaggtggggaaagaaccccatcctcacttgtgggctagacgacctgggagtccacagacactgaagacacatcattcttcctattcatttcaaccttccctcgacagatcttcctgggaccaggtcttcaggacagtgtgagctagggtgagctcctgagctggtcttgggggaagtcagggtgggctttctggggaaggtgaatctaggctgacagcaggaggcattgatgagatctctctccttttcagtttattgaagtgctctgggctgatgtcattacatttgtaacttccatgccccccaaaaatgttttgaagacattcattttatcaaaatacaacatacatgcagaaaaatgcccacattttaacttacggcttgaagtgaagttacccatgcaacacccacccacatcaagaagtagaacattcccagcacccccagaagccttcttgaggccctccctgctcttcctgccccaaccaaggtaaccactcttctgaattctgtcactggagtttaatctgtctattgttcatcatttcagtaaacttatcaaagtacatgcttagaagtctggctgggagggcygggcacggtggcttacccctgtaatcccggcactttgggaggccaaggcgagcagatcacctgaggtcaggagttcaagaccagcctgaccaatatgatgaaaccctgtctctactaaaaatacaaaaattagccaggcgtggtggcatgtgcctataatctcagctacttgggaggctgagacaggagaatcacttgaacccaggaggtggagggtgcattgagcggagatcacgccattgcactccagcctgggcaacagagcaagactccatctcaaaataaatacatacgtacatacaaacaaaaattagcyggatgtggtggtgcacacctgtaatcccagctacttgggaggctgaggcaggagaatcgcctgaacctgggaagtggaggttgtaatgagccaagattgcaccactgcactccagcctgggtgacagagtgagtgagactccgtctcaagaaaaaaaaaaaagattacaatatgcatgtcaaaaagtatacaaatcataaatacacagttcagtgactccacagagtaaacacacccttatagccagcagacagatcaaagtacagaaccaagaccccagaaacttctcttgggccctttgcaatcactaacctgccccttcccccaagccttccagccttccaagggtaaccaccatcctagtcacctcagatgctttgcctctgtttaaactatattaatataaggagagtcttgcagtatacactgttttgtgtctgacttattttgctcaatatcatgtgtaagaatcatkwtgttgttatgtagaattatagattgttcgttctcatatttatagtgttccattgtatgactagattattgcagatgaactttttagttgttttctggctttggttattatgaagggtgctgctgtgaacctccttgtacacacatctttcaggaaacrtgactgcatttttaggaatggcatcgctgggtcagaggttgtgcgtatttccaaattgttggccattctccactccatcagcagtgaacaagacttctagttctacatccttaccgaacacatataatgtcaatttttttaagcccttctagtgtatctcattgtagttttcatttgtacttcccaggtgattaatgagattgagcacctcttcttacatttattggcaatttggatagtctgtttcgttacattcaattcaagtcttacctctttttcatttggactatctgtcgtctcattgattagaggaattctttattctggagattacccctttattggatatatgcttttcagataccttctcccactctggggcttgcctgttctgtcttaatggtgtctagtgagagcacaagctcttaatttcagtgaaatccagattattagtcttttcctttacagttaracattttaagtcctgttcaataaatctttgtcctacctcaaagtcatgaagatattctcctatgttgtctgctagacgytttattttttactctttacacatatgtacctaatccacctggaattaatttttataagagttggaggtaggagtgcaagatctgtttttctccataaggatatctacctgacgcagaacctgttattttaaaaactatccttcccctgctgcaccaagtggcacctttttttcataaatcaaggatccgtgtaccgtgggtctgcctccagatctagtctgttccactgcaccatcaccacccaaccctaacggctgagttttctcttacgtcttgatgtctggaagtgttggtcttccagatttagtgactaacgatgaatcttgggtgtttctttgtagcctcttcattctacagaggtacttgatgctgctgatggacatttgggttgtttccagtatttgccgttataaacagtgctttagggaacatttttgtccattgtcttcatgcacctccataagagtttcctcagaccaaatctgtagagatggtgatgctgtgtcaaaggatataaatatttgaaacttaatagtattaccaaatttgcatattcagtaagatggaaaaaggagaactgtcatctttaaagtaactgctcttctctgtttacttctcttgagagaggataaagagactcagacagtactttcttataaaggaagaagctttgaatttggtgagatatatttagctacaaatgagccagttgttgggggcaagtggagggctggcctctgtgaaaatggtttagactagaggttcccaaacttgctcaactcatgactcaagattcccaaacwttctctactcactatgtctcagtaaatttttcatggcatcccttagccaaaagaaatacctaacggttctggttttcgttttttgaaacagtgtcttgctctgttgcccaggctggagtgcagtggtgcaatcacggcacactctagcctcaacctctctgggctcaagtgatcatcccacctcaccctcccgagtagctgggactgcaggtatacaccaccacaccgagcttatttttgtattttttgtaaagtcagggttttgctatgttgctcaggctggtctcgaactcctgggcttaagcgatctgcccacctcagcctctcaaagtgctgggattataggcatgcaccaccgcgcctggcctctgttaagtagttaagtttgaacatcctaataggtatttaaattgtcttaacagcttagtggtcatttgaaaaaatcatatgtcaagttgaaagaagaaataatattttttgctaggagtggtagcacacacctgtggtcccagctcctcaggagactgaggtaggagaatctcctgaaaccacgagtttgaggctgcagttagctatggtcacacctgtgaatagagccactccactccagcctggacaacatagtgagaccatgtctctattaaaaaaaaaaaaaagaggttgggcacggtggctcatacctgtaatcccagcacttaaggaggctgaggcgggtggatcacctaaggtcaggagtttgagaccagcctggccaacatgatgaaactccgtgtctactaaaaatacaaaaattagccagggatsgtagcacgcacctgtaatcccagctactcggaaggctgagacagaatcacttgaacccaggagtcagaggttgccgtgagccgagattgtgccactgcactctgggtgacagagcaagactctgtctcaaaagaaagaaagagagagaatattttggattcttaataatttcttagaaatcatggttattaagaatccaaaatattcttttatttatttatttattttttgagatacagcctcactctgttgcccaggctggagtggaatggctcttcacaagcatggtgtcactgtttcttaccaatacatgaacctgtcaagcactgcacacctcaagctttggaatcagactagcaaccatcactctctctcttttccacattrattttcacacagtactatgacagatatcacatctccaaaggaagctagtgtggtctcaatgctgaggctgcatgctctccccatctagtcacttacagtgcccarctgatgttgagcatcactgttttcctcgaaagtttaaaatagccagtggctcccttgatcacttgctgtggcacctcagactgccttggcacacgatttgagagccatggggttagaccgatgttaggggacacaacctggggttgggactggcccagggatactgagtggctctcaggatctaaacagttgtggggttcttgccacagcctctttcacatcaggcaattagcagatgagttacagggggaggctcctaggccccagttggggaagattctggtgtctataaaatttaggaaamcttaaaaaaaaatttttttttttttggcttgggattacaagccaagccaccagcgtggccaagatggtgaaaccctgtctctactaaaaatataaaaattagctgggtgcggtggcgggtgcctataatcccagctacttgggaggctgaggcaggagaattgctagaacccaggaggcggaggttgcagtgagccaagatcacaccactgcactccagcctgggtgacagagcaagactctgtctttaaaaaaaaaaagaaaagaaaagaattaagcttaaaatacatttttacttagtgatttccacatttgcctttctggttcctcttgccgtatgacctggactaggctttgcttctacttgtaacatttgggccctcgtgagggaccagttggtcctcagtttctcctggagcagccaccaggctcccttgctgattggacatgtggaattggctgttcttggaaagagagttggagtcaaccgttcaaatgttctgggacctccgaagcccaggaatcacgccaccaccccccaatctccctccctgctcagctcctcaactgctattctcccaccattgcagttatcagctcagattcagtgagtgctttgtggaaggttggcagagggtcgcgagggtcctctacatttgttctccagtatccagtatcaacactggttaccaaagaggaaggacggactattggtgcccctggtcccagtgattagaaatgtaagtgaaacaccccacctcatctcataagctgctttgagattatgagtrtgtgtctatagaacaggttgttttctctcagactcaggcagtgtctccaggttccccctggagagagatagtcttctctgtctgtgtcctcgagtggcactctgacagtgctatttctgaccctggcattcaagtcttctgaagccgttacattcgctgatggctacttagagcccagtaaaggtcagaaccatcagactgaaccagaccatgaaacagcgctgctcctgtgggggcgagggctggggtgtggaagcgatgtctgcgggcctcggcctggcagccccgcccctgggctccctgggctttctatcttatgcttctccctccctcctgtcttctgtcctcagttcctcactcaccctggcctgtttcggggagtggttatgggttggaagtcatgggtgttagtgtgaaaataccctcactcaaaaagtgacagaactgaaaacgtggtagatggtattgtccctgcagttcttgtcagtggggtcctggaatgatgttatcccggcaagtggaggaggggcccagtgaccggggccctggctctttgaattgtcccacaaagaggctttccaggttccccctctgttctttctcgcaggctggtgttcacatcaggggctcatgcaggggtgccatggggtttctgtagggggccgcccttgcagggccagctttgtggggggagtctctcaaccacctgcacacagatacttgcctgtacagggcctgggctgtcctcccagctgccccttcactccagtgccatctgatgtgaccctgacggctggccatgtgccgagcactgttctaaactttacacgcaaagtaaaagtaaaagaaaaattagtcaaagcagaataattttgcctaaaatagtctaaaagatatgtaattaaaatgacatgatgggccaggcacggtggctcacgcctgtaatcccagcactttgggaggccgagacgggcggatcacgaggtcaagagatcgagaccatcctggctaacacggtgaaaccccgtctctactaaaaatacaaaaattagccgggcatggtggcgcgcgcctgtagtcccagctacacrggaggctgaggcaggagaatggcgtgaacccgggaggcagagcttgcagtgagtcgagatcgcgccactgcactccagcctgggcgacagagcgaaactccgtctcaaaaaaaaaaaaaaaaaaaaatgacatgataaaaagtcccaggatagaaggggctgcctggcttggcactctcggggccgaggggaaagtacagcagccagggggcccctgagacccctccttgggaaaccgccttcctagtttaccctgcaggttgaatgccagtaggatcaggcagccccagcaggacaggatgcagcaggggccccacgcgtgccttgtggctgctccctgccctcctgctgggatgtggacctagtcagcaagtccagcacactctactggtgggcttgccctagtttccatggtgggctttactttcaggtacctgtgggagtcctakccctgtgctgatctttcccagtctcccccaaagcccacctccaccatggtgctttctgcaccccacagtggctgcagccagcattctgccaccttggtgttrcccctggtccttgtccttccacagagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccaggtgagaataccttggagccattcagaattggagaaagccatgcaaaccgccggtactacagagtcactgcaccagacacgcggagacacgggttgtctcttaatcttgttgagtccgtttgtttgtttgtttgtttgtttgtttgaaccaaagctcagggaggttgagtaacttgcytaaggtcacaagcctgatcagaaattgtcagtgrctaagctgggtgtgcagctctgctctctctaacattcagagcccatggtccttacatcacacagyaataaattgtgattaagctccaagggtactcttagcccttgttttgggcactttggagacacaaaggatgtgtgaggcttgctttccctggcctccaggtctctcccattgggagagcagacagacataaatggagagtttgggaacaataggtggcaggcagtcatcaactgctcagagtggtgacagggacgaggcttcaggcattggaaggaggtgctggctttctgtccctggcrtttgatagtgattggagttgactcgcccggccttggagcagtagaggctggtcaggattgacttagaccttgagtgctcagtggctgtctgctttctgctgtacttttcctcccctctcagaattggagtctgtggggagagtaaggttctacaggtataggggtgtgtgtcacacattgggggagttcactgtccttttcttttttaaataataactgtattgctcaacgtgagaattgtgtgcaacaccaaaatataaaggatgaaagcaaaagcaatcctaaatctttctaccccacccctgctggctaaacatggacttctcagtggctttgtcatctctggcagtctctggctccaggccttgttacytggaatgtgttcataagtgtccctcctcctggtcattagatcgaggcccacatatctgccacatgtgaggagagagaaggggctggtgatttgaggcctgccagtaaagaaacttgctggtgacagtcagctatccaagcattgcaaggccccgtgtctagccagttcagacaggtcactgctgatggcacgttccatgacaaggctctggaaaaaccggagcatgttcttcgttgtcatgagcgtggcagcagctaccacctttttttccttgcctggtggttctccttagccacatggagaagagaaatcctctgagacattccattttctgttttctgatccaactccacctgacagctcccaaccttagagtactgagcactgtgccaggagacacagcaccctcccccacaccccctccccaccggagctcatccagaactagtcttgagctcttcaggctgggagtgaacactctcccccatcctccaactgtttagcacagtagttctgggctttggtggagaaggggcatctgatccccattcacaaggcatggctgtgtttggagtttctctccgtaaagacaaagtgggctcataaatgagctccatttaaccccccttgcctgtctcttttccagctgaccccattgcgcaggtccaccaggccttctgcaagaacctgctggagcgagctatagagtccttggtgaaacctcaggccaagaagaaggctggagaccaggaagaagagagctggtaaagtccccagaccagtccccctgccttaggacctgtccacgcaggcaactccaggacagcctgaaggcctgcactcctggagggaaacaagcctggcatcgggttggcagggcaatcaaatggttcctttgtatttaatttctcaaaaatgagagccctatgttaactctgacctggcctttcctcctagaccaagtgcgttttttttttttttttggagacggagtctcgctctgtcactcaggttggagtgcagtggcgcaatcttggcacactgcaagctctgcctcctgggttcacgccattcttctgtgtcagcctcctgagtagctgggactacaggcgcctgccaccatgcccggctaattttttgtatttttagtagagacgaggtttcwccatgttagccaggatggtctcgacctcgtgatccgcytgcctcagcctcccaaagtgctgggattacaggcgtgagccaccatgcccaggcctttttttttttttttttttttgagatggagtttcgctcttgttgcccaggctggagtgcaatggaccagtctcagctcactgcaacctctgcctcccgggttcaagtgattcttctgccttagcctcccaagtagctgggattacaggcgcccaccaccatgcctggctaatttttgtacttttagtagagatgaggtttcaccatgtcattcaggctggtcttgaactcctgatctcgggcaatccgcctgcctcggcctcccaaagtgctgggattacaggcatgagccaccacgcctggcaggtgcacccatttttatgtatccctttaccaagcggagtcagtacttggaccaagtcagggatttcattagcttgctctgctttttggggtagggagcaggggcctgttgaaaggggatgggggctgggtgcagtggctcacgtctgtaatcccagcactttgggtgggaggccaaggtgggcagatcacgaggtcaggagatcgagaccatcctggctaacacggtgaaaccccgtctactaaaaatacaaaaaattagccaggcgtggkggcgggcgcctgtggtcccagctattccggaggctgaggcaggagaatggcatgaatccgggaggcggagsttgcagtgagccaagattgcgccactrcaytccagcctgggtgacagagctagactctgtctcaaaaaaaaaaaaagaaaggggatgggaatgaaatgtgacgagctcagcagaaggcagacacatctggcctggacatcttggggacccagcccctcatggaatgtgccgggcaatttttctctctgacatacttactgagcacagtccttctttcacagagtaagacctgagaggcagataggtgccaaagtcacttttgttttttgttatttttgtttgttttttggggggttttttgagacagtgtctcactctgtcacccaggctggaatgtagtggtacagtcttggctcactgcaacctctgcctcctgggttcaagcggttctcctgcctcagcctcccaagtagctggaattacaggcacgcgccaccatgcccgactcatttttgtatttcttggtagaggcagagtttcaccattggtcaggctggtctggaactcctgacctcaagtgatctgcctgccttggcctcccaaagtgctgggattacaggcgtgagccaccgtgcccggccccaaagtcactttcctacaaggcccagatcctgattagggtgcacctgaggagagggggagggggcagttctgcctgggagataagaaaacttttgggaggagatgacactggacttggggcttaaggagaggagtgagggtaggctgtgggggatgctagggaaaggcccccagtagagggaagagtgtcagtgacagcccagagacacggaggaaggatgcctgaggaatayaaagggtacacatagacagcgcttgcrtgtgcctgggatgacaggaaagggacagaaatggccattgggtcttagagctggagagctgaacagctaggccatgaggtgggccttgtgtatatgttttgatgtacatgggaccctttcttttcttcctagtgaattctccagtgctctggagtacttgaaattacttcattcttttgtggactctgtgggggttatgagccccccactctccagsagctccgtgctcaagtccgccctgggtaagcacctgcgggtggcccacagtctcagggtgctcagttcaggtcttcacagtgcttttgccccaggggtccagggcgttaggagtgtagatgccagcatcttctctggatcccaggttcatacctgtggctccagttcacagtcaccccctcccaaacagcactcagaggcaggaaactatggttttcagagaagtagggcaatgagtaattgaatgtcttcctcaagccctagctgtgtgacccaggtgaggacccttcttaatgcccagaagaacaagcaatgagtggcccaggcaccagggatggtggggagtcacctttcagatgcacagtggcccctgaggcagctcttgggccttatgctctttgctgaagagacttttcatctgggcctctctaccactcctcagcccctcatcacatcagtgtcacagcacagcccactgactggattgacatcatgacatttctttgcttctgtccctaaactgccatcaggatgatagcacatcagctgccaactcttgggcttctgtggccaccctggaagatgggggtaccaagctaccgctggtcactctccctagggagggagggatcccagaaaatcagccaccctatcatgatccctgacctgtggcctctgttttcaagtttagggaagcatgaccatccccgctggttttgtgggatcactactgtcatcattttgcagttgagaaaactaaggctgagagaggagaagacttaaaatattctaacaggagcctgttccagatactttgaagataccattctttatggctattgaaagcttaggttgtatccatctttttatttaaaaacaacactgcagtcaaatatgtgttaaacttttttctctctaagccagtttcattatgacagactgccaaaaatgggattactagcttaacgggagtgaacttttttattttttttgagacggagtcttactcttgttgcccaggctggagtgcaatggcrcgatctcggctcactgcaacctccgcccgcaccgaggttcaagcgattctcttgcctcagcctccctagtagctgggattacagtcacccgccaccatgcccagctaatttttttgtgtatttttagtagagagggggtttcaccatgttggccaggctggyctcaaactcctgacctcaggtgatccacctgcctcagcctcccaaaatgctgggattacaggcgtgagccaccgcggccaaccaggaatgaacatttttaaggctcttgatatatattgccaaacactttccaagattgtgctggtctattcccctcccccagaatcctgggtgtgggagcccagaggctgctggcccrttcccagcaggcaaagatgttacccatctcctaggaaggaagtgtagcagcctctgagcgccacaggtctcgtttctgtgggtgctggagtgcgtttggtgctgttctcctctaggtccagacatcatctgtcggtggtggacgtctgcaatcactgtggccatcagctggctccagggagacgatgcagctgtgcgctctcattttaccaaagtggaacgcatccccaaggccctggaagtgacagagtgcgtaaccctccttggcmactcacttgcttctctccaggggaatcttgtttgagttagcaggagcaaactggactgggtgggcgtgttggggtgaagggtcaggactgcatgacaggtgggcggctagaaaagtcgggggtgagggcaccatggagaactcaagttgggccagcaggtcctctgtgcaagtgtcctgctctgcacaacacgacagttgtcccagcavctgtcagcactgtgtccgggtcctcctccctgcagccttcatggcgccacaggctgaaaagaagagacgagagcagtgtggcccccagcatcttcagaagctttgtggtggaggcaggcactggtggttcacaatcagtgcagagaggccactgttgcccccaaaactcatgtgcactggagcatcttgcccctgtgtgctagcattttatccactttccttccagccacctccasccccaccatcaaccctggcaactttgtcctgtaactaaaatagcctttarcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatacacaggcttgaagtcctttgttccctgaagtagatgtgacaccctaatttcattgaagtagccccatttgtaagcactctgactaggtaagcacccagcccggtatagcattccacctgtatgtgtgtctcccccagtcgatgtgcctgaggacactgagactcagcaggtaagttgtccaaagtcacctcgctccagagcagcagagcttccatggacagccaagacacccctgcaggcactgctgcctgctggattcacttacccctgggtccctctgcttttcagggactaggatgctatgagaaccctcccccatccctagcctccccttccactcccagtctcctctacagaaagaagctaactaagtatctccagagagtttaataccacatctctgsgggggtggtcccttaaagaacgggtacaacaccttattgtggccactttataggtaaggaaactgaggcacacgttggaatgactatcttgggtggcttcttagcagcagacgtgatggtgaagcctgtgtctctgacttccagcattgaatgaaggtgctaaagggtggggcgctaaccctagctcagggctggcatttcagatctggagctggtggcatggtgccatagtggcagcattggagtcaacagatgcacatgtcatatcagtgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtgagtgggagctgagttggcccctgggggaggtgctctgcactggtttasgagaacactcccactcacctcatgctgaccctgcgggtggggccatccgaaagacagagaaaccaggacagcagccccctttcaaaaaagttacggcttattggcctaggtggactcctttttcatcccttttcagcctctgaggcaagygtgtttctacctgcacctttcttaggctcccagagtcccaggtcctgctggcccatagcctctgtaagcccaggtgcaccccagctggccaggggttcacctgcatttgctccagcggtttgcgtgacttcccaggcctctgcaggcagccttggagtgggttcctgccccctcgggcacacaaacagagctgaagaccaccctgggcacctccttggctggccgcatacctcctggcgggcagctgtggtgcattgtagttgcattgcatgttctggtggtacccatgcaatgtttccacagtgcatcacagaggcctgcctggccctcgagagactgccctgactgaaggccctatcaggtgggggaggggatcctgatagagggcactgctgccactgttggggcccaagtcacagccatcccaggaaacaggagggcacccagctgaaagtggagcatcacctggtctacggggaacatgtccttagctccagagtgggagggaccrggagagtcctggagattcagattctcagccactccctggggcttggtcttagctggctaggctagtacttcaagctagatattgtcagtggacctgggcaytgggatgaacccaggacagcgtggcagcccctacagggacaggcaatgtgcagaaaaggcccaaactggctggacgcggtggctcacacctgtaatcccagcactttgggaagctgaggtgggcagatcacctgaggtcaggagttcgagaccagcctgaccaacatggtgaaaccccgtttgtactaaaaatacaaaaataagccaggtgtggtggcatgtatctgtaatcccagctactcaggaggctgaggcagaagaatcacttgaacccaggaggtagaggttgcagtgagtcgagattgcaccactgcactccagcctgggcaacagagcgagactccatctttaaaaaaaagctggtgggggtgcccaaatgccctgggctgccaagaccaaaggcagatggtgagccacatttcaccttctcttttgggctttccattagtctcttccgtatttgtcttcatgagagaaccaaacagtacaggctcagtttggggaatgagaggcttgcagccaccctttggactggggttccttggtagcagctctgtggtaggaaagtgagcctagaagacaacgccatgcagcctgatggccctcggagggcagaatccagacataggcctgctgcctccatgcccacaggygcttctgcagcatgcacagcttagaagtgccaggttttgaggagagggatccttttccacatccccttgaagcacacaacagccagaaaacagtgtaggcaaggatcaaggccttgtgcagggacagggcagggtcttcctcaggcccagtgtcctgggaaggaggaaagccagggctgggtgagatgaggctcagcctgagggagttcatcaggaccggagggctgcttgcggcccatctcaacaaggactcctcactgctcggtgtcgtgcaggtgtgccactgcgagccgggtgggcagcccagccccataggtcgtaggcagagagtatgcatggcccacatgcagtaccttctcatatgatacaacagccctgtgatggtgccatttacatttttttgaatgaagaaactgaggctcagagagactaagtcctatgccagggtcatgtagctagtaagtggcaaagccgggtcagtaggcctagtccccaagcactaaggcactctgtggttctgtcttctgagacacctgtctccctctcccactcctcctcctccttcccccagccccatcgacaggctctgctgycacttcaggcttttccttggtaccttgtgggtatctcagcctcctagccagccatggtgggactcccatggggtggaagaacctgcgccttcaacccacaagggttttatttctgcccctrccacctgcctgtgctgtattccctatacaagctgctgtccctgtcagagccttgctttctcacctgcagaatggggagggcttgtctcccacytcctggggccatggaaggaactggttctcccctgagctgttccctcacgtcctgcggagttcaccagactctggggctctccacttcctcccagagctgctgagtgttggtctggggagaggcctggtaggtgctargatccttgcctcagggatgggccagtcacctgtctcccctctctcgtggctgaccccacaggtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgaggcccagctggctggtggggcagggcagattggagcctgtggggcctgagcccagaacccagcatgggcaccagcatgtggttgtggagttggccctctgaggtcagcctggtgacctgtcgagcacctgcttggctcgtgcccaacactgggctaggcgccatgtgtccctgtgttcagcacacattggttgagtgcctgctgtatgcctggccctggagctcagcagggagcaggccacactttgctgccacagacaggggccagcagggagctgtgcctccccaggcacatgctgggtgggagggctctgagggcaatggtggcaagtcagggctcctggcctggtcccgagctccacgttgactttcattctttttcacagtagctagaggcttcggttctgctgctgggtaacatccccttggcagtggccacgtgatctgaactaagtcacggaggaaagttctatgactgggcttgccaggctccagctatttccttttttgtttatttgtattgctatataatgtattcaacatatttgtacctgtatttttttctaaaaatttgagtgagatgactcaagtgtcattgagggggcacgggctgggctggaagaaggcctcagagcgaggctgctgccgtggagcttgggattcagcccccacacccatcaccctgaggtgctgcggggcccacccagggttgcactgtggccactgtgtgcagcaagccaagacagacacaacagacagtatcatcggagagccattccttactgtggagaagagggcatgtaccccaggcctggagcggcacccctgcctcctggagcccactctggtcagctctctggtctgctcacagcatggctggcatcagtggcctttttttcrtaatagatggggtcttgctatgtggcccaggctggtctcaaacccctagcctcaagctgtcctcctgcctcggcctcccaaagtgctgggattacaggtgtgagccacctygcctggtccaaaggcctcctcttaaataccatttccattctgctgctccctgctgagagcccatcagcggctccccattgcctaccaggaccagaatccacttggcagcactgaagaccctccctgaagactgagatataaaggcatcaaaaagagcttgagattttaagaaatgacagacctcagccttgcccttcacccaccagtggctcatacctaagcgctgcagactttacccgcacacctctagactctcttcctttctaaagatacggaaagaggataccaaacctctctggtaccagcccaactgtccctcctcacccctctgtccctgtcacacctgtccttttgtcaaactgcaggcagcctccagggccttggggcttcacccagggcacttgtctaccagccccacraggtgcgtccagggctttcttgtcaccagttgggaaaagcaggccttttgcctctctctcctctcatcctgctcctgctgttcagccaggtttcctgcctggctcagggtcagagtaygggacaacagasgttgcttttcaggggtgagcaaggcagggtggtgtgggaagggatgtcatgaggtggcaggcgagatggctcagggagagctaccctgggcatagatgggtggggaccaggggtgtgatggatgtcaccccggcacctccccaggtgttcctgcatgaagccaccgtgcgcctgatggcaggagccagccccacccgcacccaccagctgctggaacacagcctgmggcggcgcaccacgcagagcaccaagcacggtgagtccacccctccccagctcacaggctgggccrggccctgcgccctaggaagagaggagaagaggggccagcccagctcccacatctggcattggtgcccagcacacctctcgcctctctgagaatgaaagaagcccgaggccgcccttggygggttgcaggggttggggtggtcatgggtcatgctgtgatcagggaaggagggttggggtggcgtcccagcacaggtgcaggcatagaagcagaagctcgagccaggtcatgtgggcccatctcagccccaccacgggctggccgtgagaggctggacaagttcacttcttttccgtggattgggtggggcagcagacyccacctcccaggatggatgtgagcgttcagtgaatgagtccaggtaacgccaaggaactgcaccaacttcatggtagattctcggttgtgacacacatctccttcccacaggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctcyccccctcagcatcttcccgctgagagtggtggggargagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcrgatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccrtggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccctaatccctccccagcggcaagcccctcttttcaragtgggcagagggttgcctatggtgggcactaggaatgaggtcccctgcctcgatgcgggtcctaggagaaaaagtcctacttttctgggtccccaggtgcagcacctcccrgagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagcacgaggtgtgtgagggtctgtagtgcgactgctgtggtgcccagccaaggggctgcgtgacttggcaggcaatgggccagggactgagggcagccccccaactgctgagagggcccctggcttcagtctaatgggcctcccttgtccaccttccttccggtgcctggcgcaccctccagcctgggataaaagggctgtgggtggcactttgggggtcagaggtcactgtatccaggttccagcttgttccctggatgtaatgcaggctggctgacagatttggggtgctgaccctctcccccactgggtaaactgctccttagtttctccctccctgaagtcagtgatcctctgagccaggaggctcactggcccacaagtcagatccaagtccaggtcctgtgcttcccagctgggtcacctggggtgggacctggcctcagtctccacttccacgtgtgcagaattgggaagctaagctcagccatgaactgcagctccaaaggcttgtctgccaggactgagtgatgggatgcaagtttacagcgagtgccttgtgtggctggtgaggccaggcttggcgtaagacacaccaggggacaggaccacagactgggatgggagtgctgggcctcgtcgcaagaggagtcaggatgtgactgagcatgtggctgaatccctcakctatgagccacatccttctctgaagggtagtcacagcaggctaccctgagaccagagcagcccggtgaggcccaattgcagctggtcccgtgcacagctccatcattttcagggatggccactgcccacagcctcagcctggctccactgggatggagatccagggcccttggaactgagaatgagcagggggaattgcccactcttggcacagcccagcagggggtgggaggtggggtgagaagcaaccagattcctttgtgagtctgtgtaggctccatgcctcagcccccaccctcctccagctctgcacagctgtgggacaggggcaggaccgtgggcccagagctctgtcctggtgcttctaggccttggtttccttaacagcctaaagggacagggaggtggaccctttgtggcaggagcggagaccgggcctggtgggttctggggcctcagggcagcccaaccagcagaaggaaagctccagactgtttatatataccctgggaacagggacccctccctaccaaccctcagaaccctccctcccagccaaactgcctgttgcttgccattccagccgattcacagcaattcgggagagtcctaacctgggagtctgctgggtgaccttgggcaagctacttaggtttcaaaacccaaatttcctcctctgtaaagacacacccacttgaggcgcttgtggatttcctgagaaaggccaacaaatggtggccattgttcttaaaacagtacaycacacttcaggtactcaggagggaaacagacccacctgggtggctttgctgaggtcacacacctcaaccagccacagccctggcccctagcctccccacatcacacacctcaaccagccacagccctggcccctagcctccccacatcacacacctcaaccagccacagccctgacccctagcctccccagtgttacctggcggagaggaactctgtggaagatgcacgcagactgctagcagtgctctggaccacagccaggtgcaggaagccctcccggagggacactgccagggaccctgctccagcttttcccccatttccttcagagaagctcctgggaggaggcgcccccatccggagcaccagatgtccacacggcccacacccattaaggggggtagcccggggccaatctggccaagcgacctgcaggccaggggctggcccacagccagtggtcagtgagcatcagccaggttcagccaactcaagctgcagagtggcggctggagggggctcaccttcagtacagggcatggaccccccactgggccttggacccaacagccctctctcctgtgcccgggcctttctatggctgaagtctaactgttccctctctcccagggctcccacgggggtgggcattaaccctgacattcaaccctggcccccctctccagccacttccccctggctctggccggtgcactggagcagtcctccaaccttgcactcgccgtgcccwctgcctgcactgccatctgtacagtcagtgaccaatggtgcctcgcagccacgctggggcttctttattctcagrggcaggaaccacataaaagggcttatttacaagacgaacccgcggcctgcaggctccaagacaccactgccgttgaggcagacagaagagctggccttacggcaggcgctcctctccctgtggcctgaggctccracgggcagacaggaccccagcccatgcctcgagggcaccgcggccccgcttcacacggtgacctcggtcttgctattggtccttaggtaccgggacccgcggcccgcgctgccgtaaaggccggggagctgcgggttgaaggtctcaggcatcttcacactgaactggcgccgggccgcgtgcccgggtcgccggggtacctggaaggcccgagccgtcgggtggctgagcggggcgggccgggccgggcgactggaggtccaggcggcataggggcccggcgcggcagggggcgcgtagaccggcggggcccaggggcaggcgtccagcggcgcaggcaagtccggggatggtcgcggagcccgcgccgggggttgccgcggggacggctcgagggcggggaaacgctgacagaagtcccgcggggcggcctctgcggggacagggcagggaagagtgacgccgcgccgagcacccaagctcaggactggacaaggggtcccggccggggactgggacggggaccgggccggggcgggccgggggcggggcccgctggggcgagggagccgattggccgagcggcgggcgcgcggaactgggaatttggcgcttggagctgcggccccgcgcttcgcagtccgggagctcgtgcgcccaggtgccctgacgctgcccgcacccgccactcacctgcggccttgagcgcggcggccttgaacgtggcgtacttggcgtagtctggctgcagcgtcaggctgccgccgccctgcagccgcgggccgcgcgggggccccggggcggccgacccccggggcgcgttgttgaggcgcttcttgtctggagcgaggagtgagacgcggctcggtccgatgccccggttcactccgccctcgctgtcacctctccgtagtcctctccccgaggccgttcggtgagaacctgggggaccgttctccgggcgaggctgcgagccaagcctgtcttcgccgcagcctccagcgcctggaacagggcctggctccgagtcacgcgcagcggcggcggcagccagcccggggggtgccaccctcatgaacggctcgcccggaggcgacgctcgagccaggcgcggagtcctgggacctgctcccgccgagacgggggatgtctgaggaacagaacccagacggggcgtgggggctgccaagcctgcctgcctctcgagagacccagggggaggctctggagcccgagcctcagatcacagccccggccagcaaatcctgcatctggaaccttcctcacacatcacagccccccagactcgaggccgcaggacccgtggggggtccctttccaccctggcgagctggctggccggtcgggcccctcacccgcagaggccgcggctcwtttccaccggggaagcctctatgccccagccgagggaccgcctctcggcctctcasgcccctccgcgtgctccgccgccgctcagccccgcccgccaccgactcacctgcgctgttgtggggggagccccgggggaggccgtcccccatctgcacctggacacagccacccaggggtgggcccagggtgggaggcagtggctcctgggggcccggctgcttcagaagctctgtcagcgccctgcggggacagcagtcaggggtggccctctgtctcccacctcatcaaaagccagccccggccaccaccgtctcaccgtgtggccctgggcagttctttcggcctctccaggccgtcctctccggtgctcgaaatcacgcacgagtttcccctcccaggcagtatctgccagcctcacctgtggccccaagacagctgcttcccagagcaggtcaggaaactctaatgaggctccccttccctcccctcccctccctggagcccactctcagggaccttccccaggtgagcctcccctcccaatgcgagctttctctgctttcctgcctcttctcccaaaaaactgctactcattcttcagaccccatcagcggcctcctccaggaatcctttttttwaatttttttatyttttgaagcagagtctcgctctgttgtccaggctggagtgcaatggcrcaatcttggctcactgcaacctccacctccccggttcaagtgattctccagcctcagcttccctagtagctgggattataaggtgcctgccaccacacctagctaatttttgtatttttagtagagacggggtttcaccatgttggccaggctggtctccaactccgccggtctcggcctcccaaagtgctgagatgacaggtgtgagccaccgcgcccggcccaggatgccttatttacctgcctgcctaactgcccctgcagccgcrgcttctgctgggacctgggataaagctgccatcacgggcatgaaggacagatgggtgacggaatggggatkttgggagaccccctggtggcagcccaggacccacaggctgtgtgaccttggacagccacctccttggacccaacacccagcccccacccagctgtgatgtgacagtgtctgcagcccagctgccttcagaacccggaacccatgattttctcccactcagcctgaccctccttccggggctagagcctcaaatggctgattcgtgaaggtcattcaggaggcaggacaccagggatggccgaggtttggcttcaggtttggtggcagggtctgaaaccatcctagtacctgcctgggctgaccttcctgccctgccctctccccagaggctcacctctgtggcctcatctctgggcaagcacctcaagctcctgtctccctgacagctgagtaaccaccacgcctctgggcctttgcacaaactctttccagatgccccgcccaagccctctgagaagccttccctggccttcaaccccaacacagcagaatgaagggtgagactcgaggggaggacagggactcaggacacacccacacacaagcctacgtcccattccaggtctccccagcagagaaaagggagtyggggccatgggagcctgaagcccagaaaggagaagggactggcctacaccacacagcacagcaagggtgggcatggctttcctgcggcatcaccaaacctgctgccccatccccagcaggtgcagggagttcaggatgaacatgtcagctgggctgctgcagccacccctcaccatygcagccctaagttcctttttccccgcccctgtcaaagacatatccaggcctcttccaagctaccctcacccatcatgggggacccccaaatttgggcagcccagcccctacccctgcagcatccagaagccaggccaggaggctccacctcctgaaggcagtgcagaagctgagggtggaggccagggtgccagcccgggcttccyttagagctccytgggagaaagtgggctacgtggtttygggagcgaggggtgctgaagtgccaaggaagccstcaccccctgcctctgaggcccaggagggggaagtgtccacatctggcctgccagggtatgaaggcttctctatggtcacttttaaataccagcctgtcacattcggtgtcagcagcccac

SEQ ID NO: 13365 - DNA, 67088 bp, Homo sapiens
tacataaagtaggtgttaaagcacaaactaaccagactgcctgggtttaaattctggctctgccacttattaagtgtgtgaccttgagaaggttgcttagtcaatttgtgcttcaattctctaagaagggatggtaatcctttctacctctgaagaattattgttaagtatatctctcatggagtaagtgctaaataagaattggttataattatgtgttggtctcccccatgagattgtgagcaactttaaggcgaggactttggctttttcatttctctggaatattaagtattcagtaagtgttactgaatgaataactggtgagacagctctatgatgatgggagggattacccagtttccttctttgagcagatcctacacttttttttttttttttaattgagacggagtctcgctctgtcacccaggctggagtgcagtggcacaatctcggctcactgcaagctccgcctcccaggttcacgccattctcctgcctcagcctccagagtagctgggactacaggcgcccaccaccacgcccggccaattttttttttttgtatttttagtagagacggggtttcaccatgttagccaggatggtctcaatctcctgacctcgtgatccgcctgccttggcctcccaaagtgctgggattacaagcgtgagccaccacacacccggccagatcctacacattttaaaaaaaattgtattgtttccaattttgtggctccagttttgtttaattcaaaccaaaatcctgaaaacatcacaatcatataattgaaattcaacaaaatgaaaccaattttaaaaaatcataaaatgcatgttcattctaagaaacttaactccatttttaagctttaagattcccccgatcccaaataacctaacacaccaaaagccttgccatttcacacatgctgttcctttgcttagaaccttttcaatgtctagctcactctstttgggacttcttttttcttttcttttttttgagacagggtctggctctgtcatccaggctggagtgcaatggggcaatttcggctcactgcaacctccgcccttccaggctcaagcgttcctcccacctcagtctctcgaatagctgggactacaggcatgcggcaccacgcccagctaacttttgtattgtttgtagagacagggtttcgccatgttggccaggctggtctcaaactcctgagatcaaacaatccgyctgcctaggcctcccaaggtgctgggattacaggtgagagacattgtgcctggcctctttgggaagttttttctgatcttagggtgaggcagatgcctcttctgtgctgccaaaacagcctatacatacaacaatatggtaccaataatgcatcatcccaactgtgatgctctgttaccacrcttaaggcagatattgcaattatttggctcccctgctttactgcaagctccttgacatcagggcagtatctcagtcattactgaatgtctgacatttagttgatacttgatgagtttttgaatgaataaatgtttaaacaggtaagttttattttgcttatcaattttttgtttatttcaatcatggcaacttttatatagtggttggaaattaaaattaaarttaaaatttaaagcattttcccatacattatacaactgatctcacaaccaccctgagataggtatttttattatcctcattttgcaaatgaagaaacaggttcagtggctgacttccccaaaactgcttatcttgtaagtagaagctgagactcttgattcaaagccctaagtttcagtttgtgtaaaccagacaacactcttctgaatatgactattagctgaagtgcccctttggaacattctaagcctcctagagtcacctttttcatgaatctaaaagctctcatcattctcttactgctccatcttgcaggaagaatgtccagtcccttccctaaatccccttccatctgctaactccccactgtccaccagagcatgcctcttctaatacttcagattcaaagtggggatggaactcatctctaaaaacgactgcatgcatctcatatagacaaaagaaaatctggttaattctttaatcttcaaattttattttgaaaactattttaaattcaaagacagagtagtataaaaaccacccacgtccccaacactctcaaataaccaatgttgtaattaactttctatgtactattttggggctctgtttttagatcatcatcaacttcttcacagttcattcttcttaaatacacatggctaaggagtgagaccctgccgcttcctccccagtatcagtctcttccatgccacatctgaaaacagcggtcattgacccttctttcgtccaatttcctttccatatgttcagcatgcaatctttggtgctgatcaagaggaaccccatcccatatcagcacagggatatattggcagtggtcttcatggcaagtatacccactccttcctaattataaattatgaaactctctataaaggtgagggtttgcttttgttttcatgtgtttggctgctgtaaatcaatccatcagaggctgggcaacaacattaacatgaacaaagtatgaaaaatagcccaccatgatacagtaagtatttaataaggacaaacctaaaatagcagcccagttaatcaaataattttaaatcagcccaatgcaaaacactcccctttcctctacctggcaattcttaccaacctgagtaatgtgaacagagaacatgagtccatgaatcaccayaggccatccccaggcagagtgaggcacacacagctgtgatcaaatgttgccttctctcgttttaaacaaggaattaactgtacayggtgattatctctggggagtgggagtcaaaatgactttcatttttgtattttatgtacttcaatacaggctgaatttttcaaagagcatggattttataataaaaaacatttccattttgagaaaaaatagacacgagtaacccttaatttggttcacataagaatatgagaaaaaataatttcaccattttagcatgagatactagcacagaagaaaatgtcaggagaaaacattctatagagaccaaagtgacctctcaagaagatgtttctcaaatatacctcattttttttgggaagacaacagattgcagcttattaacaaaaatctatggaaatttttctgtatttctataccaaatagtttcctctcctttgcaccaaaggcttagtgcttttcctggctagagggcaagtctgaaagcaggtacttcttttctcctgcacattagaaagggaaatgatgctacaaagaaaacgagatactcttaaaaaggtcgatgaactatatcttccccagagcctggcaaaagaggagaatgaggaagcagtacaaaaatttagaagtgttaaactgaaatcaaagcacaaggtcaagagcaagtggctgtgactgtgctcatgccctgctaaggccctggttaaatatggtttctcttttctctgacaatgatacaccagtcccttccccacaaaaaccccaaaaaagtaggccatcgtattaggagtgggaagaatagaaaggcttcaggaaagactgttcaacctgagttattcaataccatgaaaatgtggtattaatggagaaagcctgcttgctcataaaacgaatgtaagaggttaactgaagactctactgtagacgttatgtttattaacctttggaaaagcatttcacctctactatgcttcagtttcctgtttttgttgttgttgttgtttgtttttttgagacagagtctcgctcttgttgcccaggctggagtgcagtggcgccatttcggctcactgcaacctccgcctcccaggttcaagcgattctcctgcctcagcctcctgagtagctgggattacaggcgcccgccaccacgccaggctaatttttgtacttttagtagagatggggtttcgccatgttggccaggctggtctcgaactcctgacctcgggtgatccacccgcctcrgcctcccaaagtgttgggattacaggcgtgagccactgcgcccggcccagtttcctgtttctttaagaggaggaaccccctttctagctcccaaagtcatccagttattattgagactttattagatatccagcaagtgattcaaaagcaaagttttgaggttctgagcaaatgttggccagccatcattcaagcctcatctttttgtactcaattttccccgtttctccacatcatatctatctgcactgacaaaatttcatagaatctaatttctccgtttcaaagaaggctgtgattgctctgtaaattatgagacctgcatccttcaccaaatctgcttcagagacattgatcctacgttgcctcaaaaagcctcggaccactccttgggttcgagtgtcaaagggaacactatttcttgtactgatacataccgtatggaaatacactaacaccaatgaagaatctgcgtgcactgccacactgaaattcgacttaagaacgttatcacacacaaatgtcctatccccagaaaacgtcaaggattttcatcaacctcttcctgattcgcccaatttagaaaatgtcatgtcaacccttcagatcatgtacacgcgttgcttaggtagaaagggagactgggtggggtggctgagctcagaccctgcctacatactttagtagtaacgactcccgatctgcatccaacacatttaccgaacttctagtaagcgcccaccgctgcaagcgaaagcactcccttcccaagaaacagatcttttccacttaaaattcccaaactcagaccttccactttttamtgaacaaaaagcgtgtgtgccggcgagagggggtgggaaacagcgtarcaagaatttgcacggatcttacgcctcctccctcggagcgcgcccaagtctgcagcctcgggctccgggacacttcccctcccacccgccgccgagccgcagctgtaagttgagagaagcgggctctaggcacgtcaatcaaccgggttctcccgcctcccgtctacacctcccctcccccctcgaaaaaaataaaggcagagaaagaaagaaaagaaggtaactaatttgggaactagtctccgtaggggcttcgcctccgactcagggaggccgcacgcccgggacctgacgcgccggcaacaagcaggcggcctggcagccgcccgtcaccgggtcctcgcagcgcgtccgccgcgctccggctccccgcacggatcggcgcccctccggcyccgcastccgccaggcccgcggcccgtcgccctccggcctgggccaaagttgcgcaaatagccccacaactggcaaatacttaccggccgcaacaggaaccagagctgcggagattttagggagtttaaggcaaatcagccgcgggaaaggcgggcgaaggcgaaggggccgcgagctgcagtggcggcggcgcgcggcgctcggcgctcgggctgggctgcgcggagaggctctggctctgccagggactgtgctgcaacaaaggacttccgctgccgcacagccgcgcctgccgcaccgcactgagccggccccgcttacgcggcgactccgggtctgcccaccagttcgctgcggcgtccgccagccttcccctccctctcgcccgcccacccactctgccgctggctgctaggggcacccgcggtcgcctgtttgttgcaacaagtttctgcgtcgagctccgaggaggctggcgcaacccgcaccgcgggggccgtcgcggcggcggcggcttgaccacccctcttgcccctctcaagggtaggcttgggacctcctcctcctcctgtttgcacagctggatggractgggctcctcccgactccccagggcaggatgcgaggctgctttcccactccgtccagatgtcagacccctgcccgttgggcccagcagctgggccgtcactcgcggtccgcctcgagtgctccggcaacctcgccctgccccgtcggttcagggtcgcccagtccccgcgcccccccgaccccaccttccgtgggcctgctgcctctggccctgagtcacttcccccgccatgccccacctcgcccagtccgcctctccacccaggctcccgcggctcggcctccctggccccgcgccctcatcccttccccagcgaacacgcgggcgcatccttccccacccccaccttcaccccagaactgagggggtgcctgtgcttttgcacaccctggggaaagtccccgggtcacgcggttgtttgtggggagcctgtgacgctcaggcttgtccctatgcttccgcctacagagtcacaactgckaactgtggcggcrgcactcagagcgcgggccgacccccgcccggccamtraggcgggcgggcgggagggcgcgcacgtacgcacgcacgcacgcacgcacaccccggccctggcgcccctctttcccctgctaccagacacgcggtcacgtggggccatcgcgggctgccggcgcgggaagccgcgcgagaggcggccgaggggtgcgtgagycggcgccactgcttgcagtgcgcggcttgggagcccgcccctcctgcacggaggagtcggcctgccgccgcggcggcatctgggtaagcgacgcggtcctgcccctgtgggctgccccgggctcagtccctcctgccgcgagccacccagggcggcggcctgcagctgcaccagtcgcgggacagatgcaagtagctggggagaggggtgtttttggtccgattgagatgtcaggcagggcacaggaggaaaatacatccgcgagtgagcgctgggccgacaatacccagaaccaccctttgctgctcgtaggagcggctgccggggcctgattcagggtggcacacggggtgccgcgaaggtgcagagccgtcccggccgcgggtccgggtgcgacccccagcaggaaaccccagtaggcctgcggcctccctcgggtagcgccgacccctcttacgagcgggcgactttccagatgctgggaggacgctgcggctactgtttccactcccagcttgtgattacctcgtttctagggcaagaagacatcccccccttttctatcttcaaattatgtttatcttgttctaagcatatccggtttttctttttgaagcttgacccatcttatcaccgtcttctctggcactcagtatttggagtaatcagttgttaccagttgcggaggcagcgcatagcacaacgtagtacctggaacctgacggcacctagcatgtttcaacagttagcgcccgcatcaccccaagggattaaatttggcattctttctcttgagactcaagtcctggcagagctgttgatcctctcacaagattctgtcatgtatgtaaagtacactttggaatcttaaattttagagccgagaggtgccttatagaaaatctgtttcatccctctcgttttacagagaagacaccaggcctgaagagcgtgatgtagctggagctagctacacctcttgatagctaagactccaaggctccagacaccttggtgattgcactctccaccatgccaggaccgcagtgccagtttaccccactcacctgtagagaatgtatccggcggaggtcattatatatacttggcttgattcagkttatggagaagtcaggcatggccactgtgtgggtttgatggtatttctaggtgaggtaggccgcctatggtgtatttttggaactaaaagcctacaccccccagccacccctgaaartttcattgctgttctctattatttgcagcattggttgcttccttatgttaaggcatcaaagtcttctttaacaatctggatatattttagttaagggtaaatcgtgaatccgttatcggacatcaactccttaatagggaacagaacactgatgggatatgacatggaacagattaattctgagagctggcagtcagtgaaatatcaaggtgtggtcaggaagaaaacagaaaggaacccacgtaacctgctaacaccttttttgtccagtcctaccttgaatgtcttatttgcatgtagtagagatggattctgctcaagttggccgctgtttactgagtacttgcagtgggccaagtatcatactagctgctttcgtagatgaactttgtgtctttaccaaaaaggagatggtactgtcttcatgttacaagcctgaggaaacaggctcattacctgggctgtggtaatacagtcattcgcagtagaatttaagcctagatcgcttatctctcaagtccaatcagtgctgttttgcattatatcttgctcctgtttcagccgggaagggaatgagagaatcgcctgtggctgatttattggcgcctgtggttgcccagagaggccaagcaggactttcagctgccctctrtgccttacaaagtggagctgtgagcttccaccctatctcctgaggggaatgtgaaggagccaggctgtctagctggggaggaggtgccttggccgtaaaatatcctggccagggctgtgctgggaagtgttgcataatgtcctccccaccactgaaccaaagtgatttatttgctatggtccgtaggtggtgcctgaccaacttgtccattttagcaataacagggccagaaaagagttgggggttttatattattgcagggtttttccttgttttaaaaaagcagtgcaggtgctcttatcttgataagttataaagtgcttctttctgcaccacttcctgtgccccttttctgtgtatttattccaaatagcatgtgaacttcagtcttttaagaagagaaagctaagaaaatattgctccagtttattagcacaggctatggagacagacctggctttttatctccactttataccatttgctgattgtgtgtcctaagcttaggatttttcctcatttgtaaaatggaaatgaaaataatacattagtcatcacagtgacgattttaagagatagtgtatatagagcacttagcacaaggcctcgcatatagtatttattataataataggttttgaaaataaccagaatagtattctccctaaaaaggaaagatattgctacttgaacctgcttagggatagaggaggaagaagaaagtgtttgtaacaaacatcagtttcaggattattgattaaatttttttatacttctggggttttttttgtttgtttgttttttgagacagagtctacctctgtcacccaggctggagtgcagtggtgtaatttcagctcactgcagcctccgcctcctgcattcaagcgattctctggcttcagcctcccgagtagctgggattacaggcgcctgccaccacacctggctaatttttgtatttttagtagagacagggtttcgccatgttggccaggcgggtcttgaactcctgacctcaagtgatccgcccaccttggcctcccaaagtgctgggattataggtgtgagccactgygcctggtccatgttttctttatccatttgactatccatggacatttgagtttttcccccttattggcaattcttctgcctcagcctcccaagtagctgggattacagacgtctgccaccacgcccaactaatttttgtatttttagtagagacrgtttcaccatattggccaggctggtcttgaactctgacctcaggtgatccaccctcctcggcctcctaaagtgctgggattataggcatttatttaccgttctgctttccctttgctagcaggaattttctttctctctctctctcycytttttttttttttttttttkkygctttattgggagaaaaagtgcttagagtgttcagttattttttatatttttctaattcatttcttctctggttacaaatcagtcatgcatggatgttttattttttctgaaatctccaagcactttaagcaaaggtttttattagcccacttgagtagtgtgttcatgggagtatacttccattgcgaaagaagtattggtttacttgtatccagaagttttagttactcttgcctgtactgtattctaggtctgtactagcattataattttccatctttctcctgtcctttgagtaccttattttttcttttagaaatttggtttgtctttaatggactgagaggaatcttttcctttctttctccgggttctgattttttttaaaggtctattaacaatttgtgcttactgttgttagtattcttgtgtgcttggctttatcaggcatcctacaatgtaatgttrgttagatgggaattagaggtgcttggaggttggctatgtctgccaacaggcaggaggccccaaactaacgtttcccagttccattaaaggtttctagagcataactactcttcctgtttcatctaccccctccataccctctttgctaacattctcagtagatcttaataagcagatgtctggaattacagcagattttacctcaaacagtattttcagatttagaatttctgtatcatttttaggtgttatgaaatccaatctaggtgtaatggagtaagagagtaaatatttctttttcctaaatactatttgaaaagaagtctgaaaatagtgtgttcctccacccccccacccatgcccatcctgccagtttaggagcacttttgattctttyttttctttttytttttttttttgagatggagtttcactcttgttgcccagactggagtgcaatgacacaatctcagctcaccacaacctctgcctcctgggttcaagcgattctcccgcctcagcctcccgagtagccgggattataggtatgtgccaccacacctggctaattttgtatttttagtagagacggggtttcttcatgttggtcaggctggtctcgaactcccgacctcaggtaatccacctgcctcggcctcccaaagtgctgggagcgagccaccatgcctggccatggagcacttttgtttcttaatctggccaatattttaaggttacaattagaattacagttgtttatatttgttcatttaatgtagtcaacataatttccatactttgaacactcttacggaattgtttatttatagagactagtataaagttgttctatcttacttartttgaactaatccagagttatacaatctagaaagtaaagaaagtttttattgtctcttaaatatcaatgtaattgtagagtgtgaaataatttcttgggtttccttggtcccgtgttcttctgaggcagtggttcttaactgagcagtcacgttagaatcacctgggaagctttttaaaaaaagaatctgggctgggcgcggtggctcacgcctgtaatcacagcactttgggaggccgaggcgggtggatcatgaggtcaggaaatcgagaccatcctggctaacacagtgaaaccccgtctckactaaaaatacaaaaaaattagctgggtgtggtggtgggcgcctgtagtcccagctactcgggaggctgaggcaggagaatggcgcgaacccgggaggcggagcttgcagtgagccgagatcgtgccactgcactccagcctgggcaacagagtgagactctgtctcaaaaaaataaaaataaaaataaataaayaaataaacaatctggccgggaacagtggcctacgcctgtaatcccagcactttgggaggccaaggcaggcggatcgcctgaggtcaggagttcaagaccagcctggccaacgtggcgaaaccccatctctactaaaaatataaaaattagccaggcgtgatgggcacctgtaatcccagctactcaggaggctgagtccgggagaagcacttgaacccaggaggcggaggttgcattgagccgagatcgcgccattgcactccagcctgcagcctgggcgwcagagcgagactctgtctcaaaaaaaaaaaaaaaagaatctgtgcctcacccctagcaattcaattctgtttgggctaagcctgggttgggactcagacatcaatacagctctgcatagaaggttttacagtatagtcagcaataagaacctctgtttcaggataaaatgatttctacaaacattstttcattctctacataattaaatgtcacacctctacagtcatgtgaaagttccattaaaaagttagtcgctatataaagtcttttatcatatggcacttgaaatattttgcttttgcctttgtatttatagccatgagtaagtagctcaaaaaagatgtacatattcctctgccaactttcctgtctccttgtctgaatgaaaattcatcataaagtctcagtggtaagcattgacagagaaaatacctaagactgttttcctacagaaacagtcgtcttgctctttttgttccttttttattaaggattcttacagcctgagagaatgaagagctgtgtagtccaggatatccggctggctaccatagatctgagagtccagtctagtacagtagatttttctaaatacataagaatcaaagatatgtattgaatatcaagccagctttaaacaaacatagatactagtataaagttgttccatcttaatttgaagtaatccagagttactacaatctagaaggtaaagaaggtttttgtaatctcttaaatatcaatgctaaaactattatgataatgtatcactttgataacagataaaacttttaaaaatgtagcactcatattttgattctggtatttataagtataataaaatactttatttttccataatttctctcacatcttaaaattctcaccagaaattctcaaatgtaacttctaagctctttctgtattcatgggaaactttagctatttcacatactagagaaaataaaatagacagtcaaagaatgatgagcaaaggctatacaaaaagtctagctaataatttgcagagtaggttgtattagaaaatgttctaataactcaatggaatggggctattgatttgaagtaaaatctggtatattacaacatcaaagatctcctattatgcaaaacaagtttgaatgcacctcatgtgtacttggtgttttttttttaatagattttaatttgtttcattttatacacttgaaaagtttactcccttatttgattcaacatatttgcaaaatctgccaacagtgtaaatgttgaaagttctagatggggttttgaagaaagggccctgggtttaaactcagtcttgatgtattatcagcaccatttaatagctagttgtttgacttcaggtatgtttcctgccttctctgagcctgtggtttctcagccataaaatagagctgatagtacctgctctactacctcacaagatttaaaagaaaaaaagatagtgtagggcagtggttctcaaagtgtagtccaaggagccactggaggtttcatgggtcaataaggatctcccttatgtaagaacagattctcaatatacttgaaccaaaacaagagatgacaacagattgaatgcagaatcagataagagagtccagctgtatctgttaaagccagatattaaagaggattgcaaaatgtaaattaatatcacccttctcacttgtttttgaaaaattttttaggaaaaaatatgttaatatgtaatgggtttattgctattttaaatattttaaaatttcttttaattttgaatatagtaaatattgataaatataacctatataaacaacagctcttcacaatctctaatactttttttttgagatggagtctcgctctgtagcccaggctggaatgcagtggtgtgatctcggctcactgcaacctcttcctcccaggtcccrgttcaaacagttctcctgcctcagcctcccgagtagctgggattacaggcacacgccactgtgcccagcttttttttttgtatttttagtagagacggggtttcaccatgttggccaggctggtcttgaactcctgaccttgtgatccgcctgccttggcctcccaaagtgctgggattacaggcgtgagccaccgtgactggtctgtaatactttttagagtgtgagtggatcttgagaccacagctttttagaactgctgataaacagtaatggttgagtagggctgctctgcctatggagtagccattcttttatttattttctaataaattgctttcgtttaaaaagaacacaatgttgggggagggggtaatggttgaatagttcctatcaggacagtttcctgcagataactataaacttgatacactttttttttttttccttttgagatggagtttcgctcttgttgcccaggttggagtgcagtagcgtgatctcagcttaccgcaacctctgcctcccaggttcaagcagttcacctgcctcagcctccagagtagctgggattacaggcatgtgccaccacacccgctaattttgtatttttagtagagatggggtttctccatgttggccaggctggtctcgaactcccgacctcaggtgatctgcccgcctctgcctcccaaagttctgggattacaggcatgagccactacgcccagctgataaaagttttaaaaattaatagatggcatttgagaattacaaaaactagattgaggtctgcaactggaagaggagaacagcaatgaataagcttctgtttttatggcttttagactggcataaggtcccagctggtgatatgaagaggtggctacaactgtaataacaacctgtaatctctcttgaagaaaagaggacagagctcacagtgatcatgcagctggaaagtgcaggagaaaatcctagaaagaatgttggagtggcagaaccccaaacactgtttataaactctgcttgaatttcttgcaaacccctcaactgtacatgtgtggagcagcctccaaacagcacacttaaggctaaaggagcagagatttcagctgctgtccaccataggggaggcagaacttggagtttaagtccagctaaggtaattgtctgcaaaaaacaaaaacacaaacactctttggaagaatattacagaatctagagtgaattgtattaatcacaatacctagactataatccagaaacaatcaccctaatcagtggagactgaccccataattagccaaaggttggatttagcagagaagatttaaagcagcagctattataactatgctcaaggatgtaaagcaaaatgttgtatatgtgaacaaataggaaatctcagcagagaattagaaactttaaaaaagaatgaaatgaaaattttacatctgaaaatacaatatctgaaacaatcttgaatagatttaacagatcagatatgacagataagtcatttaatttgaggatagattaatagaaattatctaatctgaagtagagaaataagttattgtatatgaaagttctctgtaaacttcagtgctctatgtaagtttcagagtttattactccaggttkctttcatatgtaaagggaagaggtatgtttgggtcttctgatctgcagcttccttaatgtcctgtcctgtcatgtctgtgtctaagctttataccctctggtttctttatttttatttttttatttttttttgagacagagtctcgctctgttgcccaggctggagtgcagtggatctcagctcactgcaacctctgcctcctgggttcaagtgattcttctgcctcaacctcccaagtagctgggattacaggcatgtgctaccacacctggctaatttttgtattttgagtagagacggggtctcaccatgttgttcaggttggtctcaaactcctggcctcaagtggtccactcaccttgtcctcccaaagggctgggattacaggcgtgggccactgcgcttggcctagcctctggtttctaatatcccctgcagtcagatatttggcccttgctgctttcctgtactattgtcagaggttaccaggaatcttttggtcagtacactcgacatgtttgtaatgggcctcacccccatgtttctcttcagtgttttgcaccattgccatctcctttctgcaaggtcattgcctttcctcaatgacgatgttttcttttttctcctcctctgtcttattttgtcttttctgttttccaaagattcattcttagcttttttccctcttatttcattctactttttagtctrctttattattttcatacttggttacttcagccttgtcgtttcagaggcctcttctccctctctggctctgctctctctagagccctgtcctgcttcttgtccccgctgatcactaaacatttctacttagataccyggtagacacttggagctcagagtgtctgaagtgaaacccctattcttcttcttcttttttttttttttgaggkggggtctcagaacctcttatcaagacggtttctgtacttcttctctaatgttctgggactctgcctttatatcaacacctagcacatggcagttactctgaaaatgtaatctgaaggaatggatgaattcttccaattacccaagctggaattctgagactcacctttgatttgatctctgtggtgacaagtcatgtcagttttgtgtctgatgtatctcttgtattccttccttcattcccactgcgattactttgataccatagtaggctcctagccagtctttctccatgccttttcccttgctaatattttttatatgttgctgttagagcagtctttactcacgcctaatgatggtgatgatgataatgcctagtatttattaggcactaactgtgggcccactgtttctaagtgcattatatcattaaattcaaataacctataagttagatactgtcattgtccatattttataagtgaaatggaggcccagagagttaagtgtcttgccaagaccacgcagctagtaaatggcagagctaaaattttaagctgtctgattttagttcaagctttaactaccacgctctgttctccctcccacagagtaagttaactgatcatgctgttcttactcaaacatcttacatagttcacttcaaacacgacactactttttagtcttatattctgtatsctttttgarctgaccacatttcattatttctgttactttttttttctatgccaagctgaatccttctgttatctaactattcatattcttcccagtaattttattcattttattttttctgcctggccttgtttcccatcaagttgcctgtgtttatctccctctgatagcatgttctctaactgctctgtgctactgaatgcatttatttcatattataattatggtttgatgttttatctttcctgtgagcctgtaatcttgagtgtagcatcttgtcatttttttctgtctccacgccttgtacaatgcaggcttttacacattttttctttattaaattgctcttcaaaaatatctgttgaataagtgaagaatttaactgttaccaacagaccattaaccataagattcctgtatgggtggcttattagtgtgctatgtctcatttccctatggttcagtagttcaatataatgggaagaactggtgaaaatgtttatgatccgagggtttggttttgttttttttttttgagacaayttatcaggctagtttaagatgcttcaatatgaaccatttcattgattctaagacacgtttttcacatgctgaaattgtcaatacagatttttagtttgttaggccgggcacggtggctcatgcctttaggaggctgaggtgggcagatcacctgaggtcaggagtttgagaccagcctggccaacatggtgaactcccgtctctactaaaaatacaaaaattagctgggcatggtggcgggcacctgtaatgccagctacttgggaggctgaggcaggagaatcgcttaaacccaggaggyggaggttgcagtaagccgagatggagccgttgcactccagcctggtcaacaagagcaaaactccgtctcaaataataataataataataataatwtaacttggggattattccacatcagtacattaaatatgtagttttaatagagtctgccttttttttttttttttttttttgagatagggtcttgctctgtcacccagggtgaagtgcagtggcatgatcatggcttactgtagcctcaatcttcctggctaaagctatcctcctgtcacatccacccaagtagctgggactaaagcatgcaccaccgtgcctggctaatttttgacacataggaagcactataaaatgttagctatatttattatattactgatcacttagctgtctgctgcccaagccactgccaatctttagacggctaaccctgcattacatcactgacctccttagaccttggtctggctggctggtgtggaaacctcattctctttttcagtgtctgctctttcaaaggatgttctcctggccacccaatgatgccctttatactacagctaccttctgcctaaagtaccagggctctctccacagtagggtagagaagatgatgtacagtctgccacctgcctgaaaccagggcacttctgaatgtttttgctgcttatactcggcttcttggccagaattctgcatgttcttcctcatataggcttccccgcagttgttccaccttgccttttacttcctttgggaacctacattataatatgcgtctgaatccagttgagatcagttctttcttttgtgtgtgtgtgtgtgtttttgagacagagtctcactgttgcccaggctggagtgcagtggtgtgatcacagctcactgcagccttgacctcccagkcttaagtgatcctcctgcctcagcccctcaagtagttgggagtacaggtgcatgccaccatacctagctaattgttttattttttgtggagatgacgtttcactatattgctcaggttggtctccaatacctgggctcaagcaaccctcctgcctcatcctcccaaggtgctgggattacaggcatgagccactgcgccagcttaagttctttctcaggaggctcttgggccacaagtaaattggggatgtggcttgacatctattttaagagttcctgagctactgtgatgataagtcccccaaacatttgatgagagttgggaagccagtatcccctgagcaccagwggatccctgaggaggagtgacatctctagctcagccaggataccgtgttatgttattaacatttatagctaacatcgaatagcagtttccattacaacatgattttcacataagttatttaactctgaggcaggaatcagtatctcattttcatttttctaatgaggaaacaagattagaaacattgtgttcacatagatggaaaaggacaggtctgtcttcatgtgtcactcataccaagctatcttcttaccagatgaaaaagggtcatattttatggttcagcagagtttatatcagttgtcataatggaggaatttagtgttagccgtgtttgcagtgaaagtaataggattgaaaacttgaataatttcatttaaatttagatctccttgttactctgtaggtttgtgtgaactgtagacaattttgtattaataaaaaataatgcgtatatacatacwcacctatctacatttatcttgtcctttttttcagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggtaaggatgtgtttttgtaaataagaatttttaatattgtgatttatataagctttattatagtatcattttggaaattctttgttacggagtcacactaagaagtaaaattataattttttttttttttttttttttttttttttttttggcgacagagtcttgctctgtcacccaggctggagtgcaatggttcagtgtcggctcactgmaacctctgcctyccaggtacaagcgattctcctgcctcagcctcccgagtacctgggattacaggcgcctgccaccacgcccggttaatttttgtatttttagtagaggcagggtttcaccatgttggccaggctgatctcaaactcctgacctcaggtgatccgcctgcctcagcctcccaaagtgctgggattacaggcatgagccaccatgcctggccaaattataataattttttatacattagtaattaaactcagtgtgtaggatccataatggaaaataagaatgaaaataagaatagctaaaatkggctgggcgccatggctcacgcctgtaatcccagcactttgggaggccaaggtgggcggatcacaaggtcaggagttcgagaccagcctggccaatatggtgaaaccccgtctctactaaaaatacaaaaattagccaggcatggtggtgggcgcctgtagtcccagctactcgggaggctgagggaggagaattgcgtgtacctatgaggtgaaggttgcagtgagccgagatcgcgccactgcattccagcctgggtgacagagcgagactctgtctcaaaaaaaaaaaaagaaaaaggaaagaatagctaaaatttattgaaggcttatcccatacccaagcactaagtatttgccctataatgtaaattctactgctgtccctatttcaggaaaaagaaaactgagactgagttaagtaacatgcccatgcaggattatacagctaataagttagatgcagatttgtctgaagctatgtctatgcttttagtcactaagctgttaatttttgtttcatataacacttttgttttttttattttttatttttattttttttgagacggagtctagctctgtcacccaggctggagtgcagtggtgcccaggctgaagtgcagtggcatgatctcagctcactgcaacctccgcctcccaggttcaagcaattctcttgcttcagtctccytagtagctaggaccacaggtgtgcgccaccacacccggctaattttttgtaattttagtagagacagggtttcaccatgttggytaggctcctcttgaactcctgacctcagatgatccacctgcctcggcctcccaaagtgctggaattacaggcgtgagccaccgcaccctgctgatttcaataggttctttcagaagttttaagatatctttattgtggctataaacatataaaatttgccattttaaccatttttaattatacaatgcagtggtgataatcacattcgcaatgttgtacaaccattaccactgtctatttccaaaacttttttatcaccccaaacagaaactttgtacccattaagcaataactccccatctcaccctctcaacccccagaaaccgctaatttactttctatctctatgaatttgcctattctagatattttatataatacttgtccttttgtgtctggcttattttacttagcatgatattttctgggttctccatgttgtagcatgtatcagaacttccttctttttatggttgaataatattccattgtgtgtgtaagccatcttgtgtttatccactcatcttttggtgaacactcagcttctttctaccttttggctactgtaagtaatgttgcagtgaacattggcatacaggtatctgtttgagtccctgtttttagttcttttgatcgtttacttgatagactgttaaattccttaagagcaggtacctattttattcatcagttttctaccgctggcatctagtatagtgcatatcacttaggagtcacttgattaatgttgaactattcagaatgtatgtctgtgtttcctaactttaggcagtagattgaatacatgaagactttttgctaggccataaagttggtataaaatgaaagtttaagcctttgttgccatgttttattaaggcagattgctaggttcgaacttcttaggaagaaattgctttagtctcagactatactgttaactgaaaggccagctaggttgtgtttcatttcttgtgggtctgtttttgtttttaacagtgaatgcataaaaatacaaccaactgacatccaacctgacatattcagctatttgttgcacattatgtacacggggaaagggccaaaacagaytgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccwcccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagargtgacaggccccacttttactgaaaacagtgtcaaaatacacttatgccattactgtggggaacgttttgattcccgtagtaacctaagrcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacascaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcrtggcatttttwattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgttttaaagcatattctaaactatcacttctgcytacatttcacatgaattcactcctaccaggattatttttaaatattttcttccatataggaaattaatagttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctytataaatcaacttaactctcttttataatggtgacacttacaaagctaaaaccccaggaaaattaaagttgatgaaakaaataacagattccccggctctatatacctgggaaatagctggttaagcttcaccacaaaggatagatctaaattgtttctraaatgtttaaatttcaaaccccgcatagtcaaggataataraacagactcatctttttttgccctcttgttaaattmtaagcttcacrggcatttgaatacatctaaaaaatttggtttgtgagccttagaatttaaccacttacaaaactcttgagctccctccacttstgaggacgtttcctgacacattcaacagcatcagcgtccaatcagsagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactgatgtgtgttgagagcacatctaacttgataagatcaattgtattgggagtaattaaaacaaatgtatgttctttggggtcagaactttgtctaatcttaaacttttttctaccaattcacttaagcaactattgaaatttgtactgccctcaaaaatatcatctcattggaagaacacaagtattaacattgattttttgtattttaggctagttaagatatatttcctagccttcttcaattcaaattctattgttcttattaagataatttttctcctctatattcttccctgtttgcctactcattattattatttttttaatttaatttttttttaagatggagtttcacccttgttgcccaggctggagtgcaatggcgtgatctcggctcactgcaatctctgctgcctgggttcaagcgattctcctgccttagcctcccaagtagcttgggattacaggcatgcaccaccatacccagctaattttgtgtttttagcagagacagggtttcacyatcttggtcaggctggtctggaactcctgacctcaggtcatgcaccagcctcggcctcccatagtgctgggattacaggtgtgagccaccgtgccaggcccactcattattctttgacacaggaaatccttgtatatagctaaagggtggaggtagagttgtacatggttggttggataagacagcaagtrcctcagggcagagtttggataaatggtaagagtttgctagcagctgattggccrtgatagacaacactsatttaaagcagaaatatatctgttcgttgagagttaagaaaatagtggttaactgtatttctattcttatagttccttttaatattagaaattcaaagcaaatgctctttccttgttccttaaaacattcattctgtttaggaagtgggaaaatatcaacttcattttatagaaaaaaaatcccaaaagctgaattccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccrcctctcgaattcaagtgattctcctgcctcagcctcctgagcatgtgccaccatgcccagctaatttttgtatttttagtagagacagggtttcaccatgttggccaggatggtctcgagctcctgacctcatgatctgcctgcctcagattacaggcatgagccaccgcgcccgggtctgcaggcattttttaaagtaactgtcatatgcctaacactgtgccctgagtattattttttaaagacatgattgctcactgagaaaatttgctttgtattttaaaagttcttccagctaggccaggcgtggtggctcatgcttgtaatcccagcactttgggaggccgaggcgggcgggtcacgaggtcagaagatccagaccatcctggctaacacagtgaaaccgcgtctctactaaaaatacaaaaaattagccgggtgtggtggcacacacctgtaatcccagctactsgagaggctgaggcagtggaatagcttgaacccgggaggcrgaggttgcagtgagcggagatcgcaccactgcactccagcctgggtgacagagcgagactccatctcaaaaaaaaaaaagttcttccagctaaaacctttattttttgactacatctccacaaaatggagctatactgttagccagtatcctaatagtatagtgcagtttgcataatgattaccaagcttgaaactggaaatgtcatatgcactttcgtgtgtatcaggcagatactaaacattttccccttgagtcagcttaaaatttttccttcttttgaaatctcacgcagttgttttctggagaaaaatagagactgttttagtatttgttcttattagcgtatcatcagaactcagcacagtctgccttataagaaaacaaaaaatttttttatttataactcttgagattgttacttcttgctctttctgatttcccatccgtaaagtgggtgtaagcaatacttacctcacaggggtgttgtgaggatttatattaaacgtgttaagttctctcagtattattgattaaaatcaaccatataaacgacatttattctgtagctagacctattaactttagtatttcagcctataaattctaaaatgttcttaaaagcagtaatgtactatctaatattcaataactaattgacagaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttaytgaaagttctcccaaatatattgtttttgtttacacaaaggaaaaggaacaaaaacaataaakaaatacctttgtttttttttcttttttgagacggagtctcgctctgttgcccaggctggagtgcagtggtgcratctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgacctygtgatctgcctayctcagcctcccaaagtgctgggattacaggtatgggccactgggcccagcctatttttatttctttgatgtaggtgatctaaatagtagatgaggacaggaaatggggtgaaggtaataatagtattattagaaaagtcttcactgaaaattgaaggaaatacatattaatcgtggaaaaagatagtgtgaaaaatgtgtaatttcgttaacatttatttgtacaggcacattcttgatgttgtgagtcagatacttgataaatgtccattttttgtagtaattgatgtaaaaatgggccatgtgaagaattttcataatgtaatttgtgtctttgtatattttgaactacatatagatttgtggcacttaaattattaatttttgatttcttaagagtgaagtctgtaaatgatttctctctgctgtacttctgtgtttgtatggttggwcattttgaaaactggtgagattgcacagtcccaaacctggatgtcttaaatacaaggaattacaaactgtgatttttgtcttgaagacctggaagaattcattgtgcttcagtatgtatttgtactgcacttgattaattagttaagtattggtctggtgcaattgacattaactgtcatcaactcctctattttgtgctaaataaagtcatttagtcagaatggatcaaatataaacttatactttaaaataaacttagattataaaaacttgttcaataaaaaagacccactgaaaaatcttcaaagtacatgtaacacatagctaatacaggagaccaaaatcaataatacattgtgtggctaaactcatccacctaatgtactgtgaatttgcttcagaaacattcttttagaaagttgtgtatctgccgggcatggtgcctcatgcctgtaatcccagcactttgggaggccaaggcccaggagtccgagaccagcctgggcaatatagtgagacctcatctctgccaaaaattttggcyaggggcagtggctcacgcctgtaatcccagcactttgggaggtcgaggtgggcggatcaccagaggtcaggagttcaagatcagcctggctaacatggcgaaaccctgtctctactaaaaatacaaaaataagccaggtgtggtggtgcgcgtctgtagtcccagctacttgggaggctgagacagaatcatttgaacccgggagatggaggttgcagtgagccgagattgcgccattgcactccagcctgggcgacagagtgagactccgtctcaaaaaaaaaaaggcagggtgtggtggctcacacctgtaatcccagcacyttgggaggccaaggcgggcggattatgaagttaggagatcgagaccatcctggacaacatggtgaaaccctgtctctagtaaaacacaaaaaattagctgggtgtggtggcacgtgcctgcagtcccagctactaggggggcagaggcagaggaattgcttgaacccgggaggcggaggttgcagtgagccgagattgcgccactgcactccagcctggcgacagagcaagaaacaatgaatttcatatattttatcaagacaaattaatgtgacttaatcaaaaacaagtttattagcttagcttatagaatgtgttcttattttacatcagtgtttgccaaatgttgtgttcctagtgttgaggcaagtagtctttgtactgggtaacattttggaggtgtgatgcaaaaatgcatttgtggacctaattcttaccraccataatctgtgttaatcgaaaattgacgtcctaatcaaatgctttccaactgctgtctctggaaagaaaggtagtatttcgtcatttcccagaagtttcttgctttgcttcttcttttttttttttttttttttttttgagatggagtcttgctctgttgcccaggctggagtacagtggagtgatctcggctcactgcaaccttcacatcccaggttcaagctattctcctgcctcagcctcccgagtagctgagattacaggttcccaccactacactcggctaattttttgtatttctagtagagacggagtttcaccatgttggccaggctggtctcgaactcctgaccttgtgattcacctgcctcagcctcccaaagtgctgggattacaggcgtgagccaccgcgcccagctgcttctttcttctctatttacagtctactgtatcgccttttgcccccagtaacatgatccacaatagtagttctcaactgaggtatattagtcaggattctccagaaaaagaaagaaacaacaggtagaactgagagagagaaagagattgattgattataaggaataggttcatgtaattatggaggctgagaagtcccaagatctgcagttgggaggctgagaggctggggagtcagtgatgttccaatctgaatttgaagacctgagaaccaggagagcttatggcataagttccagtccaaaagctggcaggcttgaaactcaagaagagctgatgtttccatttgggtccaaagggaagaaaagaccgataattgcagctcaagcagtcaggccagagaaagtctctttttttattatattctggccttcaactgatggaatgagagccacccacatcagggagggtgatcttctttacgcagtctactgattcagattttgtctccctccagaacaccctcacggacacacccagaataatgtttgactaactattggggcascccatggcccagtcatttggacacataaaattaaacattacacagggctatccccccccatagagacatttgacgatgtggagatgtttttggttgtcacagttgggtgggcgatgagggaggctgctgctggcatctagtaggtggaggccagggatgctgctaaacatctcagtgcagaggacagcctcccgcaatacagaatatgtacctcaaaatgtcattagagctgaggttgaccaacccttctgagaccttaaagtaagttttgtgatggctgtcaggaataaaagaatacaaagaaacccaatttgggggatttctattctagtcatgtttagagcaagtattggagtatgagatgtgttcagaattaaawtctatttgtattatccttgatcccagcttttaaaagataaaaatgtgattattagaaataaaaggaaaaaatgtgattattaaaaatcagagatgtattaatcagcaagacagttttgaatctattcatataatgtttgaactaaataattgtctccccaaagaggtctcttcatgaaattgagattgtaggttataatttctgtgaatttttaatctggccaaaaggtggcaccagtgtacctttaaaaaaatgttcattatacttgaattcagcattactattaatagtaaatattatttagggcttagctacttttggatcatgctttatagagtcaagactaatgagaattttcttaaaatttcataaggtactgcaatatcttgacatccctctttaatcaagatgcttctgatttacatgtacatatctcagcagataactttttaaaatatcacattattgtgctacattgagcatttctgaagatttttccaagccattaactgtgaggccttggaatttgggctcttttaatcaggcatcacactcagtttttggtgttctgcctggtcaagacatagattgaaggacatttgagtaaatacgctcccttgctcctttcttgccttttgttcattttttgtacatccacaatctatgaggtatgttacctactgaaatttactttcttttccaactgtggttcaacaactgayyttcttctctcatactttccaacccattccattctgaataagttaagagttttcttaccttcagctcttctcaccttccaatactaagtgaatacagcctgcctcccccttcatttctgattacaatattattctcatcatcctaggactttgtacctaatcaccagttgcttctcctaagtttattttacagctgataagccaacttggaaaatgagcccactctccctcagatacattctcttccgctgtttgaaacgtttttcattgaaacaatttggtgatattgtatcaaaataataaagtattaagctactggaacaccatggtgtcctttcatgtcaaacgtctgaaggaatgacagtcctccaagagagattctctgtacaaatggtgtgttcccactgtcctggaaacaggagaggcttgtgccagggggctggagaagatggctctcacccactgtggtcgtcatcccttgtctggtctgtgttattaacaagtttcaggaggttccgtgtcagatttatgtgcatccagcaggcctttgaggaatgggatcttgtgtatttagcactgccacattttttctatagtggaagccatgtgaaacttagtccaaaccatatgcaggtaattaaaaaaaaatttttttttgaactggcatttatggtaactaccatatagggaggaaaacctgaagaacctggagtggttctgtagaaagtgaagtcacacctgttactttttgaaggtgaaaacatatttgcaaaggcaagggaagaggttttaaaatgcagatcaaagattcgagggsagtgaatctcaacagtattcctagctaaccacttctcatttcccaacattgctcttttttcacatgtgtgctgtctggtggtgtgagctcagtggtttctgtcccctctatcacaatattttaacgtctatgaggaaagacatataaagggaagagtcctttttttaaaatcttaaatatctcctatttcactattaacataccagttttgctgctctctcaaactggtggctatgctcagagccaccatgatggccatgcagacaatgcacaacacagtgctagggggtgcctcgattgaatgaaggcttctcccagagttgtgctgtgccaatggcacagctgtgcgtgacagccttgcctttccttatcctggtttaaacactgggtttaagaagcccttattttgaatttctgcagcaagtagcagttttcactgattagtcaggattaaactaagatagacaagtggtatagaaatcagaataagatttaaaattaccccgaggtgacacaactaatggcttggtcaaaattggtagaacttgtattaaaagggtggattttgctgtatgtaaattataccttaatgagaaaaagattcataccactcagaaaaatataagtcttagagtttgatgaaccctagtgattatcattattcactgttaatccttcaggaaaaacacaacagccagatactgagggttttttaaagaattctaaacaaattcaccctgaaatcaggacaattactgataaggctatttagggaacatttggataaaagatcaaaaactgagtttgacttttttttttacctgaattgagtcgtgaccaattgttttggcattttctgcatctcagccatatagagtacgaggcagttctaacttagtcattctgtcaggaggatagaaatactctagttttgagctgggcgtggtggcttacgcctgtaatcccagcactttgggaggctgaggcaggtgaatcacaaggtcaggtgtttgacaccagtctggccaacatggtgaaaccccgtctttcctaaaaagagaaaaaaattagccgggcatagtggygggcgcctgtaatctcagcggcaggctgaggcaagagaatagcttgaacctgggatgtggaggttgcagtgagccgagatcactccactgcactccggcctaggcaacagaacgagacttcgtctcaaaaacaaaaacagaaatactctagttttggaagacctgtttaaacagaagtgatattctaaagttcttatgttgcaaatggccattccatatggaacctttgcgttgtaatttatatatatttgattagcagcacatgcatgcctgaagctgcattgtgatggtgattttatcacagatgtggtacagaaacccacttgtagtcatactgagcagacctgtgacctgtcagagtagggatttgggaataaaaggttcgggtacaagtgtagaaatgactgcatctgctttggtgtcaccttttgtttcctatctcccaggagtgcagaaatggaaggcctgggtcctaagaccacaagtatagctgtgaaaagtgtataatccttctcccatagtagcactgtcatatcaaggccaaaagttctttttgagtttcaccacaaagcaagtggtggggaaagtgcatctagttttgctaaagtcctgaaactgctggacactgctcccattgttatgataggctggagtttacggagacagttttaaggctgggagtttcccagacgcggcgccacaccatcctctcctcacctaggtttcccttcactgctcattgtgcccacacccagttttgcagaggattttctgtgaatgtgtagtgcacagacacgcatactctctttcctaagctcgggaacttaacccccagtaagcttaagctttcaggaaggaagaaagaaagaaaagtaggtattcacaaaagggttggggactccagacgtcagcattaaaggtaggtctaaaaagggattagcagaattgcctgtgaggacaacttttgtgaagtgtagtgtatctttttttttttttttaaaccaagaagagatttaataaaacttttttttgagacagagtctcgctttgtcgcccaggctggagtgcaatggcatgatgtcggctcactgcaagctctgcctcccgggttcacgccattctcctgcctcagcctccccagtagctgggactacaggcacccgccaccacgcctggctaattttttgtatttttagtagagacggggtttcaccatgttagccaggatggtttccatctcctgaccttgtgatccgcccgcctcggcctcccaacgtgctgggattacaggtgtgagccaccgcgcccggccataaaacttttaaaaatcctgcaaaatgtgaaatattagctaccctattacagtgtttgtacattaagaagacattttgctttgaagccagattcgttttaggacttttaaggtattatcaagttttaaattggttccaagatttggaaagtacagtccttcctagagcctgattgttatcatcgggctgtggttacgaaaagatagagtgttaacattaccaaaatgaaatcagtgtcttagtaaacacagaactttttaaacacccacctttagtatgtaccrtctgaataattctagcattttcacattgattagtcttttgaaaaatcataaagatgaacaattcataggttaatgcagaaaataatgagtatatcaagagatgaaaacagtgtgcttttgtcaaattcacaaatgtcatcaaattcagaactgcccttttggctgaattagttcagcattgtaggtgtttatatttgtcttgctgaaggactgttttaggagtgttgttgtaaaatctctgtccaattcccaattagcagagtagaacttttggtagtgcgaactcagtagttccatcaatgtgatctttacagttataggaaatgaacatagtttgcccacagttcttttaaaagatctgaataaacatgagtcaatataacatttattctgtattaataatcagtacataaattaattcaacttgaaaccttttttctacagagtactatttaatattatcatctgatccatagtaatttagtactaattttaatgagaaaaaatgaaacttttactttcataatagctcatccacttaacatttttacaaagaactactataaatatgtaacactatgcaggcttttttctacacctagtcacaaatcaaaataagcatactgtttatttaaaaacggaacactttcaaactgctgctgtattcagatcaccaccttccccacaccaaattaattgctctctctgtgtactcccctctgtgccactcatgttgcagcattatccatggctctttgccttaacccaacccggtttctgttgtcactgctccctaggttgagttcttggatggcagggagcctgtctcccttatcaaatagtgttaggtatgagttatgcctaatacgtgtgttgaatcaaattgaatttaattaggacacctgaattttatgtagcttccttctaatttttgtaactaaggagcattacaaattttcttttcaaaatgtmccataaaatataccatggattgaaattttgaattatgtataagagagttcatgttacccaataaaacatcataggaatttgaacctaaagaactctaaatcttaaatgaggatttttttttaaatgcacaaatggcaggcagaaaaatcaaatcctgctatattatcagatgaaattagaaagtagactacatatttcaataaagttgacattaaaaggatcttttcaaacagtgggattctaaagcctaacaattattttttaaattctgttgtaaacctcgaaaaacattcttaactataaaaaataaggtaacttgaagttagaaatttatggatgaagttagaaatgtatggatgaagttaatgctggattgcatacagaagccaaatttggtgcctccatgatccatatctttaatgcctttagcaagcctgttcacatatactggtgaaataacaatctctcagaagtaaataaaagagattctaagactccgctgagtagtagaccaagtaagatcatcacaaacttcatgctgtcaaatacattaccttgaaggaaaattatgcagacagcttttctgaacaactccatttatgccacatgcttattattctttgaggtggaggaggtggcagggaacataatttctgtttgaaagttcttttgttttctgctacctttacttaaatgttaccgggtactatttttatatcctataaagtgctttgaaaaaatgttaagtgaatagtgctacataaaatagaggagaattttcacattctctgggttgtaagaagcaaagtgaataatacttgagtcttaaaagaggaatgataatatgctgaaaaagttaacaagtagctaataatccccctccccaacccccagctttgcaaaattctgggttcaaagagaaactgaattttggctaataaataaataaacattcattaaaagcagaatttataccacagcaaatgtaaagaaaattcatgtggtgttcctaataattattttaatgttgttaaatggacatgaattgaaacagaacttatttatattcacttaacgtttgcatataaggtcaaattgcttaaatactattacaagaaaaatattttatgactctgaagccatctgatttctgcatatttctataacaataaaacaatttgaatcaccttagaattcactgtaataggatttggccatgtagcacatataatcagattgagaccagttaatttcggaattcctttttctaactgaaatcctacttaattcaacagatattctcaatagaaaaacagaaacctcttaagaatgaatgcaagtaaaatatacatcttatcataaaaacaatcagtacattctaaccaaaaatatatatcaaaccacagtgaaaaaagtaaaaacctagtattagataaaattttactttcttaaccaaaaaattcattgcacatatttaccatttatctgtttttttaaaaatcccccaaaatatttccaataactgctaagtactatactttttgcttgttcatgagattactaaacatttacaatgcaagtgtattggcttggaggcatccttgcagtaaatgagggcaggattcttcaatacactgtaaaatgcaccaaccttagtcaggtttttaaaatggttcacttttaaatatgatagctggtagctgtccaagtccattagcaccacatatagtgagttaaagagtgttttcagagaagatgactcgtcttttttgtttttaatgtttaaaagttgtacaattaaaagaaattgacttcttgggtcatgtgttttgaatgacacttttcatcttgctcaggatttccaccctcctccccggattataagcatgaaggtaggaaaatctgggggaaatatttttgcacttcagcaaagaatcttgctaataatatccatgatttggttcaatttccaagtcagattagtttcttttgttagaggtctcaatatgtatttacagaaagaaatgaagatgattctgtaggacaaagtagcaaatactttctatatgcaatccatrcacaatgcaagaattcacccagatcatttaaaatcatctaatgtgcattatttcctccaagtggagctcttgaacaaataccttacatctcatacttcatctttattacttcatctgtttcaagtagtaacacartcactcaatttacacaatgggggaatacacactttgaatcctaacctgtgaggtagggaagtgcactctggtattatggccatttcacacaaggaaagattgaaataggattactttttcaaaaaatatggcaatcattgatgagatcagatgcttccctttcaatatgtaaataaaaatgcaaataagcccttctcatttttgtaaagtatatctggattgaaaatagtgatgaaggccgggtgcggtggctcatgcctgtaatcccagcactttaggaggccgaggcgggaggatcatgaggtcaggagatcaagaccatcctggctaacacggtgaaaccccatctctactaaaaatacaaaaaattagccgagcgttgtagtgggcgcctgtagtcccagctacttgggaggctgaggcagaagaatggtgtgaacccaggaggtggagcttgcagtgagccaagatcgcgccactgcactccagcctgggcgacagagtgagactccatctcaaaaaaaaaaaaaaaagaaaagaaaatagtgatgaaaaagttaactttcaatattcatgtaaaatgctttttactggtctcaacacacagacatgaaggaatactgacatttaaattataatgtgctttagcaataacttttcacttttctattcacccacattcatggctcatttttggccgagaataaatatttgcactagattattaggattttccaggaccattactaccaggctggctttgaatctactctcccctctttggagagaagttgatgaatatggctcttaaagaagtaattctgcaagatgaatcctatattatctgtgataatttacttgggaattttcccttctcctggatgaagaataatattccccttgttttgtttttgctgtttcattttttaacttttcacagataaatccatgcagaaatggatatatacagatctgttgaggcagaaagaaaagcgggggaaaaacccactctccctgtttctacacttttgcacttagtaacaatttgcctgaytgaaggatttgtgaatggttctcyttttttttttttttttttttgagaaggagtctcgctctgttgcccagactggagtgcagtggtgcaatcttggctccctgcaacctccacctctcgggttcaagcaattctcctgcctcagcctcccaagtagctgggattacaggcrtgcaccaccacgcccagcyaatttttgtattttcagtagagatggggtttcaccacattggccaggctggtctcgaactcctgaccttagctgatccacccgccttggcctcccaaagtgctgggattataggcgtgagccactgcscctggccaaatagcgcttataagagacttaagactaggaaaccactcacgtttaatatcaatatgcatattctgcacactatctgctgaaattgggaaaatgcaatgtattttttgagttaagcctgctgcttaggaatgtaacaattacaaatcacattcacaaaagtagctcaccttattcaccattttaaacatatatgtgcactgtaaaaaataagtttttaaaaacttaatgtgatgttagcctatacacagagctgaattatcaaaaggaaaccagactttgttatatcagaggtcattaaaaagcttatggcataccataagtgctcaataaatacaccttcctcccccaaagcactccaatctccatatgccrttttagcaactccctgtatgttatgtcattttacactgcaatctgtgctgacttcctccaatccagaagtgactgcatttcagtggtagagttttataaacttgacttaatctttagcacttctgcgctggaattgtaccttttaagttctagagatgataaatctctcatttgttactgagtaagaaatgccacaaatgtataaaagaattcttcattaagcttgttttttctgccgtgactctggagagtaagtcactgtagaagattgtttattttattatcatcagaggccatttcattaaccagctgttctattgacaactgaatagcattcttgactagagaagaggctgtttcaattaagagtgtttcatattgttctgaagttctatcctcaaaaccattatcattagcaaaaacccctacttgctcattttcagctgaaattaagaattgcttagggacatttttagattttgtaacatcaaattcactgatttcagtgtctgtaataataatagcaattggctccattcttttgctttcttctgatttggatttctcttcagtgatcccattttctttaaaatctgattyttggctcaattcagtatcttttggcttagtttcttcagctacaatctctgtactttcatagtcttttccatttggtgcactttctagggtactgttactggcttcttccacaatttgttgatctggaattgcaggtaaaggaggaacatcagaaagtactggctgctgatggtctgtttctgaagtttcaagtgggcttgcttgctggggttgaacatcttgtttttccttgatcgtttcaatttcttcaaggattagagttcccgtttgaatagsagaatgcccattatctaatccaagttctactgaaatcactttctctccaraagttrtgctattgctcacatttgattcacagacctcatcaccatctttcygtgagatgccttcacttagatcctgggttgacttagcctttgttgcctgatcattcaatggggtctgtgtttgtatatccaaaatttcagcttcttcctggactttgatgctgcagtctgagtcttctataattttggaatgattactcctttttggccctcttgggaattttatgcagggaatcttaagtctagattttgcctttttcttagaaagatcagcatcctcagcatttattgcaggttgcatttcaccctccaatrgcttttgctgctttgaagactctgaccttttcctgcgtgtkacaagacgtttgagtgaggcccaggccccccgtgtgggctctggctgatcagaagctcctgcttcttgtggacacttccttgccacatcagcagcttcagagccagctttgggcttcagtgctttggctgctttctttcttctcttgaagcaaagcatggatgccttttccttctgcctttcagccccaggactaccttctgctgatctcttctcatccttgttttctacatgaatttctgaaattgtggtttccatttttacactgcactcttattctctagaaaactgtattctctcttccttagcagccttttgtgacaaaaagatgagcaaaaatgtcacactaggtamaatttcttccaggcatattcatacctttcatcttactccatacagttgttttaggtggtttctctagtatagaaatgcccagtttctctatggcttgtaatttctctctttaatttcttgatgaaagcccttctttggataaatttttgctttatttaaagatcaacctgatgagagaaaagaaagtggtattttatttcactatgagcctattattttctgtggagactatttcagtgaatgtataagattctaccaggcatattttccatataataacttaatgaaatgactggagaataaacattggggtttactttggccctattaaagagttcagtgtgattctattttgttttatcctccttgttgaaacttcattttggattaccctgcaagtctgatattatcagttctttagttgtgttgtctgtgtgaattgcttatgactctaaagtgcaagttaagcaaacaacaagaaccaaaaatgaagtgcaggatgaaaagcaagctgatgtaatctttatcacactcaatagataattttaaagctgcaaaggactttagagattatttgagattactcaaatccagccagatgacaaaactgaactccagaggggagcagttgtcttgtcaaaagccatgcaactagataaggtcatagccagagttagaactagagactttgactctctagttttaccattataacataaggtttctgttctaaaaatgtatgttccatcaaggaagtgctatttttcatacatattcttaggaaaatttagcattactgtcatttcccactcttaaattagttgtacaattttgacattttcatttaagtactgtatctgctgtatcacatgtttccaccataatctgcacatagttggaagtcagtaagagtagtaatagctgacatttattgagcaattcttgggtattaggcagtgcatgcacttttacatacatctctaatcctcaccacaatattacaaagatggtggtatcaccacgtacagatgaagcaatttggctgagattacggcagagctgtaacagagctcagattaacacaagattgcttgttgcttaaagcttatgttctgaaactgggctttaagagtttcgtcagaaaatgaattgtttggggatactaatctgcagtgtttcattagtaaaaaaattaaaaaattgattaatggtcatttaaccataaggcacttatcaactcataattgaaccacgagtagactgagttcttgtcatttgaaaaccaagcttttgaaattctttatattttatttttttggttcaggaactaatttaaaagccaaaaataagttggcaaactatgcaattggcaaacttagataatataaaggtgtattgaaaatttaatccttagaatggtatgatggcaccaaagaatggaaatgggaggtgattatccaacaaagatcctatgaattttagtgggtggatgccctaaaataagcaaagggactcattctttatattgtttttatgtaaatccttcactgaagtttcatttgggtaacccataattttatgaactgtagaaggaactggaaccctgaaaatcagtttatgatctaagtaaatattatcttaggttgggtgtttcatactgtrtgcctctaacagaaagataaagtcattctagaacaatgacggaactaaaatatgaacatttgacagtgtttctcctcacaatgtttcagtgagcactagaacctaagctgataactgtttaaatcttctcacctcttgtgagttttcagcacctgagcatttttgttaagcagaggctgtattaccacataatagaaatattgaaatgagatgtttaggagtctgtcattggaaactaacctggattgcgcaaagacaatcgtttgagaagctcacttgaatgtatctcacatactagaaataaaacgaatacccaaacagaaacttaactaacgagggaaaataatgcagtctgtagacaataaaactttgcagaatgtcagactgcaaatgattcgctcttaaccagcaagggtagctttatcgcctcaggaaatcttaaagtccctgtgctcatttcctgatggaattgcaagtctcatgtcacagaaaacaccccctttcctttttcccttgagcagccagtacccgaggaaagcaatgcatctttcccagcaccagatacggaccacgaagcttcctcctggaggaaggaatctcgaattctggcttgacgccccttatggcaggagacagagcgcaggataaagtactcaaaaaggaaaatgccgggggcgtggaacagataacccagcttcaggctgtctgcagaattataatgtaatggccagaaacccaaaatcacatttctcaaagagggataaagaaggaaaaaagccaccggcaacccatgcttctaagacaagctgtaacgcgaaggggataggtgggcagacctgatgagggtcgccctggccgcggattccagcggacaagcgacctcccgcgttcttactcccagcacctcagagggctcggataccccgtatccagtgggcacctcttgcccactccgcggtccgcggaccggacattgcccccgaccctcctcccccgcaggctccccgccctgcctttacttacgtagggcgtcggggtccttggccaacactgctcccgaggtggcggcgcgctcgcggggcccgccgcccaggcctccagggagccgcggtcgcacccggagcaaggcgccctctgcagagcccgccgccgggtgcgccccctccccaccgcgcggggacagacagcaggcagcgccaatgcgagcggagcggagcgggcgggcaggggcggggcgaccgcsggaggcgcggggcggcgcgggcgccgggacccacctgcagcagcagcctgcctgcctgccgcggggaagcccatcgtgctccgcccgggcgccaatctccactgccagaccacatcagcgccgaggcggggaccgcaagagagccagccggaaggttcggggggcgggggaaggcgggggggaccagggcaatgaaccccgcgttttctgagacgctaaatagtgaggtccggtttcaaattatagacagtcgcattacacatctcctctcctccccctcagaatatttaaagacaaggcagacatcgcattttaaaagcaggattcaaaactgtgcatagaatagcgaggtcatgtttgtttgaagcgaaaattacatatataaatggaaacagaaagaaacccgactttctcaggagtggcttgagtgtcagatcatcgtggttcatcgccaaacaggctttcaaacctttgtctcccagtgggaagcaggtggaggtgattggtgcagaactttggcctgcaggagcagctgcatctctatgcggacaaggtgagaaaggcacaggaacccagctccatccatcttataccttacatagttccaaaaataagttgaggtagcttacaagttacccatgattcccttcaggacattccctatgagggcattcctgggagctccagctgtaaaatctagtasgatccatcacaatcccagcctcctcctctggcccccatagcatagcatccagatgaagaacctggtaaggtgaagtgaagaactactgaaaagcagccgcgttcatctcctttcttcaacaggatcacgaccttagggagtgtaaatgtcaggtgtccatttttgtattttttccggaaatgttttatatttgtaagattctgtagtttccacagaggcttatcaaggaaagaactcttgagacacaaaagcaaagccaaatataagctgtcaagatcttaaaattacagataaaagaggcaagagttgtaaaacaggaaaatccataagcatctagtttagttgtaattaagaattcagggatgggcgcagtagctcacacctgtaatcccagcactttgggaggccaaggcaggaggatggcttgagtccaagagtttgagaccagcctgggcaacatagggagacaaaaaaatctaaaaaattagctgggcatggtggtgcacgtatggtcccagttactcaggagctcaggaggctgagaagggaggatcacttgggcccagaaggtcaaggctgctgtgagccactactgcaccactgcacgccagcctgggcaacaaagtgagaccctgcctcaaaaaaaaaaaaaaattcagtcagccttgttcactcagcaaacacgtctatcgaaatggtctgcgtatctctctatgggttgctagcgctgcttgttgccagttttgaactttaagccaaaagaaatccattatgctyataagcaattgagaactattccttattgagatccaaggtttctcaaaactagcagacctgggagtttgcaagagtttcaggcaaaaaataagatgagcttatttaggtgaagacagggtaaaatagctgtcttatttttatttttatttgagacagggtcttgctcaggctggagtgcagtggtacaatccctggctcaagcaatcctcccacctcagcctcccatgcagctgggaccacaggtatgcgaccacatgcccaggttcttcttcttttttttttttttgtagagatggcgtctccctatgttgcccaggctggtcttgaactcctgagctcaagtgatcctcctgccttgacctcctacagtgctaggattacaggtgtgagcccccatgcctggccttcacttgcctttcttttaaacaaaattagtaaaagggaactgaaaggcagtttgaggtgagagatgaatttatttagtatttgaagggcaaattcggacagacttccttaaggtatattacaaacaagtcatccctgacctccaccaacacacatacacacagagtcactcacacagagtatagtactataaataacatagcgcaccatagtttttctttaggatatgactagaactcaatgccatatgtgtgtgtgtgtgtgtgtgtgtgtgtgtgtgtttaatgtatccagtacctcatgcatgaaagaaacctgtcattcctgaattcaggtaagtgacaacgaaggctgtttaagctattacccatatcattgtctactaccccattagtagcttttcattatataacaggaaataggctataaatgtatttctgcaatctgatgagaaattatcctacctatagcttatcatgttaatatcactagatacagtgtgccagtaaaatagcttacatatttatctgagcaatactctactgatcttaccatttatcccatcttgrtctctacccattgcctgggcctatagctaccaaaaatgacttataactccttgttaatagctcttacatttcagaggccttctgggaataagccctccaaccccgttccctgggacaccattgaatgaacctgaggctccaagtctctggtggtttcatctgttcctgggcaccatgagggttgcacagagccaacacaaactcaatagtaatactgttgcaatctgtttaatgtggcagcacataaatgctatctcttttgaattaagactgtgtgtacatcttcagtgcacagaaacagcctctgaagtgagatcagagaatgtacaatttgtttatcagtaatattactaataaggggaaggaaggcwttagcagcccagagaagagaaagggcacgggaaagccactaatctggagggactcttagcaccaaggtaaaggcactagaccttctctgccagcacatgctaatagttaccccaagcactaatgcttctataggtcttttttattttgacacagggtcttgctctgttgctcaggctggaatgcggtggctcagtcatagctcactgcggcctcgaactcctaggctcaagcaaacctctcacatcagactcccaaggagctaggactacaagcgtgcaccacacactcagctgagttttggggttttgttttttgtagagatggggtctgtcttgtccaggttagtcttgaactcctgggctcaagtgatcctcctgcctcagcagcctggacaagacagtgagaccccatctctacaaaaaacagaacttcaaaactcagctgagtgtggtgggattacaggtgtgagctaccatgcccagcccctaccagtattgaggatttaaacccatgtggctgttggcgatattaggaaacctaaatcctttaagatgatccttaagtcaccatatctgacaagactgcatccttcccttgtctacaaaatgaattcccagcaaatcccattccaggtgaagtttcacaggacattaagaaatgtaccagaaagcggtcgggcacagtggctcacgcctgtaatcccagcactttgggaggccgaggtgggaggatcacttgaggccaggagtttgagaccagcctggccaacatggcaaaaccccatctatactgaaaatacaaaaaattagccaggcatggtggtgcgaacctgtaatcccagctactcgggaggctgaggtsggagaatcgcttgaacccgggaggcagaggttgcagtgagctgagatcacgtcactacactgcagcctgggcaaaagagcacgactcttgtcccaacccccctaccccccctgccaaaaaaaaaaaaaaaaaaggaaaaaaaaagtaccagaagcaattaactctgcaaacagggcctggaggatgctgtgcaacaggaactgacaagtgcttacaatgtgccaggccctgtacaaagcatcttagatgatgtgtttgagtaattccagaaccgccctcacgaggtaggtaccaacagtgctcctatttccatggtgaggatgtggaggcagggaggtgggtgaggctctctgccatagagctggggctctgcactgtgacccctttgccatatgcctctcaaggcagcgctatcatttctgtggactgtaaaattgactgtattacaacattgacayggacctagggaattaaaaataataaaaccaaggtcactgggaaaaatactgctttgccaacatcagcagtgtttagcactggcgccagtgggatgcagcatcctctggaaggatccagtggagggagacaaggggaaaaagggaaggaaacaaatgggagaggaagaacagagatagaagataaagaacaagaagagaaggaaaaatatttgatttatttttttagacagagtctagctctgtctcccaggctggagtgcagcagcatgatcctggctcactgcaacctctgcctcctgggttcaagcaattctcgtacctcagcctcccaagtacctggggttataggtgcctgccaccacacccagctaatttttgtatttttggtagaaacagggttttaccatgttggccaagctggtcttgaaccccagacctcaagtgatccgcccacctcggcctcccaaagtgctgggattacaggcatgagccacctccacgcccagccagaagaggaggaaaaaaaatattaggttggtgcaaaagtaattgtggtttttaccaacctaatgttttasgaaaaagaaagtctgggccaggtatggtggctcatgcctataatcccagctacttgggaggctgaggcaggagaatcacttgaacccaggagacggaggttgcagtgagctgagatcgcgccactgcactccagcctgggcgacagagacactgtctcaaaaaaataaaaataaaaataaaaagtctgtagggaagggtggagcccaggcatttagaagaaactcaatgaatacttgctgcaccaacagaatagaggctcacctaaggctaatgctgcatgaccatccttcttgagcactctaaacatagacagtgctaaagctgtgacagaaatgggaattccaaggaagttcaggcaaaaacttgtataagcaatacttcctcagggtagaaaaacaaaattcaacaatatagaaaggtataagattaaaaggtaagtcatcaacttccaacccaaccctctcaggaggtcccctgaattatgtgtcctctcagaaatacacaagcatgcatacatttccctctaaacacaacagtatcataaagggcacactgcaacttgcatcttcagcccaagggtctgcctgacaaatgagctcacaaaggatggcagagacctgtggcacagtctgttaaggctgtaattcatattgcaacaccaagatggcaaacttgtttccttttattctgtggaacgtcactaaagtaaacagacatgcatgatttatgttaatttatacatgatgagaattaaggctgaaaatgacktctggggaaactcctactattagtttcagatcttctggrcaggggctgacttctcttggcttacttatacttcctaactcccagtgggcctgaatagacactggccagactttyaaagtagcttcttgaagatggatggtgatctggaaggaaaaacaagaaataaatgttttctctaagcactgaaatgtttcctgttccttccatactgcaccattacccactcacattgccaaagctgttaacatttacatcctttcctgccaccagctcttctagggcgtgtccataaatggacttgaaaatgatgcatggtatttccatagtactgtgtgaatactgttcaagaccagaccaagccgtgagccatgactgcatttcgagtatcacacataccctctcaaagaatagtgttctagcatcaaactacagtttgcttctacttggaccttaactttctcaaataatgcaagagcttttgttttatactatgaccctttgatatccttgtcttttctrgctttttctagtttttctcaggtgctcccccaacctgttccacacaggatttgtaacttcaggtcatttgcatggttatcagaatgccccttcgctaatgtccaaatgagggttcagtttcccaaaactcacgtcttccttttttcttggttaattcctcattttgctaagtacattgctaaataacttcttaggaagagatgtggggtggcaaacccttgcacgtctgaaaatatccagatagattcggctaggtgtgagcacatgttgaaagtcatcttccctgtgaccttacaggacactcctccattgtctaaaagcttcttattgccagtaagacgggcgttaagtctagttctcattcttttcataggcaagccacttttttcgtctctggagaaagatgttaggattttcatgtttgatatttttgcagtttcaacaggatgtgtctagggatataagtgcacactgcaacttgctgcttcagccccaagggtctgcctaaggagagacacgtcctgttgaaatttcaaaaatatcaaacaatgcaatgtcactcattgcagtcggtactcagggccctttcacctaaggccctaagaactgccagattggtcctgtttccttctcttttctattatacttcctaagacatttgctaattcttgccttctaactacctattcagagtatacagaccgtcagctgttcctgacctgcaatgtgtcatcaactctgaaccccaagcctcctggggcttcagcagagggagtctaacctctcctgtagtttcctctgtagtttattggacagcagttttctcccctacactgtcaacctgtgacaagccatgctgcgcttcttccaaaaatgtgttgaaatataaatatttcaattcattggttattgccaactctcattactatcccctctcccctcagggaagtctgaaaagaaatgttttgaaagcattagaatgtgaatttttatagcgtcagtttgagccctataattcataaataagctacatgaggaaaaaagccaaattattacccagtaacaacttacctgtttagaataatccattcacctgttctgtttcarggtccaaatcaatatcataaaaacagggccgggtggggagtccaggcattgtgctcatctaggatgtaaaaaagcattacaaataaactaatgctgggcacagtggctcacgcctataatcccaggctgagrtggagaggatcacttgaggccaggagttctaaaccaccctgggcaacatagtgagacccccatctctacaggaaataaamaattagctggatatgatggcatgtgcctgtagttccagctacttgggatgctaaggcaggaggattgcttgaggctaggaggttgaggccacagtgagccatgatcatccgattgcctgggcgacagagcaaggccatgtctaaaataaacgtaaagtcatctttactttcacttttccttcagaaagaaagcccaaggcataaagatagaacatcattttatagttgtcaataaagtgggtactcttgttacatattaaaaatcaagtcactgatcctgttaaaaaactcagaaactgatccctgccgggcgtggtggctcatgcctataatcctagcactctgggaggccaaggcagatggatcacctgaggtcaggaatttgagaccagcctgaccaacatggtgaaaccccatctctactaaaaatacaaaaattagctgggcatggtggcgtgtgcctgtaatcccagctacttgggaggctgaggcaggagaatcgcttgaacctgggaggcggaggttgcagtgagccgagatcttgccactgcactccagcctgggtgacagagcaagactccatctcaaaaaaaaaaaaaaggaaaagaaaagaaactgattcctcatgtccttctgcaaaccaaatgccagccttcactatcatcttccatgtggtcacaagcagtagcaggaggtgtttccaccttcaccttacaagaatgagtgctggggagtagaggagttgctcactcgcctcctcagctcacgctttgcaagaccaaaaggaggtacagggcttgyctgcttttaaattttgtttcgttcagtcttgctagctgagctgcccatgtgatttttgcttcagcaacacgatggtaggagttagtatcctttaacttgggccaagacacttttgtacataatctagatggttttataatcaccattcttactggcccaaaatggccttctaaaactaaacttgtaatgcttacaaattatatttgtactcactacttttctaaagactcggctttgacaaatttctacttagatgcaaatatgtacggcttgcaagtgaaaactccgtatatttttatctgtaacaatgtcctatataatgaatacacacaagttccaaatcaaatctagacaggaaaacagcttaggttacttctaaaacttaactataaaaaggttatttaaaaagagtcatcttctgtaacacaaaacatcatcaatactttagaaaacctcattctgactgacttctgagtaccaatcaatattccccaaaacacattatagggatctgacaactggtttatattcttatattgtgtaagaggtaaggaggtgctaggtgtgagacaagtaggagagaggaaaggatgggtccttagacacagcagaaaaaccggaagatgacattataaagataaaagacacatgcccattgttgtagacgggcatgtgcatgtcagcagaaaaccctaaagatggttccctaaacagtgatgagtaggatttttgatattttcactcattccccaagaggattttccctcctaaacactggtcactgataatcagaaaaaatacaaaaaaagacaatattatgtgtacgcacatgtatgaacctagatataaagttctgaaaataagccatcacactttgaattaatatagaaaatattcaaataatctgagtctygttaaggccccaacggcaactggaaggtgttagaatagtgattaaaccatttgatcatgtgtggaaacgccttggtccaacttaaagttaaaagcctctgacacatactttgttctaaatgagaaagtcttgagttcggcaggctgtgtctctctccaccttacagcctgactctcactggcctgactgcttccagatttgctttcacctctactgttacccttttcttcatgtgaagatcaaaagtgacaagaaagagtacagctacccgtctttcagctggtagctgctgacaacttctccaaaaagaacaacacatatttctgcactattcaaggtgctgggtaaaaatggtggaaaattcctaccacaagggatttctacaaatcctggagactgatgtacatcatagcaagtctaagccttctgctctctatagagagctaaggaggcagtgagatgcaggcatttgtgctaagcaccactgtgatgtgatgatgttgcctacagtgtgagctgagggcagcagggctctcacctttcataatttgcccaaggccaagatctgaagaggtgaaaatgaattcagctctaatgtcctacgttttcaactctataatgccacctcctaccactttcttactatactgaaagaatgacataaatccaaaaggatgtatgttggtttcttttccatgtgtgttgatttagtttaatatttcagtcctgtattgcatggcagtacaatctgtagatacaggatacagggcagatttaggggataacctagattcaggatccaagttaaccttggaacaatgtcagcccaaactatgattatgtccttaagcatccctcccctctgcttcccaactggcaatattcttctttgaatatgcataaaatctgtaagataagaaagcaatggacaccttgttcaccttgaagcgtaaataagcaacctcacctttcatatctcaagggtccatttgcattttttaatggggaaattccttacttaaaaataatgaaccccctgaatttcagacgtaagttctaggcctgtcagtaaaacctctgtccctacctcctagggctgtggggggactgagttaatctatgtaaggctcccaataaacattaactgtgattatgttagcactaccccagcctatcaactgggctcatcctagattcagtgaagagcatactgtccctgggaaacagaattttttattcagtatgagtagtcctggcatcattcttgatttgacaccaagatggtccacagcaagagctatatagctcctgctttatagcttatgatccacagcaatcataataggcccgattccaattttcttctgggcagtgaactctgctcacttggcatttgcttgatggtttcggcaacacacttcagacgagaagtgcagatgcgcccactactcccttgcagcatgcacttaccgttcctactaaggggtacagaaaaccagccccaacgctggcgcggatgtcgcgaatgggcagaatgaagcctgtagggacacctttttgctctgggttgtgagacaaagacaagtgtgttttagccatgcagatggggagattcccaaagccctggggaaagaagggaagagagggaggacaaatgaaaagatgacaacccagcaatgaccatctgggccctgtgattacatggattcttcaatttattcgaaacatccaactccctttatatacatctctatcttgctgtcctccagcttatttattaagccaaaaaaaaaaaaaaagaactgttgggtgagggagttaggtactcacaactgtagtccacaagtgaatattttatttccatctatggaaataacataaaactaatttaaaataatagtttggagtagatatgagaataaaattggagagggtcaggtgcagtggttcatgcctataaattccagcactttgggagactgagatgggtggactgcttgagcccaggagttcaagaccagcctgggcaacagggcaaaaccccatctcaacaaaaaacacaaaaattagccaggtgtggtggtgcgtgcctgtaggcgcagctactcaggaggctgaggtgggaggatcgcttgagcctaggagtcagaggctgcagtgagctgaaattgtgccactgcactctagcctgggcaatggagccagaccctatctcaaaataacaaaaactggagacgttctcaatattttggtaagacattctgtatttcctcatggatttctacacattcatataacgcctatgggtaaataaagaaccagggactgtgccacctaatccaaactcagtatttcagaggagagaaggctgccacccagagaagtgaagcaacgggtayttggcagggctgggaggacccagagattgygactccaagtcctgctttgcaaagagttgaaaggacaaactaaccaaacatctacctgcttcgtgtagacttcagctttgtgttgagcttcgggaagtaattcaatgtcatctgctccatagatcttctgtgcaatgatcctgattttatcctcaactgggagctaatgcacaagaaagagatggggacaccatgactggacacatgtgaggacatttaaccaggacatagccacattctaggtcagagtccctaaaaggggcagaagatggtttttatatacatatacataagcaaatagtttgaggttgatgattgggttaagaacactttctttttgtttttttgagacggagtttcgctctgttgccaggctggagtgcaatggcgcgatctcagttcactgtaacccctgcctcccaggttcaagcgattctcctgcctcagcctcccgagtagctgggattataggcatgcgcaaccaagcccggctaattctgtatttttagtagagacggagtttctccatgttggtcaggctggtcttgaactcccaacytcaggtgatctgccagccttggcctcccaaagtgctgggattacaggtgtgagccactgcacccagccaggaacactttcttttaatatcaagcctcagattttataagtgaaaatgtcccacagaggtaaagtttttatatctatatatgcagatatacatatacacacatacatatatatatagatatagatacacatattaatatatattaaggttttaaatatatacttacataagtacatatttaaaatctctcgctaagtacatcataaacagtgttgctgactacccaagaataattatttcttcataaataaaaagtagatgttcaggctgggtatggtggctcatccctgtaatcccagcactttgggaggaggccaaggcaggaggatcacttgagcccaggagtttgaaaccagcctgggcaacatagcaacactctgtctctttaaaaaataaaaattttaaaataataataaaaattaaaaagtagatgttctattctaatactggagatcagtcctgtcaaaccagacctggggacactgtttatgaaataagacaaccaatgtccatctacataactcccagtctgtatatgagaggcagatgccacccttaacacaattgattaagtgcaagcaccaggaattaggaaatagtcataaaatcaaaatcacccaggtattagaaaaaacaacccagtgatttacatgatcaacacgcattgggcatgtccactttctgtggcacctgaagcaaacagtgcagtggacagagaccagtggtctaactggtgagggcctcagtcccatgggctgtttcctccggggcaaagccttcagagaagtggagctggcttcttaaatgctgtgtagactagttcagggcattaagattcaaagagaacagcatacggagaggttgcctaaaggaaatcagaagcaaagctactcatgggtaatttggatgagcaaattacaaaaattaggcaatatatctgtctttatagcaactaaagctaaaagaacatattaggcaggttcttatttatttgagacagagttttgcacttgttgcccaggctggagtgcaatggcgtcatctcagctcactgcaacctccgcctcccgggttcaagagattctcctgcctcagcctcccaagtagctgggatcacaggcatgggccaccatgcttggctaattttatatttttagtagagacggagtttcaccatcttggtcaggctggtctcgaactcctgaccttaggtgatccacccacctcagcttcccaaagtgctgggattacaggtgtgaccacagcgcccagccaagttttgtttttaaaaggagcaataatctatctataaaaacaaaaattcccttttgaactaaacaatgataatttatgaaggggctttatataatgggcatgaataaagtgaacattcaataaggactttataaagatgaaacacagattattttcatatgcatctcataactggagctctataaatgccaagrcacatttagaacttctgaagcaaaagcactttggttgaagggtgatttaagactagcagacgctgagtaagacaaaaagtggcagcctcctgtttgccagaatggataaaagttgcaagtagaaaygggttctaaagtccatatgtccctgctctttcaggtctcctgctggttttcaaggactgggcttccagccttgggtgctatgcattggagcctggagagggtgcctataaatgctttgcatttgtgtgcaaatttgtgtttatggcatttttctaaaaggatgattgctgaacagattttaaaacttgcctataaaatcaaagctcaacaggagaatgtcaatgtcaatgttaattaactgtaagtgtattatatctgcaaggggcaaagagaaataagagaacactaaaactcaagagtaataagtttattccttctgcttttttatggctgtttttgaaagtctatgattatctattaaaaaccaagccaggccaggcacattggctcatgcctataatcccagcactttgggaggctgaggcaggaggatcacttgaacccaggagttcgagaccagcctgagcaatatagggagacccagtcactacaagaaaaataaaataaaataaaacaaaattttttttttgagacgaagtttcgcacttgttgcccaggctagagtgcagtgatctcagctcattgcaacgtccgcctcccgggttcaagcgattctcctgcctcagccttccaagtagctgggattacaggtgcctgccaccacacccagctaattttttgtatttttagtagagatggggtttcaccatgttggccaggctggtctccaactcttgaccttaggtgatccacccacctcggcctcccaaagtgctggggttacaggggtgagccactgtgcctggccaataaaacaaattagccaggcttggtagtacatgtctgtggtcccacctactcagggggctgaggtgggaggaccacttgggtccaggaggttgaggctgcagtgtgccatgattgtaccactgcactccagcctgagcaacagagcaagaccctgtcttaaaacaaaaaacaaaacaaaaaaatcaagccagaaactagcctagagaataggaaaaattaactacagcatatatctcatattcctaacaaagtttccagttgttgtttccatactacttaatgtcaaatcacatcctgaaatacactggacagataaatgaaaacaaaacacaaccctataataagaaccttttcctgaactaactttattgtatcatagagtaagcagggctctacttagaccaggtgtaatttaatttgcttagtgatggaaaaaatgatgaagcttcctggagtactttggttttgcatgtgagggccctcaacttgaggcagcaccttaccaggaagtgaacgtgggggcacacttctttcccctattactgaaaagccatcagaaaaattttgtaagctcgatgcagccccttaccaatctgctacatggttggtgccttgttttaaaggctacagtgaattacatatttggtctatatgtaaccttctcttctgccacctgtactttgacccttttcgaagttaggatatgagcaacggttccccctccaccctggggtattcctgcttaaatcccctctgtaagtaagcagtggcatatgtttataagaaggctgtctgggcggacgcagtggctcacgcctgtaattccagcactttgggaggccaaggcaggtggatcacgaggtcaggagttcgagaccagcctggccaagatggtgaaaccccrtctctactaaaaaaataagaaaaattagctgggcacggtggcagacgcctgtaatcccagctacttgggaagctgaggcaggagaatcacttgaacccaggaggcagaggttgcagtgagctgagatcatgcctctgcactcgagcctgggcaaaagagcaagactccgtctcaaaaataaaaagaaggctgtctacagctgggagtccaggctgtggttgtgtaagtcacctacgtgggaatcaaaccgcaaggctgaagctgcgaagcawggggctctaatagaagtagccacacagaaacttcactgtgcccttttcgtcttttttctttttttgcagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccrtcctataaaggaagcatttcatatcaaagcatggaaaatggctggagagacagaattgtcttctttttgccattaaacctcatgtgaattacccactgataaacgaacactaaccaagaaatttggcctgggtttgaatctcagctccgaaacttactagctggtgacttttggccagttacctaatctttatgtgcctcaatttccaccctggtaatacgcgaataatcacagcacttatttcattgggacgttatgagactcagatggtaaatccatgtaaaatacttggaaaattcccagcactccagaaggaatcagtaaatactagcatttaagaattttgctggctgggcgcggtggctcacacttgtaatcccaacactttgggaggccgaggtgggagaatcacgaggtcaggagatcgagaccatcctggctaacacggtgaaaccccgtctctactaaaaatacaaaaaattagctgggcatggtggcaggcacctgtagtcccagctactagggaggctgaggcaggagaatggcatgaacccgggaggcagagcttgcagcgagtggagatcgtgccactgcactccagcctgggcaacagagacagacttcgtcccccaaaaaaaaaaaaaagattttttgcttcccattctactacggtgaggccattataacaaaaccctgaccaccaatgcaatacctaaacaacccacacaagttcttgcatgaccccttccagagtaatatgcccaattctttgtcaagacaacatcccaccagatctagtaaaataatggaacactataggcctatgaccttctgttagcataaaaggcctctaaagatgaaaaaggaacattgaacttcaggcttgtgtgttacttcccccagtggaaaggaaaagggcccataggagctgaatctgactttgggaccctcagtgggtgaggtggtgagcccgcagtgacgtaygcaatgcctgtcacagtgcaggctaaaaccacaggctataaccaatagcagtaactgaaaaacaaaataaagctaaaagcagtgctgtacaatcagctccaggagattttccacattcatccttttcgcttacactctacacttacttgaatgcattcacggccactactactggaattccaaacattctggcattttcaatttgtttcttcaagttactgaagcctttttcaaccagctccaggttctgtaaaaacaacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtgagtggatgctatggagaactgcagctttcactccagcctatgacactagagtagagctctgcttgtttcccagccttcaagaaaaaaagagctggtatgtttcctgtcattatgccacatcattatagcttatttgcygtttgaaaggaattagttacccttacccaaattatatttaccaattgtgtttatagattttatgtattcatagggttatgataatacaaattractctactctgcacagcacagacccttccatcagaagacagagcctaacaacatagtggctggcacagaagaggtattcgttatatggctgccgtaaatactgccaggaaatatgaagtaagcagtgatgttttcaaaggttttaatgaactcgaccgtgaacgagggcaagaaataagataaatactatctttaggaatcaggccagtggctgggcccagtggctcacacttgtaatcccaggactttgggaggctgaggcaggagaatccacttgagcccaggagtttgagacaagcctaggaaacataacaagaccccatctctacaactgagaagttaattaaaaaaaaaaaaaaaaaaagggccggacctggtggcttaygcctgtcatcccagcactttggggggccgaggcaggtggatcacaaggtcaagagattaagactatactggccaacatggtgaaaccccgtatctattaaaaatataaaaattaactaggtgtggtggcaggaacctgtagtcccagctgcttgggaggctgagggaggagaatcacttgaaccccagaggcggaggttgcagtgagttgaaattgcaccactgcactccagcctggtgacagagcaagactctgtctcaaaaaaaaaaaaaaaaaaaaaaaaagaactgagctggatgtggtagctcacacctgtaatcccagtactttgcgaggctgagatcggaggatcacttgcacctaggagttcgacagcagcctgcctgggcaacatagggagaccccgtctctacaaaaaattaaaaaattagcctggtgtggtggcgtgttcctgttcttccagctagttgggaggttgaagcrgggagactgcttaagcccaagagttagaggctgcagctatgatcacgcctctgcagtccagcctaggtgacagagtgagaccctgtctgtaaaaaaaaccccaaaaaccggctgggcgtggtggctcatgcctgtaatcccagcactttgggaggccgaggcgggtggaacacgaggtcaggagatcgagaccatcctggctaacacggtgaaaccccgtctcaactaaaaatacaaaaaaattagccggacatgatggtgggtgcttgtagtcgcagcttcttgggaggctgaggcaggagaatggtgtgaacccaggaggcggagcttgcagtgagccgagatcacaccactgcactccagcctgggtaatagagccagactccatctcaaarcaaaacaaaacaaaaaaacccaccaaaaaccaagtactacaaactaaagggaagcaattaaggaaatgtatctttaagtatgtttactgcagccctgcttgtagcattggaaaattataaacataaacctcctccaagggggactgggccaatgaattatgayatatacactcaataaatatttatcatgcagatgttatgaaagtgagacccatctgtgttaacatggaacctgtccaagatgtactaaaggtgcaaaaccatggagagcttaattattccattttaggacaaacacaaaaatacatgtatataattcatgaaaaatttttaaatgtcgagaaatatgcaccgaactgttaaggggactcaactcacatatattacattcttataatgtttaattattattttttacaaagggtatattactattgtaggcttaacaatacattaaatattttaaaaataaaagagtcttctataaaaatacatatactgaatcatcgagcaaaacccagcactaatgtttgttgatcccaaaaaagcagaaataggtaggataaaaggtggaaaacaactaggttcattataaatgtgatttatgcttttttcctttaataattgaaaactgagattatgatttatttgagcttctaaagaacactgctaattctttacctctagtcacatgaaaaccaattaatatgtaacgctgatcaagaacagttttaaataagtagaatttcttaaatgaagacaccagctgggccagctaggggcagtcactgtaattagacacaggaaaggctgtggggtggcaggagggccagaactgtgaattcccctcctacgcgtgaatcagacaaatgaccataaaaggcaaaccataactcagaagacaggcagactgaaggtaccagcaattttttctagccagttttgaaatacttcatttggggcctgaacagtgaccctgtattgcttgataatttaaaagccttccaaaaaggcagaaaaattgaattagcagtgacagcaggtgaccttgccaccttatctgatggcctgtctttcctgtaaccaccccaaactggctttagagatgtttctttgatggtaaatgacataaatatgaaaagatttgagctcacagttgttctctagcctcctgtttgatgctataaatatccaggaagctttgtctagaaaaacaaccagaatcctgaccatatatcttggcccgttaatatggatttaaatcggcagaggagaagccatttcaaaaaaggtctctacttgcttctgatctgaatggcatttggaacttacccagccaatgcagggaagacaatggaagggaactgctattagtctaggacagggtttctcagcctcacactccgacatttgagctggataatgttgtaggggctgtcctgtgcattaaaggatgtttagccagcatccccagtttctacccactagattccagtagcactccccacctccagttgtaataataaaaaaagtctctagacattgccaaatgtccccggggtcaaaatcagctgttgagaatcaaccactggtctagggcagtggcttattgacaccctatgtgggacaattctattttgtgaggtrcatcttccctatctactcatttaatataactcctcagcacactgcaggccttttggcaccctgcrccctgggtcacagcaataacccattcatttccacatgggccaggtggagaaatgctgattcaaggtgtggtgctttctaggacaygtgatgagaaataactcaggttacctcctgtatgtaagccttgggaagaggcagtccagcagtgacctggaaggaaaagaaacagagtcagaggcatttcctatttaaatctcctagcttaaaatggtgcttttyatgtgttaaaggcaagacgctgcaatgyttgcaggctgtacagtagtataagattatttcctgccctaaggacttagggtatgtgaccaatcacacagcacagaacaaaatcgactgctttgggcagcgtggaagacctctatgacctgaattaaggaggtgagaaggaccggatcgatggcaggagaggtggaaaggggtgtaccaagcaggtgcagtgactcgagtgaaggccatagcagtggggttggaagtcaaggggagtgtggggaaagaggaagcggtcgggcctgcggaagtcaccctgggatgtctgtcgatagagcccgtgatgagccctgccatggtttcatgaactggtccacagtgccaacctagcattggtggagctgaaccgtggtgcagggtcaatacaaacaagagggaaaacaatacagaaggattttctttctcttttgtagagtatatctaaaggatggaggtgtctggtgcctccccgccccgccccccagcccccagtcttgatctatgccgtggctcagccctgytgcatccacagaaatgagcaaatgggtgaaggtgtccatttcatgggccccaccatgggcagtggatagtgattaagaagctctgccctcttccattgcagtgagactatgtgctccaactccagaaggggctgtgtggaggcagagcaagaagcaaggaccttacaggtagcttcccgtcagcaagctaatgagagcaggaggcctactctcttgacagagccatatgtgcaaatgttcccctccatgcacagcattatgggacattatcctgactgtgaggtcaggaggaagcaaggaaaggaggtgtgatggtgtgagggtgagtgaggggtgtaagagagaggaatgttagttgtgactgggaaaaaaaagggagtctatcctgtgctactagcagaaaggagtgtgctgggttgggagtgcctttggcactcagggataactaagactggataggggtgctggggttgttatggcagcattcccagtgtgctccggggacccaatcctttgaaggggtccatgaagtcaaaactatttccataagattctgtaacatcttatggcccttttactctcattatcattctctcattgagcatataatggacttttccaaaggttatgagacatgtgatgtcacaacagatcaagtgctgtcttcaattaagccagacccagagaagatctgaaaaatgtacaatgcctaaattttgctgggaaaagataatgcattttcatgtttacaaagttctttatgtttacatgtaactcagtttt

SEQ ID NO: 13366 - DNA, 83712 bp, Homo sapiens
ctgacggatctcctgaggtcaggagtttgagaccagcctgaccaacatggtgaaaccctgctgtactaaaaatgcaaaaattagctgggcatggtggcacatgcctgtaatcccagctacttgggaggctgaggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagatggtagtaagtgctatgaataaaacaggttaatgagatagtaatggggatgtaratggagaggtaacttttgatagtgtaatcaaagaaggcctttttttggatatagcaacataatattatacattttattaacctgtctttatcatttaaaaatgtataaaagctggtcacgcgtggtgggtgatgcctgtaatcccaacacttttggaggtgggtggatcacctgaggtcaggagtttgagacaagcctcgccaatatggcgaaaccctgtctctactaaacatacaaaaattacctgggcgtggtggcgggcgcctgtattcccagcttactcaggaggctgaggcaggagaatcacttgaacctgagaagcggagcctagatctcaccattgcattccagcctgggtgacaagaacgaaattccatctcaaaaaaaaaagtatgaaagctatcttacatgtctatacatatgtatctgctgttcctttaacaactgcatccatcctgacagaaattttgttttttgctattgaaatcagtgttgtgattaacagttttacacatggtttttttgttttgtttagttttagyttttgtttttttgagatggagtttcgcttttgttgctcaggctggagtgcaatggtgtaatcttggctcactgcaaccttcgtcycctgggtttaagctatcctcctgcctcagcctcccgagtagctgggattacaggggctggccaccacgcccagctaatttttgtatttttagtagagatggggtttcgccatgttagccaggttggtcttgaactcctgacctcagttgatccaccagcctcggccttccaaagtgctgggattacaggcgtgaaccactgcacccagcctatacatctttctttatatgtaaatattactttaagataaattcctaaactgggagaggtggctcacgcctgtaatcccaacgttttggaaggtcaaggtgggaggatggtttgaggccaggagytggagaccagtctgggcaacatagcaagactatctctacaggaaaattttttaattartcaggggtggtggcatgtgcctatagtcccaactactcagaaggatcactttagcccaggagttcagggttgcagtgagctgattgtgttactgcactccagcstgggtgacagagtaaaatcctgtccaaaaaaaaaaaatcctggaagtggaattacaatgtcaaagaaaatacaaatttaaaattttcgggccaggtatggtggttcacacctgtaccaatcccagcactttgggaggccaaggaaggcagatcacgaggtcaagattgagaccatcctggccaacatggtgaaaccccgtctctactaaaaatacaaaaattagctgggtgtggtggcgcccacctgtagtcccagctacttgggaggctgaggcagaagaattgcttgaacctgggaggcggaggtttcagtgagccgagatcatgccactgcactccagcctggtgacagagcgactcaaaaaaaaaaacatttttttcccgtagatattatcatatcaaattacccctgaaaaaggttgtaaaaacggggcctctgcaaaaagtaaacattttttctagcaactgcctttataagcatttaaataaaaatattttttccttctatttgctgtgaaaggttgattttcattctttatttgaccaatttgcaacacttgacagaattaattacctctttttccatgaaacacattcttcacttgtcttgttttttttttttgtttgtttacttgtttgtttttgagacagagtctcactctgttgctcaggctggagtgcagtggcactatctcggctcactgcaaactctgccccctgagttcaagcagttctcctgcctcagcctccctartagctgggattacaggcacgcgctaccacacctggctaatttttgtatttttatagagacggaggtttcgccatgtttgtcaggctggtctagaactcctgacctcaagtgatccacccaccttggcctcccaaagtgctgggattacaggcatgagacaccatgccaggcctcctcacttgtmttctaaggtgggatgctcttggggttttccttagaacacactggactctcctttccttttaagagacagggtcttgctctgttgcctaggttggagtgcagtgtgatgattatagcttactgaagtttccaactcctaggctcacaggatcctcccacctcagccttctgagtaactgggactacaggtacatgccaccacgcccagctaactttttaaatttttatttatttatttattttgagatggagtctcgctctgtctcccaggctggagtgcagtggcgtgatctcggctcactgcaacctctgcctcctaggttcaagggattctcctgcctcggcctcccgagtagctgggattacaggtgccagccatcacgcccagctaatttttgtatttttagtagagacggggtttcactgtgttggccaagttggtctcaaactcctgacctcagctgatccacccacctcggcctccaaaatgctcggattacaggcaaattttttaatttttatttttgtagagacagggtcttgctatgttgctaaggctgttctacaaactcctggattcaagtgatcttcctgtatttggtctcccaaagtgctgggattagtaaaggtgtagccacagctcccagctggactctccttttcaatcttccctcttggttcctcctgtctccttgcattctgaacactgaaaggttctaggtgtcagtctttggtcctctctctacctacaatacccttggttggatctcattcaatcccatggatttaaatatcttctctccatttggatgtctaagagaaatctaaaaatgtctaaagccgaattcataatcttaaccccaaaacctagtcctacattttactttatttcaactcagcgaatggcaattccatctttccagttgctcagagcaaatccctgctttctttcttttacattccaagttcctctcttcattaaggtttctgctgaagtcagatgcccaaagaaatctcttaccacatttctgagacaaaactttcccacctcccagcatcactgcctatcctcttagcttgcctatttttaaaatatagcatgtcataatctctaaaattagcctatgtatttctttaacttgatcgttgtctcctccaccagaatatgagctgagagcagaaactttgctggttcactagggtatctctagcatctatagcagtgctgttggcatagtggccactcaataattatttgctccatgaatgaacgatttatgcaactcatacatagataactgtcaaaaaccaggctgttgagatggcaaaggcagtagatttagagaagaaacatcaggtttggggcctataccagccacagctatgcagctttgggtattatccttcaaagtctatccctctgtaaaaygggatttctgccatcttcctcaacaaataagaaagctggaatagtcaatacctatttgatagtataagacaaaagattcactatctgcaatttaccagaaacatttccttcaattttcttcttaatttcacttgtttaggtacaacacaatatgagacaatgtgttttagggttattattataatgacattatattactaagtctgtgcctttaacatatcacttgtgcaaactttaagaatagtaactttaaggccacgcacggtggctcatgcccattatcccagcattttgggaggccaagggagactaatcccttgagatctagaccagtctggtcaacatagtgaaaccccaactctaccaaaaatagaaaaattagccggcgtggtggcatgcacctgtggtccaagctactcggggggctgaggtgggaggatcatttgaacccgggaggcagaggctacaaagagcggagatcatgccactgcactccaccctgagcgacatagcgagactccgtctcaaaaacaaaaaaacatatattagaaataattaccagaaatagaaaatcacaagagattatctaatcccgtatatggggctactataaataacctcagaatttagaaataagaaaaaaatattaaaagccccaaaattaataaaaaatcagttttaggccaggtgcggtggctcacgcctgtaatcccagcactctgggaggccgaggcgggtggatcacgaggtcaggagttcaagaccakcctrgccaagatggtgaaaccccgtctctactaaaaatacaaaaattagccgggcgtggtggcgggctaattaggtggtgcctgtaatcccagctactcgggaggctgaggcagagaactgcttgaacccgggaagcggaggttgcagtgagccaaaatcgtgccactgcactccagcctgggcgacagaatgagactccgtctcaaacaaacaaacaaaaaaagttttagatgagctctgccagtagtaaacggcttgtaaaagaaacccggtatctggtcaagtcctaagtgacctgaaccacgcatcttcaggactctactgggatgactgtaacctgaacgcggttcctagagcagagcaagcatattccttggactcagtaacacaaggggccagtcctctccagcatcccagctgccaccgccctgtcaggctccccaggcaattgtccatcttactccttctccagcgtggacgcttaaggggagggagcatccctcctcgagggtcaactggcatgtagcttacgaagaccgcgtgagttctccaaccccagacttgctgcggggcggggacgtgggggtgacaaaatccagactacgaccctccatgagccctggcaaccccggggtgaccccaacaccgatgaggccacgcgcgctccagctctgacactccttccagatcggcggggcctgaaacagcgggctaagcttcacctacggctgagcgtcagattcagctgaggagattctaaaagcgctatgctgggcccagacccaggccctccagagcagaacgcggaggggcccgaccccagtctggtggcgtaggtgtgtgacaaagtatgagggcgcgccaagctctccagttccacatctgctgtcgagtccagcgcctgccacgctcccgtgcggggacccgcccaaaactccctggaagccaggcgattcagaccccgccaccgcgtccccagagactgggcggaaaccggagwctcgcctcccgaacccgcgaaactatctcccgcgagactkccccgccccaaccccgccccgcaactctactccctgatkggctggaattacggccgsattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcrgggggagaagcgggcaggggcgcaggcgcagtagtgtgatccccyggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgtaagcacctgacattgttgttgagtgtggggctgtggacgagggctctgagggtgtgcaggtcccccggacccattttttgcgggagggacacttgtagcggaagagttaggcccataacacctgaagacctgcagccaaagaaagagaacccgggcacaacctgcgtttgcaagtggactgcctagtggctgtagccgctggctcctgtgcttcggggaaaagtcctgtgccgactrtgctcccaaacgcgcagctgctggtgactttctgccgggagagtgggtagttgcggcttcctggagcccccctagtcagaactcagaaatccaatctacttaattcccgttaatttggaggtgagtagatggagactagtgaggtgacaaggcttgacaagactacaaggctgataatgacagagggtccttccagctcatagcttttcccactataccatagtcttatcatacgctaagtgaaatctaatacatttttcctttctcttcaatctcgtgcttctctctaacagccrtctctctgccctggtcctagagttacttgaaacgtaatttggctcctgagtcctgagaatattctgcattccwcttgacctctgcctgttctacccttgcgggacatctgaatgcttaattagtgggtatcgttgccagctttactcccaggaagtaacactggctgctttttgtctgggaggtgactggtgaggaaaaatgagagtagaaggaagagggaaaaatatattccctctagtagatgaaggagggaaagatatattctgtgtgaccttactgagtttgctcttgggacctttcacatcacccgttatgtaagtaactgttgccagccacagcagttactaaattgtaattgtcctgtaactcctaactttgtaataggtttttgagtgaattacaaagtcatcggtggtgaaaagtccgggcccagtggctcatgcctgtaatcccagcactttgggaggccgaggtgggtggatcacctgaggtctggagttcaagaccagcctatccaaaatggtgaaaccccatctctactaaaaatacaaaaaattagccgagtgtggtggcaggcatctgtaatcccagctacttgggaggctgaggcaggagaatcacttgaacctggggggcagaggttgcagtgagctgagatgcgccattgcactccagcctgggcaacaagagcgaaactccgtctaagaaaaaaaaaaaaagaaatcacaatacttactgcttagtgcttttcaacatgtggcttgctaaactgtatttctgctttactttctgtttttgtttgcttgtattcaaacttacttccttttccagtggctttttgttttaatataaaaatcttccttttagaaagactgattgtgaagagataatttagtgcataataatagtgcagataatttagtacaataataatgcatctgggccagtactgagaataggtgctcactgaatatactttcgttaattggagagcaaattaaatatgtttatcaactccataagggcaaatacatgtattgtcttatttttgtctatatcctaaacacctggaaaccctgtttcctgccttactacttgtgtggttttaagcaaattaattaacctttctgtgccaaagtttcctcaaatgttaagtaaaagtaatgtctaggtcattgggatgttagtagaattaaatgggttcctaacagatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtctkgctgtgtccaatcttggctcactgcaacctctgcctcctgcatacaagcaattctctcatatcagcctcctgagtacctgggattacaggtgcccgccatcacgcctagctaatttttttttttgagatggagtttcactcgtcgcccagactggagtacaatggcrtgatctcggctcactgcaacctctgcctcctgggttcaagcgattctcctgcctcagcctcccaagtagctgggattacaggcgtccgccaccatgtccagctagtttgtttgtttgtttgagacagagtttcactcttgttgcccaggctggagtgcaatggcatgatcttggctcactgcaacctccrcctcccaggttcaagcgattctcctgcctcagcctcccgagtagctgagactacaggtgtgtgccaccccgtccggctaatttttgtatttttagtagagacgggctttcaccatgttggtcaggctggtctgtaactcctgaccccatgtgatccacccacctcggcctcccaaagtgctgggattacaggcatgagccactgcaccggtcctagaatttcttaaaaatccagcccacttcccacattccatcctgcggattaggaaatcatttgaggccagaaaagtgatgtgatttgtccaagggtgaatggcaatggctcaactaaaactaaggtcttcacccagtatatgatgtttttcattctaaccagcacttactacttgctaaaaggaatttcgtaagcttttctttttcttttctttctttctttctttttatttttcagacaaggtcttgctctgttgctcaggctggagtgcaatggcacgatgttgtctcactgtaacctccacttcctgggttcaaacgattctcctgcctcagcctcccaggtagctgggactacgggcatgcactactatgcccggctaatttttgaatttttagtagagatggggtttcgccatgttggtcaagctggtcttgaactcctgacctcaagtgatctgtccacctccacctcctaaagtgctaggattacaggtgtgagccactgcgcccccgctggcgctttgctttttctttacagtcttcctctcattagcatgtttcccaccctgctgagaatgctatccctgactcgtcctcttctattattattctccttttatgccttcctgggagctcggacatcaacaaagttcagcattccagattccttctctacctgctctactctgtgggaaactgggtacttacatgatggatttagttgccaaattatctttctttggaagtaacagccccttttctccctcacggggaattctaagtttgcagcctgaatttgacaaccgggggaaggtctgagagttagagacaagtatctgttctttgtgggtatttattcacttactcaacaagtagctgtatgtgtcccctaagccaggcaatcttcaaagctctgagagtctaatagtgaacaaaacagcccaaatccctaccctcatgaaacttgcatactgatgggtagagacagacatttaaataggtgaaacacattgtgagctggtgggaagcacaaagagaacaccagagcagaaaagagggacaggagtttctgtggtatggtggctgcaattttaaatatgggagtcatagtctttgtaaaagtgacttacgggcaaagacttgaaggaggtggagccttaagcctgccaatgttgtgagggaaatagctcctgaccaaaaacacagcctgtgccatagacctttgtcctcaccagttactaacttactgctttggggggtcaatggcaatggccctgtgagaagctgaccgagtggaggctcctgagtagaggaacctgaccctgccctgggcagaagggtggtgtcttttaaaagattatgcaaagtgggagaaggatgtgcattagtgttggaagacccaccttgctttgtaggcaagaaagcatagttgttctataagtgggcctttcaaaggggggcttactacatttatatgatttgtttggtttttccttcccttagtttgctataattaagcctgytctctccattggtggcatttttcttgattaagtctcctttctaaagagactggttgtgaagaggcagatggtttgagtaggtgctgcgagtgtttgctggcsaagtgcagggcaagttgggtatatttgtaagctcgctgtggatggtagctccagagcctaagcacggtgctgcctcctctgtgcatcactgggtcatgcaatttacctctgtgccttagcttctgtatattggggtagtaatgtcacctaactcataaggttgttagaattaaatgagtttaatacctataaagcatttagagaagttgttggtacatggtaagttttaataaataggtacttagaaagtactcattgaataaaaaagtgatgtttgtgtttatccaggctgtacctttgggagctggcttataatcttgagacttaaaattagaatttatcctagtgatcaaagataaaagtttggaaccttggctgtacatttagctacagggctagaagaactgtttttgtgaaaataatttgcttaccatagtgaagggcaggtcttcttggttactaagttaacatggataagacttttactttgtcctgtagattaaatacatgtaggcccttttgtgcttaaaaagatttgtctgggcagggcgtggtggctcatgcctgtaatcctaggactttgggaggccsaggcaggaggatcacctgagatcaggagttggagaccagcctgactaacatggtgaaaccccatctctactaaaaatacaaaattagctgggcatggtggcccatgcctgtaatcccagctactccagaggctgagacaggagaatggcttgaacctgggaggaggaggttgcagtgagccagtgagccaagatggcgccattgcactccagcctgggcaacaagagcaaaacttcatctcagaaagaaaaaaaaaaaaaatttgcctgtaatgaactccaaagtgcaggttgctcaaaagttacatggaaacttgactgtcatagctggattgattctggaagcctgtgcaggagaggtcggagttccagagaggctgggaccttcagctaggaccccagccaggctgttgggcaggttgcagcgatagtgcagcagagcccagagctggcagccaactactatggtcatggcacctgattggggatgtggtttgcaaataagtgtctgtccttgtccatcaggggagttgggatcaggcagtttgggatttgggtagtggggttttgagcagaggtctgtggttccctgttacatcccctatttgcatgaagaatcttctagaaggaaagctggcctagtacagaggagggtccttggagtggaagcaaatggctcccttctcctctaattgactcagtagaggttggtagaatagaggttaaggggcagggatgcttgtgtggccttggaaaagttagcttcactttcctttctgtgcagtagggatgatgagaactgtctacttcctgacgttgccccaaggattaaaagaatgtaagactctcaaaacaagcttctttgacgtcccatccacagtgcagaaggcccccattacccctgcactgtgcggttggctctcctttgcaccccttaattgaccaaaaagcagcttctgtcaccctgtaaatccttgaccttgaagaagtgggtggctaaaggtgccacagtcaagattcctcagccactcggctactacccttaccctcaattttgcagtttatgacactttagccagaagctaagtgacttgcccaggtgttccaaggtaggtggcagaggctcgatggtgcatttctttccctaccatgggcttgtcattggcttgctagaaggaattgcaaacttctaccctccagcaggagacaccctgggtttggttctccctgaggcctttccattgtgaggaaatcattccacccatcagtctggttgggaagcacccaaacagattctcttcaaaaagtcatttttgaagttatagtccaattttgactggttagagacaggtcagacctacttactttgctggctaagctttttttttttctttgcccctcaccacaagcctggacgggagacgtactgcttggtatctggtgcttgagaggtcccaggagataagggagcatttctgtgaaaggttttgccagagcctgtcargaacttaatcttgactgcaatgaatgacttaacattataagtgatctttgggtttaggtgcccaaataccagtccctccttartaagcagccttttagacctaaccttttctacctaaggttttgttcagtctttttgaaaagcaggaaggccaggtccttgtgaggcttttctcattacaagctcttggcaggttcttccctccaagtggagaacccttaccttccccattctttctaccttcccctctgatgatccagagggctgcaagggacctagagctgttcattggagccctagtcagctctagcggccagatctatggttaggtaatcctccaatagtgagactaattctcagtgttagaattaggggtctgcctgttctcaccagcagacccactggcatcaactctcctttgttgacatatagttaagcaccgcttcttacagatcctcatactcagagccaaccttgtcttgtctcataactcttgctactggcagaaggtgataaaattgtggcctagaggccaaatgttttttgtttggcttacagaattagattacttctcaacacatttattactttacaacattagattacttcttaacacacttatgcctgtagttacacataaaaatctggatgcttgactttttgaaagatgtgaacagtttagcaatactgtactgtctatcttcatgccatcaatttgttggatctgagtagatgctgcctaccccctcatccttgagtgggtgggggtgggggaggtgggacctcattgttcaggaatcctaccacacttggttgcctgtaccaggactccgaaggttctttcctctttgagacctttttctgaatgaacttatggtccacttttaaaatcctaaattttataaagccttaaccagtccaacctagtccgtttattgcattagatcagaggttgtcaaatggggcagttttttcctccctctacctcagggcattgggcatgcctggagtcttttgggttgtcatatggggaaggggtatgctattggcatctagcagtagaggccaggactggtgccgagcatcctgcagtgcacaggatagtccccataacaaaggatgatctggtccaaatgtcagtggtgctgagatcgaaaaaccctgatcragaagcttaatgtgagttattgtgtcattgtgtgtgtggattaatgatggactttaccctcactaagaattataggattcattaaaattttacactattctgacttattttcatgtcataaatatcaagcagtttacctttgctttcttagggctttgagttagagacaattggatggaagaactttacattataaactttcaatgaagcataaaatagcttcctcacattaagctttcaaatacgtatttgaggtaactgtcaaatttggtaaatgtctgggttaaattataataatttttttagtaaatattcttatgtaataatagtactattrtcagttgactgtcttgtatactgatatagcttttgctatattagtgataggtgaaaatcagttttctttcaacaagaaggtaatttagtgttttaatttgacttaaatgactagcaatttgaaatatatgtatttcttggaacactaggtggccttacaatcacaattatttttacaaggaactacatattaagtttttaaaaattttttgaaggttttttttttttttttttgagatggagtttcactcttgttgcctaggctggagtgcaatggcgcgatctcggytcaccgcaacctctgcctcccgggttcaagcgattcccgtgcctcagcctcccgagtagctgggattacaggcatgcgccaccgctcccagttaatttttttttttttttttttgtatttttagtagagacggggtttcaccgctcaggctgtgtcaaaccccccagctcaggkgatccacccacctcagcctcccaaagtgctgggattataggcgtgagccaccgtgcccagccgaagtattttttagtagtataaaaattgttaatgaacaaatgaaataaatcaacaaatgaacaaaatgggaataaaacatattaaataaaacatttgtgttctgcattttaaaaatcttataatagctgggcgccgtggctcactcctgtaatcccagcactttgggaggccgaggagggcagatcacgaggtcaggagatcgagaccatcttggctaacacggtgaaaccccgtctctactaaaaaatacaaaaaattagctgggcgtggtggcgggcgcctgtagtcccagctacttgggaggctgaggcaggagaatggcttgaacccgggaggcggagcttgcagtgagccgagatcgcgccactgcactccagcctgggagacggagggagactgcgtctcaaaaaaaaaaaaaaaaaaaaaaaaaaaaaaaaawatatatatatatatatatatatatatatatatatatatatatatatatatatawaacagtaatctattggggcaggggataaattgtgtccttgtttagaagaagactttttttttttttaraaraagccctgttgtttttgttgttgttatttgtttgtttgtttgttttgagacggagtctcagtgggtcgcccaggctggagtgcagtggcgcgatctctgctcacygcaacctcygcctcccgggttcaagcgattctcctgcctcagcctcctgagtagctgagactacaggcgcgtgccaccacgcctggctgatttttcgtattttttagtggagacggggtttcaccatattggccaggctggtctcgaactcctgacctcgtgatctgcctgccttggcctcccaaagtgctgggattgcaggcgtgagccatcatgcccggcccgaagccctgtattttgaaggtgaatgtttttgcttcttctctgatcagttactaaaagtgttttccctgtgccatttgagaattatttgagaactactctaagcttatggcacatttcagcatttttgttgtctaaaggcagctktattttaatcatgtaaatttcatgctgcctcctttgcctaccatatagcttctgttgaaatgtccatgttatattttattttatttactcatttttctatatccataataagagttaaaggttatattttagcaatgtgtttttttctctgtcataacatgttaaatattttaaattcagccatgatgttaaacagagtgaattggaatttctaacggatttcggcaggaatgattatataagacttagggccaaagagagcctgggtgactgtgtaggggtattaggctatgcccagcaccacatctggttgtcattcaggggagcagctagggctggaactgctggggagtgcaaactgcagtattccctgttcccttgtctcagagcagaattgtggcctctatccaggtccaatcccagttaaaaaaaaaattccaatggtctattcttcttttgagctatattattgtagagaatactgacttgaaaaaacaaagtcactaactagaaataaaatttgarctgggtgcagtggcttataactgtaatcccagcacttttgggaggccaaggtgggaggatcacttgagctcaggagttcaagatcagcctgggcaacatggcaaaatcccatctctacaaaaaatacaaaaattagctgaagtgtggtggtgtgcacctgtagttccagctacttgggaggctgaagtgggaggatggcttgagcccaggaggtggaggttgcagtgagctgtgattgcatcactgcactccagcctgggtgatagagccagaccctgtctcaaaaaataaaataaataaataaaaatcaaaataaataaaatttgaaaatcttgggtatgacttctttcttgtaccattcaacattcttgatgtttactaggccagtccaaataatctatttcttgtgtgcctgtttatgtcagttttttgtgacgtgtggagaagtggaactgggagtaaccaaatcagaatgaaggaagagctgtttgtgaatgtccatatgacaaatgacaaaactggttttccaagagggacagagcatgttcaagttgaacattgtatcatatatcataactgggcaaggttgagctattcagatatgtatttatggatgtaatttcatttacttgacatcctagtgtattgttgagaagttgtatgttggtaaattgatcatcttagttttgcaagaggttatactttctttcactctaataaggagactgcaggaggttatacttttagccttgtgttaaattctttgtaaagaaaattcttttgtgaattagaatataatttgtaagtttatactgaatttggagtgggattcattgatttatcattcaaccttatgtggatacgctgtggtcatcttactagtgcaggttgagcaaaaggtgtgtgcttgagtttgttcctgtaaaatttttcatgacagcacctggagagtggaaatgtgaaaaaagatgagcatcagcactttctagaagtgttggtctaagttttcatttatttactatatgattttgaatgccatcaactaatacattttcaattatccctgaaccctgtggctcagttagtgtcagtgggagtaagaaaagatccacgtgtccgggaacagtggctcacgcctgtaatcccagcactttgggaggttgagatgggtggatcacgaagtcaggagttcgagaccagcctgaccaacatggtgaaaccccatctctactaaaaatacaaaaattagccgggcgtggtggcacgtgcctgtaatctcagctactcaggagactgaggcagcagaatcgcttgaacccaggaggtggaggttgcagtgagcagatatcgcaccattgcactccagcctgggcaaaagcgagtccccatctcaaaaaaaaaaaaaaaraaagaaaaaagaaaaagattcacatctacttgaggcctggaaaattgytgggaagttcctgtacatattaaaccagataatgtccattcagtggtgtttttattttattttattttattttggagacagtcttgctctatcgtccaggctggagtgcaatggcaccatcatagctcactgcagcctcaacctcctgggctccagccatcctcctgccgcagcctcctgagtagctgggactacaggggcctgccaccactcccaactaattttttattctttgtagagatggggtctcactatgttgcccaggatagtcttaaactcctgttctaaagcaatcctcttgccttaggttcccaaagtactgagattacaggcatgaaccattgcctgctcctggccagtgtttttgatttaaaagagaaatacaggccgggtgcagtggctcacgcctgtaatcccagcactttgggaagctgaggtggggggatcacctgaggtcgggagttcgagaccagcctgaccaacatagagaatctccacgtttactagaaatacaaaattagccaggcttggtggcgcatgcctgtaatcctagctactcgggaggctgaggcaggagaatcgattgaacctgggaggtggaggttgtggtaagctgagatcgcaccattgcactccagcctgggcaatgagagcaaaacttggtctcaaaaaaaaagagaaatacaggccgggtgcagtggctcacgcctgtaatcccagcactttgggaggccgaggtcctagatcgcttgagcccaggaattcaagaccagcttgggcaatggtgaaacccatctctaccaaaagtacaaaaattagccaggtgtggtggcacagacctgtaaagtcccagctactcaggaggctggggcgaaaggatcgcttgagcccaggaggtcgaggctgcagtgagctttgattgtgccactgtactcccagcctgggtgacagagcgagaccctgtgttaataaacaaacaaacaaataaaagagaaatacatctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtatyacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcayattttatcattrgcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgygcccagccttaattttttgtatttttttgtagagttttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactartccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgytcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctstggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatrtgtgtgtgtgtatatatatatataataataattattattattattwttttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatytttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggmaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaacagaaagaaaaatgaaccagtagaccaatacccaagatatcttacggtgtagaacacagattagtaaactgtggcccgtatccaaatgctgcccagtttataaagagttaaaaaagcaatagcagcagctgctgtgacacggtatgtgtcccacaaagcctaaaatatacaccgtctgcccctctacagaaagtttgcagactcctggtataaaaaaaaagtgtccctaacctgttctggaataggatcttttttggatgatgtagtactcagccaccttcaaggagaaatcagcattcytttttttttttttttttttgagatggagtttcactcttgtcgcccaggctggagtgcaatggcacgatcttggctcactgcaacttctgcccccggggttcaagggattctcctgcctcagcttcccaagtagctgggattacaggtgcacaccatcatgactggctaatatttgtatttttagtatagatggggtttcaccatcttggccaggctagtctcgaactcctgaccttaggtgatctgcccgccttagcctcccaaagtgctgggattacaggcgtgagccaccatgcccggccagaatacacgttctttaaacattctttttgcatctagtctatcaatggttctataaccactttcccctataaaatgcctatactggccaagtgtggtggctcacacctacctagcactttggcaggctgaggcaggaggattgcttaagcccaggtgtttgagaccagcctgggcaatagagaaactccatttctacaaaaaatacaaaaattggctgtttgtggcagcgtgtactggtagtcctagcttcttgggaagctgaggtgggaggattgcttgagcctaggagttgcaggctgcagtgagccatgatcatgctactgtactctaggctgggtggcagagtaagaccctgtctcaaaaataataaataaataaataaaacctatactaagagtgactctttgaattggcttttagatgtcttttccaataaaactttgacatacgctcataactataactattaagttttctttctggaactggttgtagttttagtgttttagacaaactccttcagaaatattcaggccgaaaatagttacatgtaaaggaacaacaacagcgagagacttcagacttctcctgtgtgacattagatgccaaagacaacatctccgaaggaaaatgctgtcactccaaatcaggcaaggccagtcaagtgcaagggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgacatgagaggcacgaaaagtctagggaagcccctacgagaagcatctaatgtacttagatacaaataacccattaaaaaaaaaggtagaattcccctcaaaggactcttctggctcttgcaattcaaattagcaccacaaaactgagaactgtctgtataagggacaactgaagctaagattcaggccatgtcctgakatctgaggagagcgtccagtaatagcaccaatatgacaagctcagaaaatcctgtgttacaaaagccggcttctttctctgccatggtcctgttaaaaggagctgtgcttcagttgtctttgatatgaagggaccaccacctttccctctgtgataccctctgcaattytgggagaaacacaacttatggtagcatgtatcaaccttgagaaggagaaataccaaccactggagcatgaaacaatattagtacaataaaattttacaaataaatggttataatgataaactataaatatgttcatggtcaaagaaacagagggaacatagtgagacactgcatggtggttcaaaggatttagcctctgcactacaagtttctccctgtctctctcttttttttttaagagacaaggtctctctctgttgcccaggctgcccaggcatagtaccatgactcactgtgcactggtgcaatcatggaaaaactcttgacctcaagtaatcctcccaccttggcctcctgagtgctgggactacaggcaggcaccactatgcctggctaattttttgtaaagatgggggggtgtctcactatgttgcccaggctggtctcgaactcctgggctcaaacgatcctcctcccttggcctcccaaagtgcagggattatagacctgagttgctgcacccggcctcctctctgtgttggggccagcagattgccctttgtcttgcctggctgtttattctgtgtaaactagagggaggtccttccaccctcctttctattgtctgtgtggcggggccagggagctttccattgcccctgcgggtgggggaragggtgtggaatgtgccctctgggtgctcctgcctctcaggcatttttcttgcctgatgacagtttctcagccctccatactctgtttttctggtatggcagcagaaatcccacatgtttctagtaggcctgcagcatccttgcttagtttccagtgcagatgcagatatcctctactttctgtttggggtttggcagtgggaaccaggtgggccttgtttaggggaggggctgtaacaccatctgtgttcacataatccctcctgcccccacagcctccctatactcctgtaaaagttctctgcaacaagagtcgcatgattaaacatttcttttattaaaactaaaattgtagaagcttttctgtgcactttgcctttccctaatcatctgatttgcatgcatttattattctaggttggcaacagagatgattccaatctttatataaatgtgaagctgaaggctgctgaagaggtaacgccagaagagctgtgccatcaccctccccaacctccacctgggtcctatcgattaccccttgccctttttggtcctccctgtgaaaacttttatcacccacaggagacattagtttatctattttgtaagtcagaaatgggtgggttagatctgtggcctctggtttgcccgtgagtttttgttttctcattaatgattttcttcccaaagagcaggatgtcaattgaggaaagtgacaagtctcgatcattttaggagatttatttgccaaaattaaggacacacctgggagacaggtctatacctttctccgaagatgatttcgagttctccaaatttaaagaggaaagggtgggttattgaaaagtacacgttttcatgtaagaggtggrtagggaaaaatagtcattcatgaccttctctggctcagtgaatctgcattttttacataagatgacagatggccggacgcggtggctcacgccagtaatcccagcactttgggaggccgaggcgggcggatcacctgaggtcgggagttttagaccagcctaagaaacatggagaaaccccatctctactaaaaatacaaaaaattagcygggtgtggtggcgcatgcctgtaatcccagctactcgggaggctgaggcaggagaatcgcttgaacctgggaggcggaggttgtggtgagccaagatagtgccattgcactccagcctgggcaataagagtgaagctccaaccagaaaaaaaaaagacgatatagacaagtggggcagaggaaaaatgcaggcaatctgcattttacataagataacatagacagaattgggcaggggaaaaatcagatatacatttgtgtctggtgggctggggggatttacatygccatggtgaaattttaacagaaacatcataaagatgttgcarctcactacgaatttctttgtgggcaaaatatgggggaggcatgtagcttttcatcttgtaacatcttatttaggaaccaaaaagggggaggcagatttgcatgacccagttcccagcttggcttttccctttgacttaatgaatttggggtcccaagatttaatttcctttctcaagaaatagcaagcatgacattgctgaagtgcagtggtggcaattaacaagtgaatgatgaatgggttgaagtgagggactcattcttcagaacatataagggtgaaatgatgaccaacacctccttgcttgttagtcatgtctgtaaaagaaatggttcaatatctcaagttgtcttgccatttacctgcttttaatgtctgttttgcagattgggatcaaagccactcacattaagttaccaagaacaaccacagaatctgaggtgagcttttatgagttgattgtgaagagggaaggtgaagtggtttcctctctggttttggtttacgggggctttggggactgacacatttagccaagacctccaggtatttttttttttttttttttttgagacacagttttgctcatgtcacccaggctggagagcaatgatgcgatctcgactcyctgcaacctccgcctcccaggttcaagcaattctcctgcctcagcctcccgagtagctgggattacaggygcccaccgcctcacctggctaatttttatatttttaatagagacgcggtttcaccacgttggccaggctggtcttgaactcctgacctgaggtgatttacccgccttggcctcccaaagtgctgggattacaggcgtgagccaccacgcctggcacctccaggtattctttcttcacagactcccacagaggagatggtgcagggatgaacatttggtactcaaagtgtgactgcagtactgtttgcttccaaatcatctgttgtgtttgttaaaactgatccttggagccaggcacggtggctcatgcctgtaatcccagcattttgggaggccgaggtgggcagatcacctgaggtcgggagttcgagaccagcctggccaacatggagaaaccctgtctctactaaaaaatacaaaatttgccaggcgtggtggcgcatgcctgtaatcccagctacttggaaggttgaggcaggagaatcacttgaacccgggaggcggaggttgcagtgagccaagatcgtaccattgcactccaacctgggaaaaaagagcaaaactccgtctcaaaaaaataggtaaaaccgatccttggcctgtaattatctgcattctaaaaaccaaatatgtattccttttatatgaggttcaggactaggcagaacaaatcagcggtgattaaagtcagaactgtggttgcctgtaggtgggagattaatgctaaactgtaggaggataaagcaactttcttgaggttatggcaatgttccatatatgcgctgtccagtatgggagccactagccccatgaggctatttgaatttagttaaaatgaaataaaattaaaaattcacttccttggttgtactagccactttgcaaggattaagtagctgctattgtattgtaaggtgcaaattatagaaaatttctgccatcgcagaaaagatgattggacattgctgctctacatcttgatttggatgattgtaacatgggtattattgctgtaataagttattagagttcttagctctttttattttattgtattgtatttttagagacagggtctcactcttttgcctcagctgcagcacagtggtgtgatcatagctcattgtagcctcaacctcctaagctcaagtgatcctcccacctyagcctcttgagcagctgggactataggcatgagccaccatgcccagctaattttattttatttttgaggcagagttttactcttgtcgcccaggctagagtgcagtggtgcaatattggctyactgcaacctccacctcccaggttcaagcgattctcatgcctcagcctcctgagtagctgtgactacaggcatgcgccaccacgcccagctaatttttgtatttttarttgcccatattgcccaggctggtctcaaactactgacctcaagtgatctgcccactcaagcctcccaaagtgctgggattacaggcgtgagccaccgcacctgtccccgctttttttttttttttttttgagacagagtcttgctctgttgcccaggctggatgcagtggcatgatctcagctcactgcagcctcygcttcctgggttcaagcgattctcatgcctcagcctcctgagaggctgagattacaggcatgcgccactatgcccggcttattttttatatttttgtagagacagggtttcaccatgttggccaggctggtttcaaactcctggcttcaagtgatccagtagctgctattgtattgtaaggtgcaaattatagaaaataattttctatattttgggaggcctgccttggcttcccaaagtgctgggatgacaggtgtgagccaccacacccagccctaattttttttttttttttttgaggtggagtttcactattgttgcccaggctggagtgcaatggcacaatctcaactcacygctggagtgcagtggcactatctcagcgsactgcaacctccacctcccaggttcaagcaattctcctgcctcagcctcccgagtagctaggattacaggcatgtgccaccacacctggctaattttgtatttttagtagagacagggtttcactatgttggcccagctggtctcaaactcccaacctcaggtgatccacccacctcagcctcccaaagtgctggaattacagtcgtgaaccaccgcacccagcccctggccctaatttttaaaaagtttttgtagatatcacatttcactgtgttgtccaggctggtcttgaactcctgggttcaagtaatcctcctgacttggcctcccaaagtgctgggattacaggcatgagacacctcgcccagcctcttagctcttttatttgatggacttcttaccagacacctaggggatgcattctatgttaaagtacaggtgctctcaggattcaaggggaaggtacattctgaaaggactataattaaagtgttggggggaaatagggcaacctaatttttgccttagaaagtgtttcttcctaccttttgatttctgtgtgatatacaaattatatatggtattacttttaggtgatgaagtacattacatctttgaatgaagactctactgtacatgggttcttagtgcagctacctttagattcagagaattccattaacactgaagaagtgatcaatgctattgcacccgagaaggatgtggatgggtaagtgtggcttggcttcctatgtctcattgcatgctttcatttataatatgtttctatttggggaatacagcataaatgtttctaaagagtaaagacatctaattgcctttatttccttcttatttccatcacttttttaagattgactagcatcaatgctgggaracttgctagaggtgacctcaatgactgtttcattccttgtacgcctaagggatgcttggaactcatcaaagagacaggtaaaaacaacaaaccaaacaacaagaaagcaccatttcctgaatcctggtcttgacatgtggtggcatagaggaggtacattgtgggccataaataaatggacttgattggcagaagggcctgtctactaaggatgttacctaaattttctctcaattttctcagcaactctgtgaagtaggtactgttattgttcaactgctaagaaaataggctcaggccaggcacagcggctcatgcctgttatcccagcactttgggaggctgaagcgggctgagatcacctgaggtcaggaattcgagaccagcctggtcaacatggtgaaaccctgtctctactaaaaatacaaaaaaattatccaggcagggtggcatgcacctgtattcccagctattcgggaggcagaggtgggaggattgattgaacctgggaggcggaggttgcagtgagccgagatcacctgactgcactccagcctgggcaacagagcgagactctgtctctaaaayaaacaaacaaacaaacaaacaaacaaaaccagctcagagagagcaagtaacttgtctgggagacaacggaaccaagatttgaattcagagttatctgagttcaaagcaatttattttaacctatacagtaataaaaatttggatagtttaaaaggatatgaagtgaaaagccccacctccccccacccccaaaatgggcactgaatctccacagtagttccaggactcgacagatggctggaaatgggtctcctgcacagttggccatattgtcccgttactagttagcaccttgctattttaatttcattatgaatacttttagcagaggttattttttacaaggaaatgggtcctggtaaaaagaagtaggtcagaagtttcaagtggaaagttttggccagcataaatgaaaattttctgtggttggcaagaaaaggtcaaaggtcaagctttgacagttcatttctacagttaaatgtatattcttcagcatatttagcaaacattgtagtgccttgcttaaaagaaaaaaatcccacgaggacagcacctgaaggcctcccactgcctcttattgagtgatgctaccatttgccctgatgcagctttaactcttctgctgaatcctaaaaagtatagaaagttaccttttaaaactttgaggtctttacttctagatgttcatgatgttcacattattataagagtttatctttttctgaaaaaaaatgattttatgcgagaagcacaatttaaacccttgctgctttgagcaagggtccactgccctcagccttgactgccctgaggactctgatgaagtcgtcaacttctctctgctttcttctttgtggacagctcattttcgggctccactttgtggccacaaacacctacagcctggttccatcctcatgcctaacagtcatgggattggatcttatcagctgagggaagaaatatggtcccctgtccactactgggtactcactcaggctgtctttagtagagtatgagtcagccctgaaaaggacattggtatattgccagaaaaatggatgctgtgatagcaaaaagaaagctttgctgccacagttcaatttcccctttatcacttccctgcaagtaaccctatggctcaggccctaagccaaaagagaaatttgggtgaggaactgtataaacaaacttaccaaagttagaaggaattaccgatactaatctaatttcttacacatctctccagcctgttacatacaccctatttgttttaactttttttccccatgtaatttaatctgatgtcttcttccgtatggctgattagctgtatgtcagggtttcttttttctttgagtgtaggttttcttcccactcccctatgactcaatgaatgatcttggcttaagctgctcccaaaaacccacggccagaaggacacaagtacaagtcccaatttatagctgaaaccctagagttgagaatattattgccaaagaaggaatgcttttaggaaggtttctgtttgatgttaagaacctgtttttgtgcacttattctaatttctccacgtggcatgcgaaggagggcagcttctatcctccaactctgatgcaggctggcttttctttcaggggtgcygattgccggaaggcatgctgtggtggttgggcgcagtaaaatagttggggccccgatgcatgacttgcttctgtggaacaatgccacagtgaccacctgccactccaagactgcccatctggatgaggaggtagggtgtccagaggagaggtaaaggtgttacggtggggagggtgggtgtgccagaggctgccatgtcctttacactcatgacctcatttaaccccatcatctcatttttacaagatgaaaaaacaaattcaaattaaaggctgagtggggtggctgacacctgtagtcccaacactttgggagtctgaggcaggaggattgtttgagcccaagagtttttgagaccagcctgggcaacatagtgagacgctttctctgcaaaaaaaattaaaaattagccagatggggtgggcacatgcctgtagtcccagctactcgggaggttgaggcaagaggattgcttgagcccaggaggtcgaggctgcagtaagctacgatcacaccactgcactccagcctgggctacagagcaagaccctgtctcaaaaaaaaaaaaaaattaattaattaaaaaaaacataaaattaaaagcatgctgaagtttatacagagtttgttctgtgtactttctctcttcctttttcttttttctttatttattttttttgagatggagtttcactcttgttgcccaggctggagtgcaatggcgcaatctcagctcaccacaacctctgcctcctgggttcaagtgattctcctgcctcagcctcctgagtagctgggattacaggcatgtgccaccacgcctggctaattttgtatttttagtagagacaaggtttctccatgttggtcaggccggtcttgaactcctgacctcaggtgatccacctgccttggcctcccaaagtactgggattacaggcatgagccaccatgcccgacctttgtcttttttcttttgagacagggtcttgctctgttatttaggctagagtgcagtggcagtccatgagagcccactgcagctttgaactcctgggctcgagtgatcctcctgcatcaaccttctgagtagctgggactacaggcatgtgccaccatgcctggctaatttttaagctttttgtagcgacaggggtctyactgtgttgcccaggctggactcaaactcctggactcaagcgatcctcctggttcaccttcctaaagtgctgagattacaggcgtgacccaacatgcctggcctctcaccaagtactttctaccctaatctgcctcgtggtggacagggattagcagtacaggcactcagattgacctctggcagccagatcccatgtgtgtaaaagtggtggcctcagagtgaaggtgctccagaggcagtcgtgggcagtagtctgctaatagctatggcagcttgttctagatccctgcatcagattcctgagcccaagaatgcgcacacacacacgtgcctgttgacagtgcagtctcttaaatgtggggagagagcaggagagaggcctagtactttctcttttaatcctcccaaagtagtgctctacattctgtaggagaaggagcagtgtctggacataacacgcagggccccaagcctgtttgcccctctgccttgcaggttgacactgatttccctattgggtaaaatggctggtgaaagggagctctttggcatgtgtagaaatgagcacggcatgtgaagggctgtcagaaacagtgtgtggcttacatttgaggccttaacccaatatcttatgaaatagcttaygacasttaagaatttaatacaaagctcagggatatccttttcatttctgggtttttttttggtgtgtatttcattatttcatttctgatgtccaaatcccctacccctaggtaaataaaggtgacatcctggtggttgcaactggtcagcctgaaatggttaaaggggagtggatcaaacctggggcaatagtcatcgactgtggaatcaattatgtcccaggtgagtgttgttggaggagtaaggtggctgctggtattgaggatggtatctaggtcatcaaaagaagcctgagagagaagcttgtctcattttatgcttgtagtactaaggtttaggagactgactagcccaagrgtgcacagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagaggractcattctgccaagaggagggctttacaaagaagatatttgacctgggtttttttctaggctgagaggataaatctagccttttaatcatgtccaaaactgtactcggcatcctcatccccaagttacccctwactcccgtcttttggttagtatcaccattcttccttcccgcaagtctgaagccttttagtttccctcccaagcattccctatattggaccagtctctaaatattaggaattgttttctctctcctctgttctgagtgtcaccactgagtgttaccttctcagctgatgggctgtgataacttccttgcaggtgtccctccctccagctgcttcccactcagatctatccccgtgctctcgccttgccacgttcaccttctggcatggaactctgagcctcttccttcttacttgccagactccttagcctcacactaatttcagtgacctctgcagcctgtgatctcacttgcgcatggtgaatacctgtcttcaacttgtaaagtggaccactttcccttccctgcgcatgcctcgtttgccctttgtagttccctcacctgcattcttagtggagtgggctactctttcaaacagaaaacttcacagaacaatagggcaaaacttgcgtacgtcctcatagatccaagaaaggaacaatctttaacggagcaactactgtgtatccagcacaatgccaggccttgggctacacaactgaataaggttcaacttcaccttcaccttcagctgcttcctccccatstcctctctgtcatgtctgttattccttccaaaccttgtttgatttccccttatcaagggatgatctttccttctctccctccctcctctcccatagaacatgtgtattgtatcttttgttgcatgtgtctcatgtacggcgtcctgtgctctcctgcctagatagctcctcaagggcagtggtcactgtggcgccacatccagcttcctgccatctgaccactggcactcatatctattgaattgtygaagggagttatagctggaagtcttttttctcccttcccatctcaagtttcagatgtagacgctgagctgccaggaacattagtcactgtcaagccttcaccgtttttaacctccctcccactctccctaccgtgcttttaagacagtrgctcataattgatcactcattttcttgtagtgtaattatctaacaggcgataaagaaattgctctcctacaactcctcactttgaatacttgcgatatgacattcaagctcagtctttttatttatttatttttttaattttttttttttttcttgagayggagtctcgctctgttgcccaggctggagtgctgtggcgcgatctcggctcactgcaagctccgccttgcgggttcatgccattctcccgcctccgcctcccgagtagctgggactacaggcgcccgccaccacgcccggctaattttttttgtatttttagtagagayggggtttcaccatgtyagccaggatggtctcgatctcctgacctcgtgatccgcccacctttgcctcccaaagtgctgggattacaggcgtgagccaccgcacccagcaagctcagtctttttaaaacctcgcatcttctgtatcatatttctgcttttggcattttttttttggattacatgtgagaaatggagaagaaaaacctgagtggggatcttgagtgttgcagataggtaggaaatgttgacttaaacatgaaacttgccatccttttcacattgattccttatgtagacaataaaatatgaataaaatcaaagcagtatcttcccttctggtcaacagtgtttttactgatcttgggcatataggcaaattaatgctgatacagctggatgttattgtgttccccaaaggatggcagaatcactcagttacagaccagcaaatgggctgcaggacctaaagactgatatttgcaaatgttcactttagaagcaaacttttctaccaccgagctacttcttggttcatattttgattatttaaatagtttgcatggtccactcagggataacattgtaagtcacttgccaaattaagaatgaatcaaggtgtgtataccttttacaaagaagtaatatttttaaagattcaagtgcagggcagaaagtattggccagagaaacacataaaagtgctcttcctgcttggcttactaaagataaattgagaagggccagatcaatagtgttttatttggaagggttaaaaagtgggaacagattccccaccctaatgcaatccagtctcaacctatccagtgtagctgcttctggactggcctctattattagggtccccaaattaaatgtagaagagtcagggctcagctggatctttagttgatttttgtacatgtgatttcccaaagaaagagaaattctagggctgggggtagataaccaaaaggtttgctcattactgaggtcatatgcttaggctgagtagtggtcactttttccactgaccacatcatcctatccacgaagcactgcatgtttagcagtgtctcgtcaaccctgacagtatttggtttaggagcaaaactgaactcaccagtgctgcgtttagtcatgtagtcaaagatatgtgtctcttacctgtgggaaaacgaaaatgactaacattaacacgtagaaatagatgcagcgggtatttcaagctaactacagtgtgaagacgattgaaacttgtacagagggcaaacctctatctatatttccttggcattttgaaatgactctaggggctgtaagaggaaatgttctgccagtttgctgctttataatcttctagaaacttgaaaccatcccaatgagttgtgttgaccagctccttttactccatataaaaaatatcttacgtatctgtggtggaaagagaaactcttgcgtttggaggctgctttttcaatttcagtaatgtacacattttctcattttgccctcagcaaatttgtgataggtagtgttaagccttctttgcattttggacttcagattaatatggagcccacaggagctgcagaactaacttttttttttgagacggagtttcgctcttgttgcccaggctggagtggaatgctcactgcagcctccgcctcccgggttcaagtgagtctcctgcytcagcctctgagcagctgggattacaggtgcccgctaccaagcccagctgattttttaatatttttagtagagacggggtttcaccatgctggccaggctggtctcggactcctgacctcaggtgatccacccgccttggcctcccaaagtgctggcattacaggtgtgagccaccacacctggccctaatttttaataaaagagctgatgctacagctaatctcttttttttytgagacagagtctcgctctgttgcccaggctggagtgcagtgacgcaatctccgctcactgcaagctccgccccccgggttcatgccattctcctgcctcagcctcccaagtagctgggactacaggtgcccgccaccatgcccagctaatttttttgtatttttagcagagacggggtttcaytgtgttagccaggatggtcttgatctcctgatctggtgatccgcccgcctcggcctcccaaagtgcctgctaatctcttaattctggcttcttgcctccaccttggagcttcttctcagttgtggcgatctgatcagagagaagtggtgatgtcgctaaaactaccagatgcagcgcgggagccttattgcttcgaggtctaggcccgcccccagcccctcctggaagtgcactgaagccaagtgtaggatgttctttgtgtgagtgagcaatgatgcatcattgggttttgttctcttgaatagctattctttgctggtaagatttgtagttgttcttgtgtccttttaagggaagtgtaattatattctttgcctttagcatacatttaagtagctgtgtctttggaattggatgttgaattgttcctccagctcacacatggagctcacaaaatgctgacagttgctgtagaaacgatatctggcagctgtgacagagttggatctttgtgcacccaaaaaatttcctttgtaggctttagcaaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcwccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagrtgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaagtgattctcctgcctcagcctcctgagtagctgggattacaggtgtgcaccaccacgcccggcgaattttgtatttttagtagagacaggtttctccacgttggttaggctggtctggaactcccgacctcaggtgatccgcccaccttggccttccaaagtgctgggattagaggtgtgagccaccgtgcccggcctgttttccctttctaacatgcaccagctgacaggggccaggcgagcagccccaaagcatgttaggtgcctcttgactcttagctaggattgaagcatggtaataagtrggtctgaagcagttcattttgtgattgaactggagtgacctggagcttgaaactgaggtgaggattaaaataaccacctcttctaagtttcatttatttcattttgcttagagcacagtagagagtgccaagcrtttcctggagaaatttaagccaggaaagtggatgattcagtataacaaccttaacctcaagacacctgttccaaggtaaaaataaagttttactgatttaaaactttgtgaattgttggtttttagttgacagatactgtgggttcacatatgctccctctgaaggtgccttcagtggttggggttgggttgggggcttgttactactgtgggattaattaaactcagtggataaacattaatacctattttctatgtttccaaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactgggtatgctttttattcatgttgccatccaaatcttagtatcagtcctgatactaaggcgttgcatttgcacttggcacatgtatgtagaggtgcctttaatttgattttagcattttcacccgtatttgatctcatttgatccttacagcaatcctgagaggtaggtaagaatagattataatcatagatgagaaaattggtcaaggttatccatctagtaagtggaagagtttggtcttaaaacccggtcttaagatagaatcaccttttgctgttgttgttgttgttgttgttttgagacagagtctcgctctgttgcccaggctggagtgcagtggcacgatctcggctcaccacaacctctgtctcccaagttcaagcggttctcctgcctcagcctcccgagtagctgggactacaggtgcaaggcaccacacccagctaatttttgtatttttagtagagagtgtgtttcactatgttggccaggctggtctcgaactcctgaccttgtgatccacccacctcagcctcccaaagtgctgggattacaggcgtgagccaccacacccggccagaatcacctttttgaacccaaaattcattaattcgatggatttactaagcattcatttttattgctgggctgaggttatattaaaaagctagtttttgagaatataaaatgagaaattaaaattatagccgtgtctctacaagataaagtatatttgcttcttacagcaagaagagctaaaatacaggaatcattttttttcttaaagttttttggaaattacaactaagacttttgaaaaagatatctttcagggcttttgtctttctttttctttgtcttttctttctttttttttctttaagagatgggggtttgctctgttgcccaggctggagtacagtggtgcagtcatagcttactgtagcctggaactcctgggctcaagtgatcctcttgcctcagcctcctatatagctgggactacaggcatacactgctatgcctgactttgtctttcttaatctttagattacgagtcattctctaggatctgctaggtatgacttagtgattcagatacacttaattctttaaacctttttctcttttgctttcgtcttgaagaataactccaacacccctgggagaagggaaaagcacaactacaatcgggctagtgcaagcccttggtgcccatctctaccagaatgtctttgcgtgtgtgcgacagccttctcagggccccacctttggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtagtcatgcttttgatgaaggctgtcattggatytccccagctcctgctgtcactgttggccactgcacagggattctctgggatgggtgatatgtagctggaggtgcttttatttgaccctcatagtccactgctacagtaaccataaaggtaatcatagctactgatcatcttacagacactctagagacaatgacaaaccccacagatgtttcaccttgttgggaataagaaaagcctacctttattgaatatatgctttgtgccagatattgtgctgagcagtttttgcatattattctatcatccagtacgagatagtattgtcaccattttaaaatagcagcaactgggacttcagaggtggcttggtcaaaggcacctgtattaagtaccagagtgattcttccatgtctatttcaagctctaaattactaccatactcgcactttaccttcagatttttattgctgcggtactaagaacatgtgtttttttttttttttttttttttttgagacagggtctcactcactctgtcgcccaggctggaatgcagtggtgtgatctcggctcattgcaacctctccaccttctgggttcaagagactctcctgccacagcctcccgagtagctgggattacaggcacgcatgaccatgcctggctaatttttgtatttttggtagagacggggtttcaccattttggccaggctggtcttgaacttctgacctcaagtgatctgcctgtctcagccttccaaactggtaggactataggcatgagccaccgtgccaagctgctgtcttaattaaaataatktttattaattatgataggttcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagcaattctcctgcctcagcctcccaagtagctgggactacaggtgcgtgccaccatgcctggctaatttttgtgtttttagtagagatggggtttcactatattggccaggctggtcttgaactcctgaccttgtgatctgcccaccttggcctcccaatgtgctgggataataggcatgagccaccgtgcccagcccacccttccacctattttataaatgtaatcactttgttctgctcttgagcttgtcttaaccccctttcaacttcagcacgagctattccttgttctgcttattgaacccattattttccttttactcttactgcaaattgcctcactgcacggtctctgcctcacaaaaacaaaatacatattaatatatctctgggstgggtgmagtggctcatgcctaaaatcccagcactttgggagggtgaggtggtagattacttgaggccaggagttcgagaccagccaggccaacatggcaaaccccgtctctattaaaaacacaaaaattagctgggcatggtggtatgtgcctgtaatcccagaccattaccctccagcctgtgagacagtatgagactctgtctaaaaaaatatatatctgatttacatttattgcactgataatgtggtaacctggactttttttgtttgtttgtttgttttttttgagacagagtcttgctctgtctggagtcccagctcaggctggagtgcagtggcatgatcataactcactgcagccttgatctcccaggctaggactataggcatgagcagccatgcttggtgtcctgaacattttcaactggcttttggctaatacagattgagcatcagaaatctagaaacctgaaatctgaaaggctccaaaattctaaactttttgagtgctgacacgatgctcaaaggacatgctcattggatcatttcagattttaaatcctggatttgggatgctggatcagtatgatgaaaatattccaaaatctggaaaacaaaaacccaaatccaaaacccaaatccaagcattttaaataagggatactcaacctgtaatccaagtagcccaaaaaaatctagcaattaggctgctttctaacagcctaatctatttatctctatttaggaaaaattatagtctttttgttaggtgtatgtattttaaatatttctgttttaaaagccaaagtagctttatgagagtaggaaattgaacaggttgcctttatgtaactgtcagctgggtgttttaacaaatgccagtaattacaaggaacatatttctaaagataatgagtaggtatatatttgttcatggttttgtcatttaaactcagatttcaattgagagactagtattagaaaacacttgatcaaaactgtccaaatgattstaaaaaataaataaataaatgtgcttagtagttacaataatgcatttgcatttatttgatttctaagtcattggagaagcatgcttaactgagcttccacccttgacctgtcccctaggtggcgctgcaggaggcggctactcccaggtcattcctatggaagaggtaaagtattctgggatttggctgaattagatccccctttttttgtcgggggggagggtgctgaattagctccctttttttccccatgacggagtcttgctctgttgcccagagctggagtgcaatggcgcaatctcggctcactgcaacctctgcctcccaggttcaagcaactctcctgcgtcagcctcccgagtagctgggattacaggcatgcaccaccacgctcagctaattttgtatttttagtagagacggggtttcaccgtgttggccaagctggtcttgaactcctgacctcgtgatccgcccacctcggcctcccaaagtgctggtattataggcgtgagccaccgcacccagcctagattctttattatagctttttctctctggagattagccttttttgtagagctcttagcggacaaatgacttgtttctcagcaaaagcaacacctagggggaaaacaacttaatttgcagacttgtgatacagcttggtttcaaactttggctttcagtgggaatgattattataagcaaatgaccaaatgaagcatggtatcgggaagcaccaacacacagcgatttcagaattcatttatgtaactgcagaaattggaacattacatagacatagagtcggtgctgctcccgtgcactcctcctcrctgttttgaggtgtgtcctcagtaacccagtgtggctgttgatcccagtggtgtggtatttgtggtctctggacatctcattttggaaaaactgcaagttctgtatttgggaggagattcttctgtggacagataattagtcttttatgttttctttttctttttctttttcttttttttttttttttaagacagagtctcactctgtcacccaggctggagtgtagtggtgtgatcttgggtcactgcaacctccacctcccaagttctcctgcctcagccttccaagtagctgggattacaggtgcgcactaccacacttggctactttttatgtttttagtagagatggggtttcgccatgttgcccagggtggtcttgaactcctggcctgaagtgatccgcccgcctcggcctcccaaagtgctggtattatagttgtgagctaccacacccagccagtcatttatgttttcaagaactccctatattgggtgtttgtccactaactgggctgccttcagtattccattggctttaaaatagggattgagctttgcaatagaatgaaagttggaaagatacagagcagctgggagactaatgtggcttctgttcttttgtagtttaatctccacctcacaggtgacatccatgccatcactgcagctaataacctcgttgctgcggccattgatgctcggatatttcatgaactgacccagacagacaaggtaggatgccaaagccccatgaaccccattgaacagttttgaaagtattgaaccatctgaattagtgttggtgtcttgggtgctgaggatgcaggtagcaargcartggggctcctctcattttaaagcccctttcttttctttaaggctctctttaatcgtttggtgccatcagtaaatggagtgagaaggttctctgacatccaaatccgaaggttaaaggtaagctttttttcttccacattttttatattgtatggaatctggaatctgatcattgattaggacataaaagtcttcttggagtagcctattttagatgaagttacrtcagyaatcatagtcttaaagtcatgatatacatagcaaagatggatggtagaggttatttctcatttatctatagattagaagtggctagtgtggaataaatagaacactgacaacctgccctcagctaagaaagaaacgacacttcctttataacatgaacaagagtcaggatgtcactgtggcggcatagcagcctttggagtttgcatcattgggaccttaagcaaatttgttaaatgacttgtttctccgcttacttgtctgtaaaataatacttgccttgccctgaatagataagggtctgtgttaaacagttaaaaccatagttatatctatattttatttgaatttctgtaacaaatacmtagttagtaagcatacaccataccacctgacccagaaatctcacccaaaataaatgaaaactctgttcacataaaaatctgtacattaatgtttttagcagctctattaataatttccaaaaactgggaactaatctaaatgtctttcattggatgaataaataaacaaactggtacatccatccaataaaaataaatgagctattgatacaagcaacaacttggatgaatttcagtggcattatgctgggtgaaagaagccagtctcaaaagcttgcatattgcatgcctccatttatatgatattctcaataagagaaaactatagtgctagggaacagatcaatagatgttaagggtatggatgaagggagggtatgaccataaaggaacagcaaaggagaggtgttttgttttgttttttgttttcttttttgagacagcgtctctctctgtaacccggctggagtgcagaggcacaatcacagctcactatagcttccaccttccaggttcaagcaatcctctcatcttagcctcctgagcacctgggactataggtacacacaccaccacacctggctaattttttattttatttttttgtagagaccgtgtctcaccatattgtccaggctggtctcaaactcctggtctaaagcgatggtcctgcctcagcctcccaaagtgttgggattactggcgtgagccaccacgtctggccacaagggattttttgtttttgtttttctgttttttaatttttcaaaaatttattggttggttgkttgtttgtttgtttaagacagagtctcactctatctcccaggctggagtgcaatggtgtgatctcagctcactgcaacctccacctctcaggttcaagcagttctcctgcctcagcctgaatagctggggttacaggtgcctgccaccatgcccagctaattttggtatttttagtagagagaaggtttcatcatgttggccaggctggtctcgaactcctgacctcaggtgacccacccgccttggcctctcaaagtgctgggattacaggcgtgagccactgtacccggcctgtttgtttatgtttttgagaaaagcttttactctgtcacccaggctggagtgccgtggtgcaatcacatcttactacagcctcaacctccaggactcaagtgattctcccacctcacccaactaggtagctgagactacagccaggtaccaccatgcccagatttttatatattgtgtagagaccgggttttgccgtgttgcccaggctgatctcaagcttctgggctcaagcaatctgcctaccttggcataccaaagtgctgggattacttgcatgaaccactgagctcagcattttttttttttttttttttttaagagatgaggaggccaggcgtggtggctcatacctgtaatcccagaacgttgggaagctgaggcaggtggatcacctgaggttgggagtttgagaccagcctgaccaacatggagaaaccccatctctactaaaaatacaaaattagctgggcatggtggtgcacgcctgtagccccagctactcgagaggctgacacaagagaatcgcytgaacctgggaggcggaggttgcagtgagctgaggatgccccactgcactccagcctgggtgacagacagagactgtctcaaaaaaaattgggtktgtgttttacaacacttcttggtcactatgatactatgattatttaggtctaggcttagggaaatcttctggtgctcagttatagggacaaacatgttaataatacctttgtacatgtgtgagtaatgtgaatttgcagatatcgggataaaatcacttttgtcagacccagaaaaaacagggctgggaaaacatgaagaagaggaggcttacacttacgtgtctgtgataagaactgtttgcaaggcctgtaatcccagcactttgggaggccaaggcaggaggatgacttgagcccagcagttcgagaccagcctgagcaatgaagcaaaacctcgtctctacaaaaaaatttaaaaacgagccaggtgtggtggcatgcacctgtagttatacccagctactcgggaggctaaggcaggagcatcccttgaacccagaagttcaaggttgcagtgagctatcattgggccactataatctagcctaagtgacagaatgagacctcatctcaaaaaaacaaaagcaaaaattgtttccaacaactttataaaaccccaaaagaaatcccttcacgtccttcacacatctcctgctttgcacagcttgcacatttcaaatgtatacttatgtttccatgacaagacttatcactagacattcttcaggatgggagtaattcagataagatgctcttgaaagtacacttatccagcaacggcaactgcaccaatgaattgacaactctggctttgagcttctgggagcgatgaattctgttttttttttttttttgagacagggtcttgctctgtcacccaggctgtagtgcagtggcacaatcatggctcactgcagccttgacctgaactctctaagcagactacgtgaagctctccctcttttcttttttttttttttttttttttttttgagatggagtctcacccaggctggagtgcagtggcgtgatcttggcttactgcaacctctacctcctgggttcaagcagttctgctgtctcagcctcccaagtagctgggattatagtcacccaccaccatgcccagctaatttttgtattttttagtagagacagggtttcaccgtgttggccaggctggtctcaaactcctgacctcaggtgatctgcccatctcagcttcccatagtgctgggattacaggctcagccacaggctgagcttcacgcctagctgaagctctccttctttgctagtaaaatcttcccttccctcactaggcatatttrtggcatcccaggttataatcctcgttgctcattcctgaataaactcaacctayttggagataattttttgtaatgtctttcttyaggctgacagtagraaataacccccagctttcagtttttccttctgaatttaagatggtttgcatttcctagaggggatcccatttagaggtaggggtcaaaatttttgtcttacgtttattgtgcttctgtttgtcttattttatgttttcattttcctacactttcagagactaggcattgaaaagactgaccctaccacactgacagatgaagagataaacagatttgcaagattggacattgatccagaaaccataacttggcaaagaggtaccagagcagtatacaagccccgtttgttttggctatattgcacaccctacaccctccagaagagttgttaaaatgtgaggctcagaagcttccatgttggyattttaccagctaaggcatgaccaagatggtgacattatttctttttcttgccacctctctcagtatctctccttattagctatcatcaaatctctttgttggattggtcgaacattttgctggctattcagtgttgactgaaattagggtagttaaaccaaaaatcacattttacaaatttaattttatgcaaaaagttttagtgtcatgaagtagagaaattatgtttaatcacttcttgaatcatgtgtgacctttattcttagaactcttgtgtggcataaatgacttgatttttttctgtagttctctagcttacctaatctttttttttttgagatggagtctcgctctgtcgcccaggctagagtgcagtggcacagtatcggctcactgcaagctctgcctcccaggttcacgccattctcctgcctcagcctcccgagtaactgggactacaggcacccgccatcatgcccggctaattttttgtatttttagtagagacagggtttcaccatgttagctaggatggtctcaatctcctgacctcatgatccgcccacctcaggctcccaaagtgctgggattacaggcatgagccaccgcacccggcctacctaatcatttttttacctcattttattaaattctcttatagcatattaggtagccttcaaggtttaaatacttaccagttcagtaagtaggtttcctggcttcactgccatatgctacttttctcaatgcacaactagtgtagcttagatttcactttgcatcaacaatgcaaccttctattctgtatcactattgagaaagaatcttcatccactcatgcagaatagagctgaaggccagtttattgactgtttttgtgattttccttgactcaataaccgttgctagctaatggccttatttagatgacactctcaatgtctaaaaccacaytggaatttctcttcctttgcttcaatagctttagacaaatggtataatattttataaggaataagctaaaagtccattttgaagatttagtatccgatttacttttcttttgcttcgtgtctcattcatgttttctaagcaactagaggcagtcatacctattgactagctattttttacagaaatattagttacatgaaacctgatacttttttcttttgaaaaataagggttggctttaacaacacattacagcaagagtggggggtgtgtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacatcttgaaaaaaaamcccacaaaatatataggcaaatttgtactctgtgagcttctcacatccttacactgcttcaccaatctctaagatgaaaaactctgttctaaaacatattcagccatcagcaatgatgttattagtaggaatatggatcaatttaattttgtgtttctttgatattgtttggcatttgatactgaaatggcaactcctgtttcctctctatactcatagtactctcagcacctcacttctgacaccagatgggtagtttttctcttccacaacaattcagctttcacttctccagtggatattgactgagtatcctatgatttaactcaattctgacactaactgtctggagcagatcctacaggtaaagggctcagtcctaaaagactgccccacttcagacaygaatcgcaagtccaggttgtcacctgtgcttctgaccaactggttataaactggagggtccccacaaccccctgctcaggttcatttgctagaatggctcacagaactcagagaagcatttcayttgtgtttatggtttattataaaggatacagctcagaaacaaccagatggaagagaagcgtagggggcatcactctcccagcacctggatgtgttcaccagcccagaggctcatcaaatcatgttgttcaagagttttttttttgagacggagttttgttcttgttgccyaggctagagtgcaayggagtgatctcagctcactgcaacctctgcttcccgggttcaagcgattctcctgcctcagcctcctgagaagctgggattacaggcatgcaccaccacacccggctaattttgtatttttagtagcgacagggtttttccatgttggtcaggctggcctcgaacttttgacctcaggtgatctgcccaccttggccccccaaagtgctgggatttacaggcgtgagccactgtgcccggcctgttcaagagttttatacacccctaacaccttacccagaggttggtgggtgggactgaaagttccagccctctaatcatttggtctttttggtgaccattcctttcctgaggctgtctaggagacctaccataagtaacttattaccataaactcaggtgtgatcaaaaggagtttgtaatgaataacaagacactcctatcacccttggaattccaagagctctgtgagccttttgtcaggaacccatgacaaaggtcaaatatatttcctattacactacacataccaaaagccagaactgagggtacactaaaatgttaacagtagttagtcctgggaggtcgttagttggttagttgcttggtctttgccatgttttttgtggttatataattggatagatattctgtcatcagaataaaaattctctctgctaagtgtgctatgtttcctaaatttccagaccaggcctggcacccagcgtgtttcaaaagatatttgcacttgccctgatttgatggctcctgcatttcttacggtggtggaaagtcaatgagtcatcatcccacagaacaacaacacaaacctcagtcttttgaaaaaatgtagactgctctgtttttcttatatgtggaatatgctttaaaatagattccagatttctagttaactgtttgaattctctagatgggataaaaccaagccattccacattcctttgctgtaaaaataactcctgtgtatttatggtatatgaacatcatttcttaactttaacacatattctagctttgccatccattttgaaatattgatagacaatcatgaaattagacttattgctttaaaactctgctgcttcctttaactttgtggtccttttactcaaaatcgttctatatcttgcctgtctgctgtagtgttggataccaatgatagattcctgaggaagatcacgattggacaggctccaacggagaagggtcacacacggacggtaacaatttgtccctttccaaggaaattagttcagaggcactagatcttgctgcttctctcctcctccatcctctctcatacgaytgatactgccaggtgttgttctgccttctcccttttaaaatggaagtgagtaggtgtgtggcattgagcactcctgacagcttttgcaataaatcccatgtgtcacctgtgtgtttttcccccggcattttttcctggaggtggagagccccaagtgaatatccttgcatagaaattgattaaaattgcttcttttttgtggccatttcactgtatatctccttggtttaagaggtaccatattattcccttgtatatgaaagaaacaataagcgcatgattataagcggccttcatagggataaaatcatagctttttggtcctactataacatttattttaaaaaactgacaactcagggctgggcgtggtggctcacgcctgtaatcccagcactttgggaggccgaggcgggcggatcacttgaggtcaggagttcgagatcagcccggccaaaccccatctctactaaaaaaatacaaaaactagctgggcatggtggcacgygcctgtaatcccagctacttgggaggctgaggcgcgaaaattgcctgaacccaggaggtggatgttgcattgagccaagattgtgccactgcactccagcctgggcracagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagaggatcacttttgcaattcacacttctggtttaacacaaagtttttgctagtacctcttttccctgcccacaggcccagtttgatatctctgtggccagtgaaattatggctgtcctggctctcaccacttctctagaagacatgagagagagactgggcaaaatggtggtggcatccagtaagaaaggagagcccgtcagtgccgaagatctggtgggtacccagacacgccaggcttggcgacatatctgtgtctgttgtcctagggtctttcagcagttattaataacaaaatgtaatgctgtacttaagacattgcaattaattcatcaatttaatcctattttgctaattacaagataattatgaaatgtttaaaaagtacatcagagtgaataatagctggtatgctttagtaatagatcacaagttccagatgatttgagtaacatcttcatcctgtgggcatctctaaaagtgggtgtatgacttcaatttgcagagaacatcaagagtaccattgctttatctttgttgctaggtagttcagctacactttgatggcttaatagagtgacctgatgttaaaagttggtattgaactcttgcgtaatattgcagtttcagctttggaagacacatattgagtttggtatttatagaaatttctgcccagataccagagttacaaataactgagtactctgggaacgagcattgtcgtgctctaaaatagtctagaatggatttctcacatcagtcagcagctgagcttgattaagatgcttgtttctagagttacatgtttttccagatattacatgtgaatgtcatttgtattctatctggcaactttggccaggcgtggtggctcatgcctgtaatccyarcactttgggaggctgaggcgggwggatcacaaggtcaggagwttgagaccatcctggctaacacaatgaaaccctgtctctactaaaaatacaaaaaaattagcygggcatagtggcgggtgcctgtagtcccagctactcgggaggctgaggcaggagaatggcgtgaacctgggaggtggagcttgcagtgagccgagattgcaccactgcactccagcctgggcaacrcagccagactccgtctcaaaaaataaataatttaataattggcaacttcatagcatatccagaaaaaaaccatgaatggtccaattcaggtgaaagtatcarttggtccaagatggctaacatgggtaagcctagaatgtcaaatattggtttcagaaggttgggtttttttgctggtgggagttgatgctgcacacatttgttttgtagggggtgagtggtgcactgacagtgcttatgaaggacgcaatcaagcccaatctcatgcagacactggaggtgagcagagtgactcctgccttcttgaaytggttttggacagtcagagcagastggttataaagcacacttgcaaggcgcggtggctcacacctgtaatcccagcactttgggaggccaaggtgggyrgatcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccrgatcgcactcaagcttgttggcccagaagggtttgtaggttagtgttttttgcaaaaccagtgaatagactgtatgtttcttttaacatcaggggarttgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcrgcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcatccctctgtatagtgacactggcaaccagccaaccaaaccagttagctgagacagaggtcagccccttcttgagtatactgttcatgctggacagggcctccacaccctagggagggagtgggggagaggagaatggcagatctgcccagggctgccctgggtaacagagaaacaggtggagactggctcatcctcacctccagcctgaattttgtatttctctgaattcctactgcttagaaattcctactactttttatcctagtattttaacaccttttctttagggcctacatgaaaagacatggtgctaggttttctgaaatcatttgaaaaactattaaattcctgtccaccaggagcttgtattataacttaggaaataaggactccctggcctacaggataaaaatcaaatttgttttggtcagggtttgtcctaatgtagcagttctctgttttggcctcagaacctctttacactcttgacagttattgagagcctaaaagagtttttgttcatatgggttatagctattgatatttaccatattagaaattaaaactgagttacatgtaaacataaagaactttgtaaacatgaaaatgcattatcttttcccagcaaaatttaggcattgtacatttttcagatcttctctgggtctggcttaattgaagacagcacttgatctgttgtgacatcacatgtctcataacctttggaaaagtccattatatgctcaatgagagaatgataatgagagtaaaagggccataagatgttacagaatcttatggaaatagttttgacttcatggaccccttcaaaggattgggtccccggagcacactgggaatgctgccataacaaccccagcacccctatccagtcttagttatccctgagtgccaaaggcactcccaacccagcacactcctttctgctagtagcacaggatagactcccttttttttcccagtcacaactaacattcctctctcttacacccctcactcaccctcacaccatcacacctcctttccttgcttcctcctgacctcacagtcaggataatgtcccataatgctgtgcatggaggggaacatttgcacatatggctctgtcaagagagtaggcctcctgctctcattagcttgctgacgggaagctacctgtaaggtccttgcttcttgctctgcctccacacagccccttctggagttggagcacatagtctcactgcaatggaagagggcagagcttcttaatcactatccactgcccatggtggggcccatgaaatggacaccttcacccatttgctcatttctgtggatgcarcagggctgagccacggcatagatcaagactgggggctggggggcggggcggggaggcaccagacacctccatcctttagatatactctacaaaagagaaagaaaatccttctgtattgttttccctcttgtttgtattgaccctgcaccacggttcagctccaccaatgctaggttggcactgtggaccagttcatgaaaccatggcagggctcatcacgggctctatcgacagacatcccagggtgacttccgcaggcccgaccgcttcctctttccccacactccccttgacttccaaccccactgctatggccttcactcgagtcactgcacctgcttggtacacccctttccacctctcctgccatcgatccggtccttctcacctccttaattcaggtcatagaggtcttccacgctgcccaaagcagtcgattttgttctgtgctgtgtgattggtcacataccctaagtccttagggcaggaaataatcttatactactgtacagcctgcaarcattgcagcgtcttgcctttaacacatraaaagcaccattttaagctaggagatttaaataggaaatgcctctgactctgtttcttttccttccaggtcactgctggactgcctcttcccaaggcttacatacaggaggtaacctgagttatttctcatcacrtgtcctagaaagcaccacaccttgaatcagcatttctccacctggcccatgtggaaatgaatgggttattgctgtgacccagggygcagggtgccaaaaggcctgcagtgtgctgaggagttatattaaatgagtagatagggaagatgyacctcacaaaatagaattgtcccacatagggtgtcaataagccactgccctagaccagtggttgattctcaacagctgattttgaccccggggacatttggcaatgtctagagactttttttattattacaactggaggtggggagtgctactggaatctagtgggtagaaactggggatgctggctaaacatcctttaatgcacaggacagcccctacaacattatccagctcaaatgtcggagtgtgaggctgagaaaccctgtcctagactaatagcagttcccttccattgtcttccctgcattggctgggtaagttccaaatgccattcagatcagaagcaagtagagaccttttttgaaatggcttctcctctgccgatttaaatccatattaacgggccaagatatatggtcaggattctggttgtttttctagacaaagcttcctggatatttatagcatcaaacaggaggctagagaacaactgtgagctcaaatcttttcatatttatgtcatttaccatcaaagaaacatctctaaagccagtttggggtggttacaggaaagacaggccatcagataaggtggcaaggtcacctgctgtcactgctaattcaatttttctgcctttttggaaggcttttaaattatcaagcaatacagggtcactgttcaggccccaaatgaagtatttcaaaactggctagaaaaaattgctggtaccttcagtctgcctgtcttctgagttatggtttgccttttatggtcatttgtctgattcacgcgtaggaggggaattcacagttctggccctcctgccaccccacagcctttcctgtgtctaattacagtgactgcccctagctggcccagctggtgtcttcatttaagaaattctacttatttaaaactgttcttgatcagcgttacatattaattggttttcatgtgactagaggtaaagaattagcagtgttctttagaagctcaaataaatcataatctcagttttcaattattaaaggaaaaaagcataaatcacatttataatgaacctagttgttttccaccttttatcctacctatttctgcttttttgggatcaacaaacattagtgctgggttttgctcgatgattcagtatatgtatttttatagaagactcttttatttttaaaatatttaatgtattgttaagcctacaatagtaatataccctttgtaaaaaataataattaaacattataagaatgtaatatatgtgagttgagtccccttaacagttcggtgcatatttctcgacatttaaaaatttttcatgaattatatacatgtatttttgtgtttgtcctaaaatggaataattaagctctccatggttttgcacctttagtacatcttggacaggttccatgttaacacagatgggtctcactttcataacatctgcatgataaatatttattgagtgtatatrtcataattcattggcccagtcccccttggaggaggtttatgtttataattttccaatgctacaagcagggctgcagtaaacatacttaaagatacatttccttaattgcttccctttagtttgtagtacttggtttttggtgggtttttttgttttgttttgytttgagatggagtctggctctattacccaggctggagtgcagtggtgtgatctcggctcactgcaagctccgcctcctgggttcacaccattctcctgcctcagcctcccaagaagctgcgactacaagcacccaccatcatgtccggctaatttttttgtatttttagttgagacggggtttcaccgtgttagccaggatggtctcgatctcctgacctcgtgttccacccgcctcggcctcccaaagtgctgggattacaggcatgagccaccacgcccagccggtttttggggttttttttacagacagggtctcactctgtcacctaggctggactgcagaggcgtgatcatagctgcagcctctaactcttgggcttaagcagtctcccygcttcaacctcccaactagctggaagaacaggaacacgccaccacaccaggctaattttttaattttttgtagagacggggtctccctatgttgcccaggcaggctgctgtcgaactcctaggtgcaagtgatcctccgatctcagcctcgcaaagtactgggattacaggtgtgagctaccacatccagctcagttctttttttttttttttttttttttttgagacagagtcttgctctgtcaccaggctggagtgcagtggtgcaatttcaactcactgcaacctccgcctctggggttcaagtgattctcctccctcagcctcccaagcagctgggactacaggttcctgccaccacacctagttaatttttatatttttaatagatacggggtttcaccatgttggccagtatagtcttaatctcttgaccttgtgatccacctgcctcggccccccaaagtgctgggatgacaggcrtaagccaccaggtccggccctttttttttttttttttttaattaacttctcagttgtagagatggggtcttgttatgtttcctaggcttgtctcaaactcctgggctcaagtggattctcctgcctcagcctcccaaagtcctgggattacaagtgtgagccactgggcccagccactggcctgattcctaaagatagtatttatcttatttcttgccctcgttcacggtcgagttcattaaaacctttgaaaacatcactgcttacttcatatttcctggcagtatttacggcagccatataacgaatacctcttctgtgccagccactatgttgttaggctctgtcttctgatggaagggtctgtgctgtgcagagtagagtyaatttgtattatcataaccctatgaatacataaaatctataaacacaattggtaaatataatttgggtaagggtaactaattcctttcaaacrgcaaataagctataatgatgtggcataatgacaggaaacataccagctctttttttcttgaaggctgggaaacaagcagagctctactctagtgtcataggctggagtgaaagctgcagttctccatagcatccactcaccgcactggaaaaaatgcaccaagggaccttctctcttctttcttggcctccttgtcctgatagtgagtggctgctggctcaaggaggttgtttgcctttgaagaagaacctgcagtggttttcaactctctgatctcataggcctttcactgttgtttttacagaacctggagctggttgaaaaaggcttcagtaacttgaagaaacaaattgaaaatgccagaatgtttggaattccagtagtagtggccgtgaatgcattcaagtaagtgtagagtgtaagcgaaaaggatgaatgtggaaaatctcctggagctgattgtacagcactgcttttagctttattttgtttttcagttactgctattggttatagcctgtggttttagcctgcactgtgacaggcattgcrtacgtcactgcgggctcaccacctcacccactgagggtcccaaagtcagattcagctcctatgggcccttttcctttccactgggggaagtaacacacaagcctgaagttcaatgttcctttttcatctttagaggccttttatgctaacagaaggtcataggcctatagtgttccattattttactagatctggtgggatgttgtcttgacaaagaattgggcatattactctggaaggggtcatgcaagaacttgtgtgggttgtttaggtattgcattggtggtcagggttttgttataatggcctcaccgtagtagaatgggaagcaaaaaatcttttttttttttttgggggacgaagtctgtctctgttgcccaggctggagtgcagtggcacgatctccactcgctgcaagctctgcctcccgggttcatgccattctcctgcctcagcctccctagtagctgggactacaggtgcctgccaccatgcccagctaattttttgtatttttagtagagacggggtttcaccgtgttagccaggatggtctcgatctcctgacctcgtgattctcccacctcggcctcccaaagtgttgggattacaagtgtgagccaccgcgcccagccagcaaaattcttaaatgctagtatttactgattccttctggagtgctgggaattttccaagtattttacatggatttaccatctgagtctcataacgtcccaatgaaataagtgctgtgattattcgcgtattaccagggtggaaattgaggcacataaagattaggtaactggccaaaagtcaccagctagtaagtttcggagctgagattcaaacccaggccaaatttcttggttagtgttcgtttatcagtgggtaattcacatgaggtttaatggcaaaaagaagacaattctgtctctccagccattttccatgctttgatatgaaatgcttcctttataggayggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaaggtgggtgatttgctgtctgcaaaaaaagaaaaaagacgaaaagggcacagtgaagtttctgtgtggctacttctattagagccccwtgcttcgcagcttcagccttgcggtttgattcccacgtaggtgacttacacaaccacagcctggactcccagctgtagacagccttctttttatttttgagacggagtcttgctcttttgcccaggctcgagtgcagaggcatgatctcagctcactgcaacctctgcctcctgggttcaagtgattctcctgcctcagcttcccaagtagctgggattacaggcgtctgccaccgtgcccagctaatttttcttatttttttagtagagayggggtttcaccatcttggccaggctggtctcgaactcctgacctcgtgatccacctgccttggcctcccaaagtgctggaattacaggcgtgagccactgcgtccgcccagacagccttcttataaacatatgccactgcttacttacagaggggatttaagcaggaataccccagggtggagggggaaccgttgctcatatcctaacttcgaaaagggtcaaagtacaggtggcagaagagaaggttacatatagaccaaatatgtaattcactgtagcctttaaaacaaggcaccaaccatgtagcagattggtaaggggctgcatcgagcttacaaaatttttctgatggcttttcagtaataggggaaagaagtgtgcccccacgttcacttcctggtaaggtgctgcctcaagttgagggccctcacatgcaaaaccaaagtactccaggaagcttcatcattttttccatcactaagcaaattaaattacacctggtctaagtagagccctgcttactctatgatacaataaagttagttcaggaaaaggttcttattatagggttgtgttttgttttcatttatctgtccagtgtatttcaggatgtgatttgacattaagtagtatggaaacaacaactggaaactttgttaggaatatgagatatatgctgtagttaatttttcctattctctaggctagtttctggcttgatttttttgttttgttttttgttttaagacagggtcttgctctgttgctcaggctggagtgcagtggtacaatcatggcacactgcagcctcaacctcctggacccaagtggtcctcccacctcagccccctgagtaggtgggaccacagacatgtactaccaagcctggctaatttgttttattggccaggcacagtggctcacccctgtaaccccagcactttgggaggccgaggtgggtggatcacctaaggtcaagagttggagaccagcctggccaacatggtgaaaccccatctctactaaaaatacaaaaaattagctgggtgtggtggcaggcacctgtaatcccagctacttggaaggctgaggcaggagaatcgcttgaacccgggaggcggacgttgcaatgagctgagatcactgcactctagcctgggcaacaagtgcgaaacttcgtctcaaaaaaaaaattttgttttattttattttatttttcttgtagtgactgggtctccctatattgctcaggctggtctcgaactcctgggttcaagtgatcctcctgcctcagcctcccaaagtgctgggattataggcatgagccaatgtgcctggcctggcttggtttttaatagataatcatagactttcaaaaacagccataaaaaagcagaaggaataaacttattactcttgagttttagtgttctcttatttctctttgccccttgcagatataatacacttacagttaattaacattgacattgacattctcctgttgagctttgattttataggcaagttttaaaatctgttcagcaatcatccttttagaaaaatgccataaacacaaatttgcacacaaatgcaaagcatttataggcaccctctccaggctccaatgcatagcacccaaggctggaagcccagtccttgaaaaccagcaggagacctgaaagagcagggacatatggactttagaacccrtttctacttgcaacttttatccattctggcaaacaggaggctgccactttttgtcttactcagcgtctgctagtcttaaatcacccttcaaccaaagtgcttttgcttcagaagttctaaatgtgycttggcatttatagagctccagttatgagatgcatatgaaaataatctgtgtttcatctttataaagtccttattgaatgttcactttattcatgcccattatataaagccccttcataaattatcattgtttagttcaaaagggaatttttgtttttatagatagattattgctccttttaaaaacaaaacttggctgggcgctgtggtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgacaggactgatctccagtattagaatagaacatctactttttaatttttattattattttaaaatttttattttttaaagagacagagtgttgctatgttgcccaggctggtttcaaactcctgggctcaagtgatcctcctgccttggcctcctcccaaagtgctgggattacagggatgagccaccatacccagcctgaacatctactttttatttatgaagaaataattattcttgggtagtcagcaacactgtttatgatgtacttagcgagagattttaaatatgtacttatgtaagtatatatttaaaaccttaatatatattaatatgtgtatctatatctatatatatatgtatgtgtgtatatgtatatctgcatatatagatataaaaactttacctctgtgggacattttcacttataaaatctgaggcttgatattaaaagaaagtgttcctggctgggtgcagtggctcacacctgtaatcccagcactttgggaggccaaggctggcagatcacctgargttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcrcaatctctgggtcctcccagccctgccaartacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaacacacatggaaaagaaaccaacatacatccttttggatttatgtcattctttcagtatagtaagaaagtggtaggaggtggcattatagagttgaaaacgtaggacattagagctgaattcattttcacctcttcagatcttggccttgggcaaattatgaaaggtgagagccctgctgccctcagctcacactgtaggcaacatcatcacatcacagtggtgcttagcacaaatgcctgcatctcactgcctccttagctctctatagagagcagaaggcttagacttgctatgatgtacatcagtctccaggatttgtagaaatcccttgtggtaggaattttccaccatttttacccagcaccttgaatagtgcagaaatatgtgttgttctttttggagaagttgtcagcagctaccagctgaaagacgggtagctgtactctttcttgtcacttttgatcttcacatgaagaaaagggtaacagtagaggtgaaagcaaatctggaagcagtcaggccagtgagagtcaggctgtaaggtggagagagacacagcctgccgaactcaagactttctcatttagaacaaagtatgtgtcagaggcttttaactttaagttggaccaaggcgtttccacacatgatcaaatggtttaatcactattctaacaccttccagttgccgttggggccttaacragactcagattatttgaatattttctatattaattcaaagtgtgatggcttattttcagaactttatatctaggttcatacatgtgcgtacacataatattgtctttttttgtattttttctgattatcagtgaccagtgtttaggagggaaaatcctcttggggaatgagtgaaaatatcaaaaatcctactcatcactgtttagggaaccatctttagggttttctgctgacatgcacatgcccgtctacaacaatgggcatgtgtcttttatctttataatgtcatcttccggtttttctgctgtgtctaaggacccatcctttcctctctcctacttgtctcacacctagcacctccttacctcttacacaatataagaatataaaccagttgtcagatccctataatgtgttttggggaatattgattggtactcagaagtcagtcagaatgaggttttctaaagtattgatgatgttttgtgttacagaagatgactctttttaaataacctttttatagttaagttttagaagtaacctaagctgttttcctgtctagatttgatttggaacttgtgtgtattcattatataggacattgttacagataaaaatatacggagttttcacttgcaagccgtacatatttgcatctaagtagaaatttgtcaaagccgagtctttagaaaagtagtgagtacaaatataatttgtaagcattacaagtttagttttagaaggccattttgggccagtaagaatggtgattataaaaccatctagattatgtacaaaagtgtcttggcccaagttaaaggatactaactcctaccatcgtgttgctgaagcaaaaatcacatgggcagctcagctagcaagactgaacgaaacaaaatttaaaagcagrcaagccctgtacctccttttggtcttgcaaagcgtgagctgaggaggcgagtgagcaactcctctactccccagcactcattcttgtaaggtgaaggtggaaacacctcctgctactgcttgtgaccacatggaagatgatagtgaaggctggcatttggtttgcagaaggacatgaggaatcagtttcttttcttttccttttttttttttttgagatggagtcttgctctgtcacccaggctggagtgcagtggcaagatctcggctcactgcaacctccgcctcccaggttcaagcgattctcctgcctcagcctcccaagtagctgggattacaggcacacgccaccatgcccagctaatttttgtatttttagtagagatggggtttcaccatgttggtcaggctggtctcaaattcctgacctcaggtgatccatctgccttggcctcccagagtgctaggattataggcatgagccaccacgcccggcagggatcagtttctgagttttttaacaggatcagtgacttgatttttaatatgtaacaagagtacccactttattgacaactataaaatgatgttctatctttatgccttgggctttctttctgaaggaaaagtgaaagtaaagatgactttacgtttattttagacatggccttgctctgtcgcccaggcaatcggatgatcatggctcactgtggcctcaacctcctagcctcaagcaatcctcctgccttagcatcccaagtagctggaactacaggcacatgccatcatatccagctaattktttatttcctgtagagatgggggtctcactatgttgcccagggtggtttagaactcctggcctcaagtgatcctctccayctcagcctgggattataggcgtgagccactgtgcccagcattagtttatttgtaatgcttttttacatcctagatgagcacaatgcctggactccccacccggccctgtttttatgatattgatttggaccytgaaacagaacaggtgaatggattattctaaacaggtaagttgttactgggtaataatttggcttttttcctcatgtagcttatttatgaattatagggctcaaactgacgctataaaaattcacattctaatgctttcaaaacatttcttttcagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagaggttagactccctctgctgaagccccaggaggcttggggttcagagttgatgacacattgcaggtcaggaacagctgacggtctgtatactctgaataggtagttagaaggcaagaattagcaaatgtcttaggaagtataatagaaaagagaaggaaacaggaccaatctggcagttcttagggccttaggtgaaagggccctgagtaccgactgcaatgagtgacattgcattgtttgatatttttgaaatttcaacaggacgtgtctctccttaggcagacccttggggctgaagcagcaagttgcagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagcyagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgttaacagctttggcaatgtgagtgggtaatggtgcagtatggaaggaacaggaaacatttcagtgcttagagaaaacatttatttcttgtttttccttccagatcaccatccatcttcaagaagctactttraaagtctggccagtgtctattcaggcccactgggagttaggaagtataagtaagccaagagaagtcagcccctgyccagaagatctgaaactaatagtaggagtttccccagamgtcattttcagccttaattctcatcatgtataaattaacataaatcatgcatgtctgtttactttagtgacgttccacagaataaaaggaaacaagtttgccatcttggtgttgcaatatgaattacagccttaacagactgtgccacaggtctctgccatcctttgtgagctcatttgtcaggcagacccttgggctgaagatgcaagttgcagtgtgccctttatgatactgttgtgtttagagggaaatgtatgcatgcttgtgtatttctgagaggacacataattcaggggacctcctgagagggttgggttggaagttgatgacttaccttttaatcttatacctttctatattgttgaattttgtttttctaccctgaggaagtattgcttatacaagtttttgcctgaacttccttggaattcccatttctgtcacagctttagcactgtctatgtttagagtgctcaagaaggatggtcatgcagcattagccttaggtgagcctctattctgttggtgcagcaagtattcattgagtttcttctaaatgcctgggctccacccttccctacagactttttatttttatttttatttttttgagacagtgtctctgtcgcccaggctggagtgcagtggcgcgatctcagctcactgcaacctccgtctcctgggttcaagtgattctcctgcctcagcctcccaagtagctgggattataggcatgagccaccatacctggcccagactttctttttcstaaaacattaggttggtaaaaaccacaattacttttgcaccaacctaatattttttttcctcctcttctggctgggcgtggaggtggctcatgcctgtaatcccagcactttgggaggccgaggtgggcggatcacttgaggtctggggttcaagaccagcttggccaacatggtaaaaccctgtttctaccaaaaatacaaaaattagctgggtgtggtggcaggcacctataaccccaggtacttgggaggctgaggtacgagaattgcttgaacccaggaggcagaggttgcagtgagccaggatcatgctgctgcactccagcctgggagacagagctagactctgtctaaaaaaataaatcaaatatttttccttctcttcttgttctttatcttctatctctgttcttcctctcccatttgtttccttccctttttccccttgtctccctccactggatccttccagaggatgctgcatcccactggcgccagtgctaaacactgctgatgttggcaaagcagtatttttcccagtgaccttggttttattatttttaattccctaggtccrtgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagagtcgtgctcttttgcccaggctgcagtgtagtgacgtgatctcagctcactgcaacctctgcctcccgggttcaagcgattctccsacctcagcctcccgagtagctgggattacaggttcgcaccaccatgcctggctaattttttgtattttcagtatagatggggttttgccatgttggccaggctggtctcaaactcctggcctcaagtgatcctcccacctcggcctcccaaagtgctgggattacaggcgtgagccactgtgcccgaccgctttctggtacatttcttaatgtcctgtgaaacttcacctggaatgggatttgctgggaattcattttgtagacaagggaaggatgcagtcttgtcagatatggtgacttaaggatcatcttaaaggatttaggtttcctaatatcgccaacagccacatgggtttaaatcctcaatactggtaggggctgggcatggtagctcacacctgtaatcccaccacactcagctgagttttgaagttctgttttttgtagagatggggtctcactgtcttgtccaggctgctgaggcaggaggatcacttgagcccaggagttcaagactaacctggacaagacagaccccatctctacaaaaaacaaaaccccaaaactcagctgagtgtgtggtgcacgcttgtagtcctagctccttgggagtctgatgtgagaggtttgcttgagcctaggagttcgaggccgcagtgagctatgactgagccaccgcattccagcctgagcaacagagcaagaccctgtgtcaaaataaaaaagacctatagaagcattagtgcttggggtaactattagcatgtgctggcagagaaggtctagtgcctttaccttggtgctaagagtccctccagattagtggctttcccgtgccctttctcttctctgggctgctaawgccttccttccccttattagtaatattactgataaacaaattgtacattctctgatctcacttcagaggctgtttctgtgcactgaagatgtacacacagtcttaattcaaaagagatagcatttatgtgctgccacattaaacagattgcaacagtattactattgagtttgtgttggctctgtgcaaccctcatggtgcccaggaacagatgaaaccaccagagacttggagcctcaggttcattcaatggtgtcccagggaacggggttggagggcttattcccagaaggcctctgaaatgtaagagctattaacaaggagttataagtcatttttggtagctataggcccaggcaatgggtagagaycaagatgggataaatggtaagatcagtagagtattgctcagataaatatgtaagctattttactggcacactgtatctagtgatattaacatgataagctataggtaggataatttctcatcagattgcagaaatacatttatagcctatttcctgttatataatgaaaagctactaatggggtagtagacaatgatatgggtaatagcttaaacagccttcgttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctcaaactgcctttcagttcccttttactaattttgtttaaaagaaaggcaagtgaaggccaggcatgggggctcacacctgtaatcctagcactgtaggaggtcaaggcaggaggatcacttgagctcaggagttcaagaccagcctgggcaacatagggagacgccatctctacaaaaaaaaaaaaaagaagaagaacctgggcatgtggtcgcatacctgtggtcccagctgcatgggaggctgaggtgggaggattgcttgagccagggattgtaccactgcactccagcctgagcaagaccctgtctcaaataaaaataaaaataagacagctattttaccctgtcttcacctaaataagctcatcttattttttgcctgaaactcttgcaaactcccaggtctgctagttttgagaaaccttggatctcaataaggaatagttctcaattgcttatragcataatggatttcttttggcttaaagttcaaaactggcaacaagcagcgctagcaacccatagagagatacgcagaccatttcgatagacgtgtttgctgagtgaacaaggctgactgaatttttttttttttttgaggcagggtctcactttgttgcccaggctggcgtgcagtggtgcagtagtggctcacagcagccttgaccttctgggcccaagtgatcctcccttctcagcctcctgagctcctgagtaactgggaccatacgtgcaccaccatgcccagctaattttttagatttttttgtctccctatgttgcccaggctggtctcaaactcttggactcaagccatcctcctgccttggcctcccaaagtgctgggattacaggtgtgagctactgcgcccatccctgaattcttaattacaactaaactagatgcttatggattttcctgttttacaactcttgcctcttttatctgtaattttaagatcttgacagcttatatttggctttgcttttgtgtctcaagagttctttccttgataagcctctgtggaaactacagaatcttacaaatataaaacatttccggaaaaaatacaaaaatggacacctgacatttacactccctaaggtcgtgatcctgttgaagaaaggagatgaacgcggctgcttttcagtagttcttcacttcaccttaccaggttcttcatctggatgctatgctatgggggccagaggaggaggctgggattgtgatggatcstactagattttacagctggagctcccaggaatgccctcatagggaatgtcctgaagggaatcatgggtaacttgtaagctacctcaacttatttttggaactatgtaaggtataagatggatggagctgggttcctgtgcctttctcaccttgtccgcatagagatgcagctgctcctgcaggccaaagttctgcaccaatcacctccacctgcttcccactgggagacaaaggtttgaaagcctgtttggcgatgaaccacgatgatctgacactcaagccactcctgagaaagtcgggtttctttctgtttccatttatatatgtaattttcgcttcaaacaaacatgacctcgctattctatgcacagttttgaatcctgcttttaaaatgcgatgtctgccttgtctttaaatattctgagggggaggagaggagatgtgtaatgcgactgtctataatttgaaaccggacctcactatttagcgtctcagaaaacgcggggttcattgccctggtcccccccgccttcccccgccccccgaaccttccggctggctctcttgcggtccccgcctcggcgctgatgtggtctggcagtggagattggcgcccgggcggagcacgatgggcttccccgcggcaggcaggcaggctgctgctgcaggtgggtcccggcgcccgcgccgccccgcgcctccsgcggtcgccccgcccctgcccgcccgctccgctccgctcgcattggcgctgcctgctgtctgtccccgcgcggtggggagggggcgcacccggcggcgggctctgcagagggcgccttgctccgggtgcgaccgcggctccctggaggcctgggcggcgggccccgcgagcgcgccgccacctcgggagcagtgttggccaaggaccccgacgccctacgtaagtaaaggcagggcggggagcctgcgggggaggagggtcgggggcaatgtccggtccgcggaccgcggagtgggcaagaggtgcccactggatacggggtatccgagccctctgaggtgctgggagtaagaacgcgggaggtcgcttgtccgctggaatccgcggccagggcgaccctcatcaggtctgcccacctatccccttcgcgttacagcttgtcttagaagcatgggttgccggtggcttttttccttctttatccctctttgagaaatgtgattttgggtttctggccattacattataattctgcagacagcctgaagctgggttatctgttccacgcccccggcattttcctttttgagtactttatcctgcgctctgtctcctgccataaggggcgtcaagccagaattcgagattccttc

SEQ ID NO: 13367 - DNA, 18394 bp, Homo sapiens
ccctagtgtccaaggacggtgaagggtcgggtgtcaccaacacctgcagccttctcaccgggcgaggcttgggttgtgggaagtgggggacagctggccctggtccccagccctgatggacatccggcattttgctggtgcaggctgtcctgaagccagaccctcccgagactgctgtctgggaggagagcgagccagcggcccagatgccttggtcgyggggaggtgcctgtgtgtaccgtgagtttcccagcctccggcggcaagtgggaaagccggtacaggaagagtggtgcctgcaggtgctcccggtcaccaccaccccttccagacrccatccccagagctcacatctgtgctggctggagggtcagggctccactctgcccgacaagcagtctggtgcaggggacgcaaatgtcagacccagcagggcccggcacttggagaagtgccacatgccaccctggtggcctccgggcaccccactgtccacgtgtctgagcatggagctgtccatctggggcattggccttgaacaccaaggacctgccccggtttgccaggcacatctgaacacaaggtcaggaggttagaacaggacaagagaaacgcctggaggcctcctcacaaggcatcctgctctttggggaaaatttctccccagcagaaatggggatttacaagttttacaggtccttgtcatttccgtgaaggaaaacaaagcaaagacagttacgagttctggwgagcttcccactgagctgggcgacagagttcaggtctccaagtgcygggccctgctgggtgtgacatttgcgtcccctgcaccagactgcttgtcgggcagagtggagccctgaccctccagccagcacagatgtggacgaggggcgcagctggaccccagaggagagttcgatccatctgcaggaagtcctgatggtcccagttttctttgatggccacatctggacttgcctgtgtgtaaagtggacacaaaagacggggcccctgccgtggccgagaacgtggcggtggctcctgctgcttgccaggcagcacgggagctgggtctccctcggacccctcaaaagatggttcctcaccgtcttctacaggctgatgtaaaatttctgtgaggcgaaagccacatttgccagctctgggtacgaagttcacttcacagtcggtccttcgcttggtgagctttgggagccaggctgccgtggccagatgtttaggagcacgacggtggctctgcagagggcgatggtgtgcagccgggctttcctgtcgcccacaccttgcaggccctcacccctccccgtgccttcacccagctsctcctccagtgccattcatcccagcaggcagcaaggacatggcagctgagaaaagatgccagcagaacgcacttattttataatatttaacaactgtcagtgccaaactgcattaacacagtcatcctcagatttttcagagggctgtgtacacatctgtgaaaataaatgttaacctctaagatttgaatgaagattctctgaagatgggcagcaggtgacctttgttttacactgagcaatttttcaccatctcagccgctctggccattttgaaaagggctacaaatctgctaaggatgagtcctcatgcctggttatcagaagtttggaccgcgtgttcctgaggattggccaagcaaatggctcatttccaaaaactgccctgtggagagggggctgggggacactcgtgacacctgtcgggcggcacatgtgatgggtggagcacccaggttctccaagcagcaggaggctctgatggacccccctcccctggcggggggacgctactgctagaagcagcgaagggcccggtgccccaggtttcagctgcctgccttctgccgtaagttgccccagcaccttcgtgcttttcaggagcgtaagctgagcagactcagtcgtcccagtggtcagtgtggctggggcagagggacacacggtccacaagaygtccatgctctcggaatgctccaggggtttggctgtggggctccaccaccattgcctgagcccggagccagaggctcctcccacactgcctggtctgccccacagagcatcagtgccacgccaggtgaggacagcgctcaccagacaaccaggcctgccgccccactgacgctgacttccggacctgcagaactgtgagaaagtacgtttcgcttctttgtaaactgcctggtcagtggtggcagcacagatggaccgacgtggacctcgacgcgaatggcgggctctgggcgctgacccggtggcggcgtagctcaccgaacacccagggggaccagaactctctgccttccactcagttgtgacttgtctatttttaaaatgttaaaaaaaaaaaaacccacaaggtgcagtggctcacacctgtaatcccagcactttgggaggttgaggcgggtggatcgctcaagctcaggagttcgagaccaacctggcccacatggtgaaaccctgtctctaataaaaatacaaaaattaaccgggtctggtgacacatgcctgtaatcccagctactcaggaggctgaggtaggagaactgcttgaactcaggaggcgggggctgcaatgagytgagatcaagccactgcactccagcctatgggatagagtgagattccatctcaaaaaaaaaaaaaaaaaaaagtttaaaaaaccctacccctgccaaatgcttttccgaagtagccgtgccattggtgtttccaactttgcctggcaccttccatygtttgctaagttccagcaggtgtatttcatttgcatttccctcatgaataatggtgttgagcagcttgccatggtgcctttgcygcctgtgacctctttggtgaaacatccggaggtgtcttctgcccacgtggaggcgcagcctgggctctgccgcccacctttcacccgaggagcctgcagcacgtggagagcatcagggtgtgctttcttyacagtttggggcttttttgagacagggtctcgctctgtcacccaggctgcagtgcagtggtgccatcacggctcaccgccagccttgaccttcacctcagcctcccaagtagctgagactacaggcatgcaccgccatggctggctcttttttaatttgtctttttctaaagacagggtctcactgtcttgattaagctggtcttggaactcctgggcttcaagggaccctctcagctcggcctcccaaagtgctgggattgcargtgtgagccatcatgcaagtctggggttgttttttttttgytaaacaggatgaatagaaatctcttttgggggatctcttagtccaaatcctttagctgaatgcgcgtgtcccrgtgaggctgctcctctagatgctgcgggcattttgcagacgtcccaccaactgccatcagcgaccaattagaagatagggacagctgcacatgtcacacagcccttctgaccttgtgtgtgcttcaagtccgagattcctgacacaaagcagcgtgtgcccccccacccactctgtggccacagctggagtcctgggctgctgggtgctccaggtgccataccccacacacgcatagagcccgtgggctggcagcgggcacccacagtggcctctgcaaagcctgcctggctgcggctcgtttcctcactgcagcatgctcataggaatgtgggagtttcgcttgaagtgtgggtaaagagttctggggttgtttgagccatcccaggccacagggcctccaggaagtggaggaaatggtaaatccagggtcctcttggccactgcgttggcctctgcacacttggcccctgcggaccctggggcttctgctttactgtctgtgacataaacaagtgacgcttgccaccttcttgccgggaaagccaggctgggttttctcatttccacyttttccctgttttacacgagggcacgaggatggggctgcagtatcagtgacgcacctgtcaccagcgggccacagagctttgtgttagcccctctcaagccctttagcttctggaaccgtttaaattcttaaaaattatacaggaccccaaagagcttttgtttatgtgagctttatctattgacatttaccatactaggaattaagaggacatttaaaattatttagctacataaaaataacaataacaaacttactacctgttaacacacattttaaaatgaaaagtggctacattttccaaaacaaaaaacgtgaatctttagctcaatcaatgtttcaaatggaagcattatgacagtcaaaagctggcaactaaacataactggcacaagctctgccaccgagacaatggaggcctgagtagtaggctccctgcagaatgaaaggactggagctgccagcatcaacaccaacgcatctcccaacaagggtgagtgaaaacacacacctaaagacctcagagagcacgtaagcacacagctgtgcatccactctgagggtgagccaccaagcacacggtgaccccggggagcgcccgaagggagtgaagtatctgaaggaaagaaggaagtgagcgatgggcaaaggagaacctgaggaccctggcacagtctcagctgcaaacatctagtcttgcttaactggggtgcagaggccactgcacctcagggttctcacgaagcgcctgacctctctattttattactattattattattattttttttttttgmgaaggagtcttcctctgtcgcccaggctggagtgcagtggygcaatctcggctcactgcaacctccacctcccgggttcaggcgattctcgtgcatcagcctcctgagtagatggaattacaggcatgtgccagcatacctggctaatttttgcatttttagtagagtcggggtttcattcaccatgttgcccaggctggtcttgaactcctggcytcaagtaatccgcccgcctcggcctcccaaagttctgggtttacaggcgtgagccaccgcgcctgagccctctaagagcccccgcctggcgtcgctgtaggcaaatcccaaagaacgtgtcccttcagcagccggctggggcgccacaaacactatctgttgtcttcgctttagtttgtgtcaaagtgactcaaagttacacaacactggcgggcgactgccgcctttttaccctgtggcctttcccatccaggcgtccagagggtgagcccctgccctccaggacccctcccttccaggaccctacccgtctgggactcaggccttccctgactcctccctcccggactcacccctcccagatccctcccctccgggaccctctcccctcccgggccccctcccctccgggaacccctcccctcccggactcacccctcccagatccctcccctccaggagcccctcccctctcgggacccctctcctcccggacccaccccttcctgacccctgccctcccggacccctgcgggactagatgtatacagctgagaccatatcacggttctcaccctcgctctaccctcccggacccctgctctcccggacgcgtggactccagctcccgcctgggtccccaaagcgctgaacccatggtcacttctatgcgtagccctggtgcccgccgcccacagccggaccgcactcctcggcctccgcctaacccctggctcagccacacgagtgacagctctgcccgcccgggcgggcgacgccgaggggtgsgctcggccccacctgagcagttccccagcgcccctctgaaacccgcctgtggtccctggcgccgcctctaggggccgccgccgctcccctatgacacagcaacaataggggccgctctggtccaagcgccctgcggcccgcgcttccgccggaaaagagccgccggcgcgggggcggaccggggaggagcgagtgcgatggacggtcgccctcgccaatcgttggcaggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggtgcgggagtcgccgggcctggggcggccgggggcgaccggaggcgggggcaggggctgctggaccaaggatggggcgggggcagccaagacgagaaggtggccggcgcggcgggtggggcctgcgggggccgggccgggcgggggttctggggtctcgggcgccgccccggttccgcctgcggctctgaacgtggggctcggcgggagctcgggcgggtctgccccgcggagcgggtcgccggggtggcgcgtcgaggctggtgccccgcggagacggcgtcaagcctagggccggccccactaggcttggcggggctgccccggcccagcgccgagtgcgggcggtgcgatcgtcgtgagcggggcaaacgcggaaaggcagcccggcgtgtctgagtctgccttaggcagctctgggcgcaggccccctgctcgcaaacaccccagggggcgggagcttgccggaccgcaggcgacagtgaccgccgcgtctcagcgtcctctccgcgctttcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgtgagtgtccctgagccgcagcagcaggacaggcgacttctcgggccctcggagtcctcgctttggagttcgcggtgggggcttggccgcatctggggaccgctcgtggggccgtcatcgactgccctgctgatgggtcgtcctggtttccgcggtgacaggggcatctcggccactgtgtatcttgaactgtccgtgtgaggtgcctgggttggaggtgtggccctggagagcccggagctctgtgcctggccttgaactgtccgtgtgaggtgcctggggttggaggtgtggccctggagagcctggagctctgtgcctggcggcttcactcagtcttctttgtttttcaaactcttagttgttctttgttacatttgagagcagttcrgcgttgactttttaactactctgggaatgttgtttccagcacgtctcagaaaccccgttgccatctgaaaggccccyttccctgctctctcccccggccttgcctttcatgggctgtctctgaccctggcttctctgccttgtggagaccctgccagcgaggggtctggcggcttagctgccccttgcgcaccccacccggttagacccagggctcagtacgctctmctgagactgggcacagtgatgccatctgcgccactgactctctcttcccctggcttgccaggacttgatcatcttccctgacgactgtgagttcaagcgggtgccgcagtgccccagcgggagggtctacgtgctgaagttcaaggcagggtccaagcggcttttcttctggatgcaggtatggggcargccttggggttgtgcctttttgttgccctgcgattcggttaggaacttgcttacagtgtggtgcaattggcttttataaaccagcaggcgccggccacacccggccacacggcctgagatgccacctcagggctgcggtgcatgctacctggggccgaggtcctctcccagagtacggaggctcyaggctgggctgcgggcaaccgattgcggtgtgaaatttccaggcagacagacatgctggccctggttctaacgatgcccagtgccctctctctgccccttgccgtgggtcactgaggcccccacagcagaggcagaggcccctgtgtggcttccctgctggtgctcacagaaacgaagcatcctgctcacactttccacagtcctgccccttccctggcagtgtgtcctggaggccaggggtgtcagtgcccagggtttctcttacccacagctgcagagcgtcttttgggtctagaggccgctgctcattctgccatctgtcagtgaccattgagcttgttgccgttttttgtgctgttacaggcagtgttgcaaagaatttcccggtacacagatcattttccataagccagtatcatctgtaggtgaaaactggtggcgggcctgtggtcaggaagcgtgtgcatgcgtttgcagtgtggagagagaaggccatgctctctgccagaggtggagctgctgtccccaccccaccccccttggcactttcaagagcaggggtggccctggctgaggtctctgtggagcacatggtctgtgttgctggtcacctgtgcaagtagtgtgcagcggcctgagaaaatgaacaggcatagccaaactccagttaaactttatttgcaaacacagatggcggccacaatttgccacctgctggtgtagaacgtgtttttccacggttttgccaagaaatagtgtccaactgttaccaccatctcccttttttccccgattttcctgttggtggcttttaagtcccccrtccctgctttgccatgagagcagggactcccagtgtccctggcgccctgcagcttccatagccattcggggtgtgcgtgggtgctctgctcccagctctgtgagctcgcaggtcgatgcttctgacactgatctgtgcacatgtgtgtgcacacgcgtgtgctcgattgtgagcgcctgccgtggccctgggccgcggtgtgctgagcgggccagttcgctgccttccactggttgaaggaaggagacgggtgtgtaaagaaccgcaccccagagggcaggagggtgagagggcttggtctggcagcagctaagtgccttcggagctctaggctccccatttgtgaaatgggcggagggggacagggcacacccgggattgcggcggatggggacagggcgcagagcatcgtgctcaggaggcgccactgccgtcccctcacctgctgggccgggtcctgtctcctcagcattgtgtggccaggcacacgcgcctctgcgtctcaggtccctcacctggaagccaggtcagaggatggctgtggtggccctgggtgagctggcrccagctcctgcccttacatgcccttcctcttgcaggaacccaagacagaccaggatgaggagcattgccggaaagtcaacgagtatctgaacaaccccccgatgcctggggcrctgggggccagcggaagcagcggccacgaactctctgcgctaggcggtaactgtcacatgtgtcacgtgagctcagggtttcctgggaggccagagtctactgtggatgactcgccccctcagcacaggttgtttggaagtggaaatagaagattctaaaagttagagaccctgtgagckccctggrtcactccccactcccaccttcacggggtaggacgggtctgcatcccaccgtcgcctcacttcaagtggtgccccctgtagggttcaggggcagccgagtgcggtgctcagcagaggcgcaggcagygcggtggggcccgcgtggatctggctggggcaggcccgcctgagctgcagtgttttccaggtgagggtggcctgcagagcctgctgggaaacatgagccacagccagctcatgcagctcatcggaccagccggcctyggaggactgggtaacgtgcgccacccgggctctcgggcagcttctgctgggaatgctttgaggcccggtctctgtttcstttaaacttctgctggctctgtctgcgtagtgtcggggagcctgtgtgtccgcaagctggttcccctttgggaatgcgcttgtttgcctgtggctagagctgggtaggcgagggcttmtgggcccctggtgaggaccccagctgggtacttcagaggagggtggctggccgagcggtggggctggaggactggagggagctggggttcctgcgccctgggtcccctggcccyacatggctgcctgcctgctgccagctcatggagtgcagacccgtgtgcttggcccttcagaaatgcttgtccctttgggtgggatctggactgaatcttctaatctaagcacatgaattgtgtaatgggatggaayagaaatgaccttgcttccagaacacagccgcaagtgtccacccgccccaygccgctcctccaggcctgtgggtccccaccgccccgcttcttcctggctttggtgttgggaattcctgctcctctggcctggggaggggccaggctctttctggtgggctagagggcatcctgagctcgcatttccttgcccctcgcaggtgggctgggggccctgactggacctggcctggccagcttactggggagcagtgggcctccagggagcagctcctcctccaggtgagcctcatcgctcctgccacgcargtgccacggtgttaagggaggggcagtggggaatcctggcccagcaccctggaccctgcgagtargccctgccgtgtggggcgygtccgctccagcggtgccctctctcttcgcagctcccggagccagtckgcagcggtcaccccgtcatccaccacctcttccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaaggtarcgtgtgctgtcgcctggagctgggtggggggcatggggcctgctgaccctcgcacgctcaccttccaaggcatctgcctagtgtgcgcgcctggggtgctggggccatgggctgagtccctgcttgcatgccttccatgtgggcacttaggctgtcatcgagctgatggccgtgttcttgtgccccagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggtagaggccgggcccagggtgtccyccactgtgtgctcmgggagtgggcaggggggaggaggaggccctgccccaccttcaccatggccagtgcttcatgtgcctgacccgcasagctggcagctgagcagtgtggctctrgggtgcagcccgggttggagctcagccctcgcctggctcttcttgcaggccctgggcatgttcagcgcagccttggcctcggggcagctgggccccctcatgtgccagttcggtctgcctgcagaggctgtggaggccgccaacaagggcggtaagtggctgcgcctgcacctccaggccagagccaggggcagggtccattcctgtccccctggatctgcagaagtggggctgagggggtaaaggtcacagcccttctgcccttgatcccatcgctttgatcccmagttctgggcaagggttagacaccaccttgtgtctttaacgtgttctagatgtggaagcgtttgccaaagccatgcagaacaacgccaagcccgagcagaaagagggcgacacgaaggacamgaaggacgaagaggaggacatgagcctggactgagccacgcgccgtcctccgagsaactgggcgcttgcagtgcgttgcacaccctcacctcccacccactgattattaataaagtcttttcttttacctgccaaygcttagtttctttgcccaaagggagtttcggctggacaggtgctagcgtggggagctgctgtagggtcccagagacagttagttatttgacctaacaacggaaaacggtcaccccaggaagagtttggtgcctctgtccaggccggttccagayctgtcttgagacthtctccgtatttaagtcaacattcattcggttacacagaagttactttttaatttttaargaggaaccagtgatgattggtgacaaatctctcacaattaaaaatgggtggaagggccaaatataaaaacattttgcagtattttattctttcgtttaagaagctataacttaaaccatcttcagaaacaagatctgtcacccgtagagcttagagtccaaatagacacctatgaggcgagcacaaggrgcggtgtgaggcagctgcaggggcctgaccaggggccggggttggctgtgtcctaggcggctgggcagccactggcccccactgccccgtggacctccacagagcgagtcatggcgacgggggaccggttcaccgccagcctcctcatgcagccgcagtaggcggggggccagggctgcacggccatgggctctgggggcacagggaagatggaagaaggctggttggtgggcagctagagacccacaggcccttcccaaacgtcagtgccccacccagcccctgtctcattccacatcataggagggtggkaggggggtgggaggagggtgggagggggcagggggtggaggggtggggggagggtggtaggttaygcagcacctagtcctgaggggcagctcccccacccttgatcaaggccgcactcaccaggcaggcccccgaggtacagaggggctggggcaccagctgcagccgccagcaaggggcccacggtgtggttgctctgcgcgtccacctccagccggagcacattcccgcttttcatcactgggagaaagggggactyctgaggccaggtggtcctcagcccagcctctctccagccccaaaagaagccaccccacccagagtcccgcctggctcccgctctgcagaagggtgggggtggcagagtgccctggccacaggaggggcctcacccgctagccggtgccactggccatcacacagcactgaggggcgggtcactgacgtggagaactcccctgctccgtcatccgcccgcagcaggacctggmggggtaggaagggagggtcaggctatgcccccgaggtcaccagaatggggaggcaaaccctgccctggcacgccacctctgccaggcttacttgcttctcggtcacctgcaactgcaagtaggggggcgtccgggcctggcccaagtggaagatcagtccggtgactgccaggggccgcacctccagttccaggcccacatcaggcagtgtagctcctgggaggtctgcggggaggggttgtgatggagaagaaagggggggcccctccccagaacctcctggagmcccctgccctgccctgctgrggcctgggatgccagcacccacagacctaaagtgataactcccccgctgcctgggaagaacaggcccgcctccagggggcccaagatgcagggtgtgacccctgccatccgtgtgggggcccccaggggcctcccgtgcagcctcagtctcttcacacagccgctgaacccgacggtcacctataggagcagaccgggcagggatcagggcccagggcagctgaaagggaacagtgggtggggagtgggggctggggcaagatggttctcaccggaagtttggagctgtggctgctggccgggaggccgcccacaaagagggtgtggggctgggggtgctctgccccctggtgctgccggtgcggcccctcctggctccaggcccgggccccgtccgtcaccagcaggatccggttcttctcccagcgcacggagacctgggggcaggagatgggtcagggtagggctgccaggccctgcccaccaccttccttcttctcggccctcaccttgtgccagcggccaggccgggagcgctggcggctctgggcgcggagccgagtcccgaggccttccatctgtgcaacgaagtggccattgctcaggaagagcgccagggaggggctgccgggcctcagacgggcagtgaagaggaggaggcctcgggagcttcgcgggaggacgtgcatggagagactgggcctggaagcggagctggcgtcagcctgcgcggcccctctcagcccaccccagccgggcctggccttaccagttcctatgtcgggccaggatgcccacaaactccaggtgactggacagggaacccccaaactggtaggagtctcgggtggtcctsaggtgtgggggcagcatgcaggcaggatgccgggcgggctgacggctgcggcgggaggcctgggggcgtggatggtgaatgcaggggccgcccrcacaggggccacccttccagccaccccagctctgcctgctcacccctggggtgcccaccttcygggcggtggcctgcagtcctctaggccccaggcccggggtctgggcttgcagggcgggtgcacagcccgtgctcacattgacgctgcccaggttctgctgcagatcaaatacgcgctgtgggcccaggagcctgtgcagggcrggcaggyggtcagcagctgcggaaggccagctgggaccttgtcccccagcgcccaccaggctcaccgctgcacgaagacgttgctgatgcagccactgaagttgtaaatggtgccagactcaggcaggcctcccaggaggagcctcgggggcccctcaggctgcggctggagctcggggggtggtccccggtggggcttcatctgctggagctggtcatcgacatacagccagactctggggggcgggaggccggaggctcggtttttccccaccctgcccacccccacctcagaggagacagaggtccaggcaagtgcaggcgggcgtccctccagaccttcacgatgagggcccagcggccaggctcaccccgtggcattrctgtagaaggcgacgtaatggggggcaccatcggcgaagcccgcttgagttttcacttcagtcctcaggagctgtaggctcacacrgccctgctgcagggacacctggcatagcccatcctggggacggcagccaggtcagccggccggcctggggacccagactcattccagacaccccagtcccaactgctccgacggccaccgcggggtggggaatgggcacgggtgtgaggtctcaccggggacgcccggtagtagagcarggcactgtcctgggcgctgtggaagccgaagccrgagtagacgttgccagtgagcggtgccacgttcgagagcgccaggcgaaggaagccgtggccatggaaagtcatggcgcgccccacctgcggggaggccatccctgagtgcccgckggtgcccctgcatgtccacagatgccacccccagcccggggagggctgctcaccagcaggtcggcrgtgcagccggcgctcacgcctgtcgtgttcagccgcttgaggtccacatacttgcccagggccttgatgcctttgacgcagccacggastgagcctccggtggggaagagccrtcgcaggctgtggggaagcggggatgcgggtcagggcgccacctccaagcccagcctaccgccccaacagcctggcctcggagccccagctgcrcacagtgcttacctcgggggcagctggtcgggcggcacgccccccaggtagtaggcgtcggccagctccagatcattgtcctgctccacgctgtacaccgtggcccgctccacacgcaccagcacacgcttgcggctgccccccagcaggaacacctggatctacaggaccagtgggggctccagggccagctgtgtccctgcggcctgccccgcccccatcgttccatctcctctccctgccaccctggtccccaccctggccctaccgccttgctggccgaggtcaggggcggtgggggctgcagtgggacggcctttttcaggccagccccaaagtcatacaacagcacgaggctgccttcttgcacggccaarcacaggaactggctctgcagaaacagggcagggttagtgtggggcagggycagtgcaagtggggatggcaggaygggtgtgcctggcgcacctgctgcttcaggaagaagagcaccccgctgtaggacacgagccgcagctcctgctcgaagcgcttggtggtgctgatctgactgtcgaagctgatgcgggcgaagccggtgccgtccaggtaggagccgtccgtgagccacgggtccccggtcgacttggagctgcaggtcggagattctggggtcagcggagggtggggtggggtgggtggagacggggagggcaggccacacgcaccgggcacaaggcctgtccacagccgtgtccagctggaaggtcctctcgaagttgtagaggctgaccacctcctcattcagcgtgtccatctcgatgcagccccggtagccggggaagcgaagcaggggagggggctgtgggcacagggctgggtcagggcacctggcctgaggcgcctcccctccaggatggaccaaggggacttcagactacagcaggacggactgaggcaagataccaaaagaacccgcggctctccaggacacaagcgactcggggctgcggagcccctcccaggctgccccaggccgggcgggctcaccgtgaaggtactggggtaccccccgacgtagaagacgaagtcgtctggccgcaggttgagcagcccctctgccccaggggccaccgtgtcacccttggtttcctggatcatctgtctctccactgtgacggacatgtggccaaactggagagtcctgagggcagaggcgaggggtggcgagtgggcacggagagatgaggggtggcgagtgggcacagagagatgaggggtggcgagtgggcacggagagatgaggggtggcgagtgggcacggagagacgaggggtggcgagtgggcayggagagacgggtggcgagtgggcacagagacgaggggtggcgagtgggcacagagacgaggggtggcgagtgggcacggagagacgagggatggcgagtgggcacagacgaggggtggcgggtgggcacagagacgaggggtggcgagtgggcacagagacgggtggcgagtgggcacagagacgaggggtggcgagtgggcacagagacgaggggtggcgagtgggcacggagaggcgaggggtggcgagtgggcatggagaggtgaagggtggtgggtgcacacggagaggggagagatggcgaacgggcaagggccctgcagttggaggcatccggcctctctcctgggcctcccacctgtccaggctgacagctgcgaactgctccccaatgtcctcatcgatgcttaggactgcagggcccgcctcacccagctgatacacccagtgcaccttcttgtcacgcagagacacacccatgtagtccccagtggcctgcggcagtgacagacacacagtcgggatggggaccggggaccagggaccaggcaccgctcatttccaaacagagcctgagctcgggccgcatccacccagccagcctggtacctggcggctgcccatgtacatcacaaagcgatcctcggtaccctgcccaggctcaggctctgggccctgcaggtagaacttgagggcagtgtaggcagcaaggtcggcaagatcccgtggggtgcgcagctgcacccctgagcgcccgttgaacttcatgggcaccttgacctgcggggcayggtccatcagcgtccaccaccaccctccctgatgtccaccttcccctgggactctcacccaccttactggcagccccccgggcctgggcaatgagctctcgcacgcggccaatgctggcggacagggccaggctggcgttgtgcaccccacggttctccaggatgctcagcttggccagcagctggggcagcgtcttctccagggtggacactgcagagagggagacctgagacctttgccccccaccgtgcccgcctccatcaggggcaccgcgagggccatgggcgcacctgagtggcctgcgtcaagcactgcctggcccaggtcctggccccgcaggccctcgtactggccctgccaccgctccacattctcctgcatggcctgcagctgggactgcacacgggtggcggtgtcctgggcttcagcagccacagccttggcatgtgcgatcttcttgcttgtctcgtctgtggtgggcagagggcaggctcagcaggggccagcggggaccatcctggcttcatgtccccaagtctttctgttgggc
